United States Patent 11,549,145 (METHODS AND COMPOSITIONS FOR INHIBITING AND TREATING NEUROLOGICAL CONDITIONS) - sequence listing, part 2

SEQ ID NO: 11 - DNA, 515650 bp, Homo sapiens
ccatgctcaggaacttaaattccatctgcaacttagtaattccaacatgccttttctttaatgcaatgaatgttattaggaaaaataaagacattctggtcaaatattaataagtgggaaacatgggacatctcatagcctttaatacattaatctgaattttaaatcttctaaaagtagataaactgtacatatttggtataactttgcctttaaaaataacacatgaaatcatttagttgttatgaagtacattccttaattagtattccacagaacacactttggaaaaagctgcaatagacatgagagtcattgcaagggtttcatgcataatagattttcattttagaaaaaaatggtttaggccaggcgcagtggctcacgcctataatcccagtactttgggagactgaggcaggtggatcacgaggtcaagagatcgagaccatcatggccaacatggtggaaccctgtctctactaaaaataggaaaattagctgggcatgttggtgcgcgactgtagtcccagctactcgggatcctgaggcaggagaatcgcttgaacctaggaggcagaggttacagtgagctgagattgagccattgcactccagcctggtgacagagcgagactcggtctcaaaaaaaaaaaaaaaaaaaaaaggtttaggaaagcaaatggttaatggatagagaagagaataggaaagaccaagagaaaggcagttattgtaagaattagtcagatgatgatgaggtcttacctaagccagtattagcagtatgtggaaaaaaagcacatttcctggataaattaagctatatacatctggctaaaaataactaaatgaggaaaagagacatttaattatttcaggctattgagtctcccactacaatcaatgatagcaagccccagaatgtatgtgagaatgtatttttggagtcttagttatcaagtacattttacttactgccaactggcctctctgagtatgattcttgtatttaaggatttttactttttcgtgaaacatggcctttaaacaaaagtcaaccacttcatttgcactcaatatgttctgttgctgcagggaaagctggtcatgttgaacttactgagagacagtatgtcagactctgatgtgatgatttcctaaggtattctcaaggatgcttttgaccatatgtaattattctcctttgaagatgacttcagcatccactccctgtgtaggttataactgtgatcccaggtaggactgatgaccgcatacttccccctttctctctaaatctattcacttgattctccagccccggctacaaaaatatatttgcatccttttataagagagagttttaataatctctagacaaaagtagaagcaccatgggcattagaagctgaaaggactgagattttatggcttttctgggaatatcaaacaccaataaaaccagcccactcaatttttgaataataaaactgaaattcagagaaagaaactgaccaaatctgatccaatatggcagaactgaaaggtaaacccaaatctttaagaggttttaatctctagagactatttatctctcttaggatactccagaaaaggcttttctttcttttttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggaccacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggcctgaaaaggcttttcttgaaagagcaaacatgtgttatgttattttctcttaatttcaaaggacatgcaaactttagctgtgtggaattacatggtacaaaggcatagaaccttcatatgtatctcctatattttaaaatgcctcatttttatcttcttcaatatagagtaattcaatacaaacagaaaacagttgcattttgagaagtttgtaaataatttgattttcctagaagtttaacagaaagattcattctacctataaatgtaaagaaggttgttccttactccataaacactggcatactccactttatcacaaaataccaggggccgagtcttcaatattgcagtcctttgtagctaaccgcctgtatggacatttagttacagccaaaggtatttgttcttcatttgactggatgggatcctgagcccttttgactattggctgatgtaattacagagctctcaactttctaccacaggagcccctgatgatgcctaagaagaactacagcaaaacataatgggctatgagttgaagaggagggtatcctggtgcctcactggtgatggcttggccagccaggttgacattccacaccactgttaaagacaggtgcccatcagaagcagcaggccttctgggaaactgaggaacaacagctgcagaggctgcagcagggcagcagccacaatgacacagtgttgttcaaagagtgtggtgatgttgggagtgatagagggaaggcagcacgaagtggcttacaggagggaagtcaaaaggggtggaaagccaaatgctgctgaccaaaagctggtggtggcactgtggtaacgcagcaatgccaagcacatcatctgtagcaaccttgtggcccataaaggtgatctgcagaagaacaagatcccaaagctattgggtggcaggagcacaaaaaagacaaagctaagtaaccaaacttcatcttcaccagaagcttcagactgcagctagggcatgttggaggaaatggaagttagagaataacagagcataatcccatctgccttttttttttaatggacagatgaaattgtatgaatttactgtgtacaacatgatgttttgaagtatatatatatatatatgttacagaatgactaaatctagctaattaacatattctttacctcatacagttatcatttttgtggtgagaacactttatatccactctgttagaatttttcaagaatgcagtatattatttattttagtcaccatgttgtacaatagatctcttgaacttattcctcctatctaactgaaattttgtatcctttgaccaaaatctccccaacacccaccaaccacccaagcccctggcaaccaccatttctactctctacttctatgagatcaactttttaaaattccacatatgaatgagatcgtgtagtgtttgtcattctatgactgccttacttcactaaacaatgtcctccaggttcatccatgttgtcacaaataacatgatatcccttttatggctgaagagtattcaattgtgtatatgaaccccattttctttatccattaatccattgatggatgtgtctattcacccgttgatttcatatattgacgattgtgaataatgctacaataaacatgagagtgccgatatctcttctatatactaattaatttccttgggatatatactcagtaatgggactactggatcatatggtagttctgcttttaatcttctaagagactttcatactgcctgtattttaaaagaaatatgtgtacatgtttatgcatttgcatatatatgcatgagtgtaagggggtatagatagattgtatgagcataggaaaacatttggaagcatattaatcaaattatttactatgattatctctagttgaaaaagaagacaggtggaggagggcactctcttttcttaattatacaaaaaatgggttgacatccatggcagtagcaatggatttcacttttttttaagtgtttgtttatttctatacatacatttccaaaagtctaactctgtgttgcagctccatttagtgggaagttagaaaaaacttcttcatatgcgtcatccttattttataactctgcaaatgggtatatccttctgaccctgcagaaatatgaagctcaagggcttccaagagtgtcccgtacttgggaaagtaatatgatgaaaatatgatattggctttttccttttattttcatcaaaaaagaaaaaaatatacttgaaacatccttgtaggaaaattgccattccagaagatatgggaaaaccttgttattttcgcattccccatcaatccatgcttttgaggtcctataccagtggccatgtctatggatttggtcatgccaaaggacacttctccagtgtttttactgcaggaagccaactgtcttccttcctattctgaattgaggagaccttaataacatgaatagctgagaggtagccaaagtagctttatttatcccttgacttgatgtctctattcttttgccccagattacagcccagacaagcaaaagaaatgagaataaatggtgctgggaaaactggctagccatatgtagaaagctgaaactggatcccttccttacactttatacaaaagttaattcaagatggattaaagacttaaatgttagacctaaaaccataaaaaccctagaagaaaacctaagcaatgccattcaggacacaggcatgggcaaggacttcatgactaaaacaccaaaagcaatggcaacaaaagacaaaattgataaatgggatctaattaaactaaagagcttctgcacagcgaaagaaactaccatcagagtgaacaggcaacctacagaatgggagaaaatttttgcaatctacccatctgacaaagggctaatatctagaatctacaaagaactcaaacaaatttacaagaaaaaaaaaaacccatcaaaaagtgggcaaaggatatgaacagtcacttcccaaaagaagacatctatgcagccaacagacacatgaaaaaatgctcatcagcactggccatcagagaaatgcaaatcaaaaccacaatgagataccatctcacgccagttagaatggcaatcattaaaaagtcaggaaacaacagatgctggaaaggatgtcgagaaataggaacacttttacactgttggtgggagtgtaaattagttcaaccattgtggaagacagtgtggagattcctcatagatctaaaactagaattaccatttgacccagccatcccattactgggtatatacccaaaggattataaataatgctactataaagacacatgcacacatatgtttattgcggcactattcacaatagcaaagacttggaaccaacccaaatatccatcaatgatagattggattaagaaaatgtggcacatatacaccatggaatactatgcagccataaaaatggatgatttcatgtcctttgcagggacatggatgaagctggaaaccattattttcagcaaactatcacaaggacagaaaaccaaacactgcatgttcttactcataggtgggaattgaacaatgagaacacttggacacagggcaggaaacatcacacaccggggcctgtctgagggtgggatgttgggggagggatagcattaggagaaatacctaatgtaattgatgagttgatgggtgcagcaaaccaacatggcaaatgtatacctatgtatcaaacctgcacgttgtgcacatgtaccctagaacttaaaagtataataaaaaataaaataaaattataaggcaaaaaaagaaaaagaaatgagagtaatattctatttaagaagataaaacagtttttacttcttttctcagttattagcatccctccatataacactaagtatacagtaggaaaaacttgtcttctaggagtcacatattcattaaaatgaataccaaagctttattaatgaagctttacagaattttattcccaacaccctcattgattattgctaactaaaattttaaaactccaatctgtaataataactcccacaaagaacattagctttgaatttgttgtgcatgaggctcacctggagtgcttgttgaatatatagattcctgagcatcacctgtaattagtctgattcagttcaggtcaggcatgaatcccaggaatctccattttatcccgtactgcaggcagtctaatgaaagtaagctaaaagttgtggttccattgtagtgatttgggggatatggaatagggtacaagtctcaatcctcatttttaaaagataataaccttggatatgactagcattcattcatcattcagtttaataaatatgtattgattgcctacatgttccaggcactaggtagtaaggataccagcacaaggcaacttctgcccttgaggagcttataactttagaaaaacaggagctgagtttctgctgccctctcctcatgccctaggtgaccaaatgatattctgttatcatcattactttaagtatcatctgggaacataaggcaaaaggttccttaaacattttaatgtcttggacagaaatggtatccagagggcattggaggagccatgaagcctgcaaatactgtgtgaggcaagcctttatatttggtgggaaataggaggatggtaagaggtgtctatacaacagcaaagcacctttgtgtttgccagaatccctgatacgtaagtcatgatggaaggcttaactatctggataatcatgtctatgactttgaccctgaagaaatgcaaatacagagggcctaccatgataatatttggtacagaggttggacagaatgtccaacagcagtctggagggttcaaatgaacagtgttggcaatgtttttggcagcaccacagccagactacttctgggtatgaggtgatctacttcagctccaacacactctctaagattggttctccagccttctgattaggtcttttcagtaaatttgttttctacttttgttgtcaggtcagtttctgctatttataatcaagaaccccgactgataccaaaaccagtatcagtaggtaacagagaacacattctcagagaagtggcaggatgaaatcctgatatgtggactacgtaggcccaaaatcatagagaatcccattagcacaggagactgaaagaccctggaatgtaatgataaatcagccaactaaattatcatctctgtttatctcgaatgaagtgcccattgaggacagttctctcggatcaagttgctacttccatttaaaagtgaaaagagcatagtagtcaaagactacagagtgagatgccagtctatcaccttactggacagctcacagaaaaagaataagagttccccaaattctcatataaatgttgtttatgatgaagctaaaataatattttatttactgatgcaacaaggttcaggaaattatgtctgctgaattcactgccattgttctagggctggtgtgacccctaagaatatacaggaggtttggaaaaacttggactacttgaatcctcatctcccactgccagccttctccctgtcaatgaggtcatctcttttggcttgaagatattgtcttagcttacctaagggagttaccttaccaagtggaccaacttttctcatgtccacttttttttcttctttgtcttcaaacttaaaaccacagccaggtttcagcatgtcctggaaagccagttgcaaagtcaagccaaagaagagaaagcttacacaccaaacatcttcagtaccatactgacttataccactggaatcttgagaatatgtgtgaaaaataaaatagatttattgtaattcgaattgaaatagatggatgatgaatctacccaaatttattattatgtgtgccagaaattctacattaagcattctggtcaaacatctgagaatagttctaattctttgctcagctggtttgtgaaattctgaacaatataaggtgttcacataatattaatgtgatattccagtaattattttgactaaggtagagaaaggaataaaaaagcacattaaatagaagtcctggagtagctttatcttatacatctgaccgaccatttttatttttgtaattaagccccaaattaggtccagagaaatgtccagacctcttggagattattacgctctggttatgagctaattccaggagatttatagtgttactctggtctgcaaatcaaagtgagggttgatggaggtcaagtgatgagttctgacactaatctacctcatacaaaacaaaatgagacatcaaatccatcctgtatttattttccccgttctgagtatcttaatccattcaggctgctataacaaaacagtataagctaggtagcttataaataacacaaatttatttctcatatttctctttatttggctgattaatctatcattacattctcaggtatttcaggctcctgtgctgatggaattccccatgactttgggtccatgtagtccacatatctgatatcaggttttcatcctgccatctctctggaagctgggaagtccaagatcagagcactggcagatttagtgtctggcagggtccctcttccaggttcatagatggcgccttctcactgtgtactcacatgttggaaagggggtaaggcagctctctggggcctcttatataagggcatcaatccaatttatgagggctctaccctcactacctaatcaccttccaacagccctctttctaataccttctccttgggattaggatttcaacatatgaattttggaaaaacacaaacattcagatcatagcatcaaatatataattggaatcaataatcctcatcaaatatagaatctgcctctttgttcttggcccatggaaattttttcttggtggaaatagaaatccctggggctctccatttctatcaaatactaaatcaaagtcaattaggcattcctctggtattagtaccattcattatcaataaactaaaggatatagtgatgatgacttctatcacatccccattcaatcatctagattgcctcatacacagcacagataatcataagctcaatcaggtctgactcttattaaagtttctaatccttgtctgatttcattattggagcctatcaacacagttcctgatacctaatatgtagccactgaattgatgagtatttttttcctctaaactaaaacatcactagcagtttgatttttatgtatatctttgcagtgtttcttcatgattacttcaatgtttcactcagtatcctaatttattctgcaagatattttaccagatataatgttgaatgccattctaccacattgaagagatctttcttttttaaaggatctacagagcaggaggcagtaatgcagtggatgacatgataagacatgtgtgtagagggtgacgcctaaaactcataagaaaatatagaattgtaacttcaggtaaggttctgaggttccagtgctctggagttattgaaatatcacctttcaagctttagacaagttgctacacatcgtgaactatgtttaccccactgtttggtagagcttttttgattttgaaagaaatatatacctcatttggtcatacttttctgaaccatttactcagtaacctgaaaaaccttaaactttgagacagatgcagagcaaaaggttctctggaccatattccaggcagcagcgaaataatcaatgccccttgacactcatgactcagtagattaaatggtacttgatatatctctggcaggctagaatattgtattcaactttgatatgcctcagtaggagaaacacaggaatagacccttaggccatgtactcttgagcaaataactatattccttttggaaaacagctcttgactttctactgggtgctgataaaaagtaaatgcctagccacaagatatctggtgatctgagctgccaatcatatatatggtattatcagattcaccttatcatgtagcttcttttcattaagaggaagaggttcaaatggaccacgttgtgagcaagttctacaggcaaaaatcagaaacatgaacaggtgaattttgtcacattatcacccctcatcagcccacactatgtttcgaggagaattaataactatgacctggaatgagttaataaaaatatgcatgcatggctgggcatgatggtcaaattcagaggagggcactccttaagaaaacaaataaaacttatgagtaaaaattaaaaagataccagatcttggaagaatccttgcatatgaggagttcttaaacttaagcttcattagtttcacagtaaagcctacttttgctggtgtcagccagaagtgtataagggaggcctgggctctacctcaattcatgggcaagacggaagtttttgccatttggtcagcaacaataagatttaagaattggtgttgaagtgtttgggggaagaagtagatagaagatctgtgtctcatgtgaatgtgtacctgaggtgctcaccatgaaggaggtgctgaggtaatggcattctctatgctccttctctaaactcccagtgattgcccaatgagctcatgaacaaagtagctatggtggcagggatggtagctcttcatgggctcaaatacatgaatttacctcacaaagacctacctggctactgcctctgctgagtgctcaatttacaagcagtagagactaatcttacaatatataataataatatactctgtgaggaacagtgagatacctggtggcaggtgattgtgttaagccagaagaattttgcagaaagtaaatcttcataaacaaggaaggaaaaacatcagaaattaagcttataaactctggaaaaatcatacaggtttgtaaaaccttggagagaaccagtcagagagagaaaaataatgcatagttagtatggtataatggtccacagtctttcaactataactttaaagatactcagaaatctagaaggaatcttaaaagaaagagttaaagtctccttcaatagctgctccaaagttattcttctcatattccactattttttttttgccatggctttagggtccacacattatagcaatggcattacaatgagattatcatgagggattttatatatacaggcatctccaactagcaatggtttttcagctttacaatgggcttatcaggatgaagcctcatactaagttgagaatctccttatgacttaagatggggttatggtttctactgaaggcatatcactttcacatcaacataaagtaaaagaatcctaaatcaaaccgtcataagtgaaggaccatctgctcttttgccagcactatatgcactttccacttaatgatatttttaacttatggtgggtttactgggatgtaactccattattcagttgaggagtctgtgtgtatagaaagagacacagagagagagagaaacaggcagagagagagagggagggagggagggagggagacagagagggaatttgtagtcagagaatcaccactcaaatgagcaaagagtaattgcagcaaagctaaacacaatttagttagttccaacttaggaaaagttcaaggaggattttgggcacttaagacaaaaagcaatgcaagaagggcaagaaaatcacatacatgtgaaagacttaatgggaccagggttcttgagataccacttaaacgttaataacccagagcatctcctgatgactctgatcatgtcagtgtacgtaaaaatcaatgaaggtgtatactgacactgccttacctgtcatgtaagaattcctgcccagctggaatcaagaacaggaaaaaggtatcatctcacaatcccatatcctgtgtaaagtggcttgggtttgggggcaacttacgttgcattagattactttctttttctccgcaacccttgtcgatttgagaaagggcacatggcttaggattagccaatagggtgcatgtggagtcggggactggattgcacttgcaaaataactggatgagcttggagtccaggctttggaaggtggcaaagcgtgaggtgattgggctagaagagaggcatagaggtaaagacagtggcaaagctaaagtcatcctggaccatgtggtaaattgtcagcaaagtcactaaagttaccaaatgacgagtgtgattggatttgctatgaagtagtgaatggtatgaggttcaatgcaagcagtggggagacagcagaatactaacagacagagatgtaaatcacaaaaacataaggcagaaattgtagaatgagctttgtgttgtcacaagaactggaatcaatgttttgtcaaaaatacaaccggctgtctctgtggtgctttataatagtgtaaaccagtactcactacctcaccctagtttggagagaaaggtctcagtatacttgaaagtactgagaaaggctcagctgttttcccacatccatgttcccaggagagccctgatgcccaggactaaggagggggaatgaggctgaaagcttccaatatgcattttcatataaatgtcctgttgtttgagaaaaagaaaaaatatccctctctgttcagctccaattctatgtatcacactggcccacaatgctggggaccttccaggtcctttggttcttgtctattgcttccctatggggcttctcctgatacaacttgcagatcatttctcaaaaggaagtcactggagaaaaaaagatctactaagatgttaatatttgctaaaacttttttaaattttgggggctttaaaagtcttttctgccttgtcagcatgttttggaggaacaaagaagtgtgagattaacagggtatggtaaagacatggggatgcaaatgagcatttgattttgaggctagaaggggaccaaccatgttggtcaagaatttatgttaggaggagaagggagatgaggctagaaaagaaataaaagaaagattggactgggagataatttttctgctgggattaggggcttgaacttcatctcataggtaattaagagaatatgagagattttaagccacaggagtcagtgaaaggatgccgtctttaaccataggtttggcagggaaggctatggagattttacccactttgttcctttgcccactcttatgggaggaagttctttagtactagaaagtggaaagacatatactatacaggcaaaatgaaaaatatctactaaaaaacaattaatacaagaggtattaacaaggttatagtgttgctacaatgtgaatgggtgggtgttgtagaaaaccgttcataggctggcagaaagacagcatccttaatgcagttgcgagtgatgagggaatgttagtaatctattgctaattaattatctattgttatataatggatgattttaacacttagtgcccaagaatccaggcatggcttagttggatcttctgcttcaggtctctcacaagactataattaaggtgtcagccagagctggagtctcatctgaggcttgacaggaacagtctacttacaagggcatattgttgtgtataggatttagtttcttgcaggctgtcagaaggcttcagttccttgatggctgttggccacaagtcacaccctcagttccttgccatgtgagcctctccatagggcagttcacaacatgggggcttgattcatcaaagccagcaagggagataatcgatagaaagtgcctgctagcaaagagaagatgtaatcttatttcctataactatggaagtgatatactaccattctgttggttaggaggaagtcataatgcatactcacactcaaagggagaggattacacaagggcatggataccgcgaggcagtgataagtggggagcatcttagagtctgtctgccacagagagatagactaaagatggtgtcagtgagaacagaaaagaaaagattggggagtggagaggcatttagagagaaaaatggagcaggtttggcaccttggagataaaggggctgaagcagctatgtgagtctttgggaccattgtttttcacatttgtctttttctgagacaatattttggttgtcctttcgcacattgcaatagaaatcttctggcattaacattttaaactctttttcaattttattaaaagcatttcaaagggatgttttgtgtttaactctttaaatcttcatgatcagcctataatatttaacaatatgtataaattggccattctttctttatctatttctttatttaccagaaatgacctctggtcatgacttaccagtttagagttttcttttttaaatgttgctgttgcttaacttatctttccagagatttttttcaaatgccagataagtctgcattataatcaatacctgtcttctcagatgaaatgtttttcttttgcatatggagacaatgttaattaacatattaggaatgtatttggtacatttggttgcaaatgcaaacagtctaatctgttactcattagacctctttgtctgaagcattcaagtgagtaacaggttgcactgagacatcaccaaagtgattcagttatcctaaaagtactcattttgtttttttctgggaagatttatgtattatgaattactcagattgcattttcattttataaccatggtaactactatgacaacacttaaaaggatggtcatgttaattacttcactaaagaagaaatcctggccaaattttctacactgaacttagcagagaatgttaacagtatcaataggaactaaaacatcattgaagattttgtcctttggggctttatattgatgttggagaaccccagtgaaaaagctgaggtacattaagatatttaatggctgggctccgttttcccttttgagttccatttcatttccactcattatttatgtttatcctttatggaggagtttatcctttgctactggagttcataaagggaaagtcatgtatcaagtgcctactatgggttaatactttctctatgatctgattttatcttcccaacagtctttttgaggcaagtactattgatttcctcttaacagatgaaaaattgagttcattcagtgattcttctaataaataggtattgactgtgttttttaagcaacatggacaaaaccttacaattagaattgagatacttgagatttaacacaaagtccatctgattgcagagcctatgcattttatgccacattttttcttcagtctgtcttttccactttaagattttgtctgactatagcagggtatgttatatgagtgtgtgtgtgtatgagagacagagagagagacacacacacacagtcagtgtgtgtgctgtgggtgggaatcagatttttccatattcacattcagaaagtcatgttataatgaacctacttcacaaagaggcagaatacatggtgtaatgtcatttactatgggaaatgcccttttctaaaagaatatcctttcctccatcttttacgaagggtaaaatcttaaacgcaataatacccaagggttaacatgcaaatggaaattaaactcaaggagttaatttcacatgtaaaagtgactcatagaagatctttcctttcttgagatccatgtttccagggcactgagcacactgggactaaaggttagactggaaacttggaatgaaaggctaaggccaggtaccgtggttcatgcctgtaatcccagcattttgggaggccgaggtgggtggatcatttgaggtcaggagtttgagaccagcctagcaaacatgatgaaaccccacctctactacaaatacaaaaattagccaggtgtggtgatgggcacctgtagtcccagctacttgggtggctgaggcaggagaatcgcttgaacctgggaggtggaggttgcagtaagctgagatcgcaccactgcactccagcctgagtgaagagcgagactctatcaaaaaaaaaaagaaagagagagagaatgaaagaaagagagaaagagagaaagagaaaaagaaaaaagaaagaaagaaaagaaaagaaaagaaaagaaaagagagaaaggctgaacatcagtttgtatctgctcgtcctgaaatgaagcccaaagaacaaaggaaaggtcctgctatgatattgtgctccaactcatcacatcatgtcacaaacagacaatatgttagatgtggggattaagtggtcagtgaaatcaaacacaacatctgctctcctggttctggcaattcagtgatggagacttgagaatcaaataataaaatgatcccacaaataaatgtactattgcaactgttgttagaactatgaaaaaaagtataatgtgctaagagaaggaataaaactgggggctgtcataggcaagggagtcagggaaggctgctttccgaaatgaaatctgaattgagatctaaacctatcaccttttccttaatcccacctctccgtatgtgttctccatctctgtaaatggcttcacaatctatttgctaaaatgagaaatacagaactcagctctgacttctctctctccctcatctcccactcaatcatcagatcctgcctatctacaaaaattattttctttttgtccacttagataagccttttctctgccaccagccaacgtctttatctggaataactcaacagcctcctaattagttttcttctgcctcaggtcttgctcgccttccgaccttgccaatcacaattcatttcccacaatgcaacaaaaataatctatcaaaaatacaaatataatggagtcacaatcctatgttaattttttggacactcccattgcctttaggatgaaatataaaaccttaagatggcttcagaccctttattatctgacccctgctcatttctgtaacagattttcttcctacttgcacagtatcctctggccatcttcaatttctctgttcctagagtaaatcctgttctctctttcttccttcctatccatttgtctgaaacactcttcttagttccttctctcgtctctcctacacgtaggtatcttctactaatcctcaaagtcttagctttctgatttcacttatttgtgtaaacttcggttcccaaaagtagatctggactcacatagcacctgtcacactgcgtcataattgcaaattttcattgtattaatcccttactagattgtgacttgcctgaaggcaggagtcatatattttcttgcttaccattgtagcccctacattaggacagttccaggttcactgcaattgctccctgaatatttattaacagacaaggaagaaggaacaagggaaagaaggggagaaataaaggaagatgagagagagggggaaggaggctcggaaggaagaaagagatagggaaatgaagaagggaagtcggaagggagggaaaacagaaggaatccttaggaatgcttcattgttcttaccttatttaaatggctttgaaatgaggaactttgctcatctatttgagcagggcaatgtaataaaacttcccacaataatgaaatgttttgtatttgttctgaccaatgtggtagtcactagctacatggagctatttgaaatgtggccagtgtgactaagaaatcagatttttaatatgattttattttaaatttaaacaggctacttggttagctactatattggatatcatggcctagaggagccagtggcagggccaaccttgtatgcaccctttggacaacccctcttttaacatttctgcttccttgctgctcaataccgtgttcttcactgcaattttcctagtgtgtttaggaatttttctaaacttctcttttgccaggctgggcagcaaaagtcaaataaatgtaacacagagaataccatttacacttcatttttaacagccttaatgagagtcatttcaattttgcaaatactggtaagtaatgtctatatatatattcaaaagctgcatttttcctgaacattctctctaacaaaaaaatagtgaaataaacaaatagcctctcagactattatgctgaatgctacaaaatcagctaaaaaaatcaacaaagtttaatgtgaacattgcttttcattcctttggcatacagagaaaacaacaggctgcagaatagcaggaggcaggcagggcagagagaggcagagacaaagcgtaagaggaaaagtgacttaatctttgcctctcacaccaagcttaatgacaattgatcagtcatcactattagaaagcagcagtgtggagagggaagagcactgaactgggagtcagagtcttcttccacattacacagacctgcctgggcaagctatacaactctgaacctcagtaattttcttcttacaatagggaaactacacccactctccctttctggttaggtttttgtgaatttcctatgaaacaatatatgcccaatgaatatacaagtttttttttttcttttttttgagacaggatctcactgtgttgctcaaactggagtgtagtggcacaatcacagctcactgcagcctcagactcctgggctcacatgattctcccgtctcagcctcccaagtggctggaacaactagcatgtgccacaatgctcaactatttgtttttgtttttgtttttgttttaatttttgatagggacagggtctcttattgttcagtacagacgctggtctcaaactcctgggttcaagctatcctcctgccttggcctctcaaagtgccgggattttgggggtgggccaccatgcccagccagttatccctagtgttgtgcaaaatgaggcaattttaaaatgtgaccactctctgactcgaaataaaaacatcaggactgaaactaagcaaaatatattattttcattgttttaacagccatactagcccacttacctttcttcagttcattgaaattatcctgaattttttttctaatcaatatttcttacaggaaagtatttacttccacactcatcctggagcctagaagtgccatatagttttataccagtggccacagtatgtgttggttgagtagatggagaggggagaagaactggcaggagagcgttggaattcaagatacaatgatgtctgcagataaaatatatctttggatctgtcctatccggtatttttccttttaagtatatacttcaacttccatattatactaacttacttgtctgagcaggtgcccacttactcttaaatgttatagtccagttcgtgtgccaagacatttttttatccttgagagaggtcatccattcaataagtttaattacattttcaactatattataactacgggaggtgctccatgaaaagaaagaaaaaacccttaagatatctccagtctgaaggtggaactcagatgcctgcagatgacacaatgaactagcagggcagagcaaactaggaaaaaataggctctgcctgtgtgtaatgtaaaacctccagactttctaacagcctcccagaaggttgtaataaaagccacccattttcaatagcattcctattttgaataaaaagaatattgacattctgtgggtgaaaatttcaatttgcaaattttattttcgctacagacaaaaccaccagaaaatgacagcctagaaattaattacacatggaggagtccattacgttagatcagactaagtggttgctatagtcaaaatatgtttcaattgattttaataaagtttaattatttacaatatgttatattctatgtgggaagattgcacatattttctgatatatttccattatgagaatacagttccactaaataggtctagcatcattaaaacctctatgcacaaattgtgacctaaatgaaatattaccagttttcacagtttgtattaataaaatgtttgtaataatagatttatcaactaatcaattgtgacccatgtatacaaacacagttgctttctttgtgtatccatccatccatgcatccatgcatccatccatcatagaggaagtttgatatggagcaataacaagatgtttaaaactgaagagacctgggattgaatttagattctactatttaataataattatgtctctgggccttggtttctcattataacatgaatacatacattacctaaacaacaagttattgtagcattaaggagtatagtaattgttgtgggattcgtttttaaagtttaaattacaattatcgaatcttggttgagatgaggcaaggtaaagcagctcttagccttgtatggaggaagtccctccactaaatagtgataatagtaatatcacatatcctccattagaagatacccaagccatgttcattgtcatggctcagagacaagtgttttgtggttcagaaattgtggttcagaaataattttagactggtcagcataatcttcttagatattttgatttctattatgtcaaattatgtctttctaattaaagtagttgaaaactaagtcattatttttaaaataattactttttaaacatcattgaaaagccagtcttactctgatgagcagaagctagaagtggcagagcagccagggtatgggactgtgccagtttttgtgttcttgttcatctgatatttttttaaccaactttattcatcctgacttctcctttgagaagaagtaaagtaataaaaaaaagagggttcagcagcaaccaagtctcaatcgaagataagtcattggcatttgctctgtgaccatctctgtgtatattaagaaagtcaaaaggcagttgttgccatttcaagtattttttggtgtacaaaacccacataaacagatctttgcctaatgtcaatacatatttaactcagtcaaaatgtgtgatagactagggagaattaaaactggcatatataaaaggcttaggttaaactcaggagccatttctgagaaaaggaaaaaagaaaagtgccttgaagaatgcctgctacagagtaaaaataaaaaagataatacatttcattccccaaacattgactgagcccctactgtgtgccatgtaccatctattcttggccaaattaaactaggtcattgctctggagaggcctataattccatactagaggaattcactgaaagatataaataacatgagtttgataagtgtgatgataaaggcacagcacactgtggcctcaaatagaaggaaggagttcactcagctgacaggggaaggggaggttaatgtaagagagtgctgttctcagaaacatggaagacgaggggtttatgagactttggtctgtgtcagtcttgtgcttgaacccaaaatgctgtcttggcctcgggatctctccctattagtagagcagtttggcaataaaacaatgacacaaatcctggctttgctaccctccaagctgctctcattcattcatttgttctttcatcctttcataaaatattatcagagtatttacatcatatccagcagttccacatctgtggattcaaccaactagatggaaaatatttgagaaataaaaggatgtttgcatctgtgctaaaatatacagatttcttgtcattatttcttaaacaatacggtataataagtacttaaaaagcatttacattgtattaggtattataagtaatctagagataatttaaagtaagttggaggatgtacatagtttatatgcaaatactacagcattttataccagggacttgaacatcagtggattttggtatgggaagttggggtggggtcctggaaccaagcctcccacaaatactatagaatgatggtacttacaatgtgctaggcactctgtaaacagaattaataataaaatggatattatttttgtggagcttataatatgtaataaataatttaataattggaaacaacaacaaggatccataaacatgcttttgtaaattatacaatagtctatggacaaagagaaaaagggaacacagagaacatagagtaaacctaccttaggcattagcatgtgcctctccagggctcatgtttacattgaggagtgaaggaagcggaagggtgaggagtgggaagcatgagacagcagtggcaggggaggcatttcagggaggagaagggtgcccatgcccttaggtgggaatgaagtgtagcatgctcaagctgggaaaggtggccagtgaggggcagctgtagtttggcaaggaggaggcaacacaaaagtgctcagtcaaaattcagttatgatcatttcaaagtgttctctattcaactcaggtagagtaatgccagagttactgaaataatatgaatagaggtaaggtgataaccagcccctacacacaacaaagaggcgaggcaaaaccagataaagtggattatctccacctgcccattggcatgctctgccttctgctctgcttggaactcttgagggattctggacgcagatggtctcgattctgcacttaaatcctgctctcgttgtggtggaaatatcaaaaacacctgctctttgttatctgttaggcaagttctgtgcgtcaggcactgtccatggtgccagcatcctattcttcctgacacgtgagccaggtcatggtgctgatctgcttccagcccactgaaggcttccgatctccttcagagtaaatgctgaagtctctttgctcactttcaaggcactagatttgctgcctcctctctatcaactccgaatactctccctcactcatttggaccattctgtagagacagctctacaagcagctcagctcaccaggcaggtgatgcctcaaagtctttgctctgctagttcctctgctggaaataccctttgccccagtgacatggtggttcagtccccttactttcttcaactcctttccatcgtgaggccttccccatgcattccatctaaaattgcactccaccctaaccctctgcatacttgctttattttgctccatagcatgtatcttcttctaatgagctataaagtgtacttaaaccccaagaaggcagaaatttttgtttgttttgtccgttgctaatccgtaactccaagaatagtgccatagtagatattcaaagatatttattgaaagaatctcatttaatcttcacaaagcagcatgcagtgactagctaaagatgatggtgaattagttttcatgaagtcacaaaaatcatttcattgacgaattaaaatattgtattgatgaataaagtaaatgcccacaaaataaacttaaatgttgcattcataagttttggtagtttttcagcctcatgaaacaaaaatcaattacttaatttattatagctaataattttctttgctattaatcatatattatttgcattgtgacaacattatatccagtgactggatttcaatttgaaattcaaaactgtagaaatgaaataaaaagttctggataagatttcaattctattcttataaaatagtatctcttgtcttctggtattacggtataaactgtacattttaataaattatatattcaaagtataaagaaaaattggtctccaacttcaatttccaacaaaacattggaaaatgtttcattttgctggcattttaaatttaaaatgtaaacttagattgcagagggtttgttgttgttgttgttgttgtaccactgtaagaaatgaaatgcaaaatagagcaaaattgaaagaaacacaactagccagacagatatgtctcctttctaaaattatggtgttcaaatttctcaactttgtatttttttgaacttaatatcttcagacacaagcctctcaggctgttaaatggctgagaagactatacacgaaaacactcctgtgtaggctttttaattagctacttgtctttgataatataaggtgtcacttttattctcctgttgaactctagactgtcttctccatgagaatactgagattattgggacaaacatgctcagtcactatattccttctgagtctagttataacatgttggatccaagaagcttccttccagaatgtaactggagaggtcaggttgtcaattcaggcaagttggctaagtgagagagtgtgagtaggtgggatcttaagtctatggagtgacacattgggcaagagcagcagtagggagctgagtgagtaacttcagtacagtgaagacagccatatgccttttcccttgacctccttcttaggtattctggtgtatggggacatgtgggcacaggatttgggggacctatcctcagtcgctgatattcccttggcttacaaatagattccaggtgaattaactataggcttcaattaaaaggatggggtacagtgatcagacagggcatggtggttccaaatccaggaaaagtgtctttcaaaactatagcatctgtccttccagggaactactgggctataacaaaatgataaaaattaatctttaaaattctaacactaatattgcttcacaatctgatcaaaaaccctaacaatgtggtgctgtgtgtgtgtgtgacaaactcttctacagtgatacaaatattcttgtagttctggtagctctaccctgatgtaaaatctccccaggtggtgtacaactcaatgccttaagatagtaatcccttaacacgtggccattgaccagtgaataagtgaatgaataaatggtcaacaaaggaacatccatctcctagcaaatattggcagtttactctaaagagcaagtaatgaagctttctgataattagcattttcaacttagcttttttaaaggctaatgataaaaagattcttaacaaaattagacattacaacactttaaaaaatggaacaatttatcagtaataaaatcattttctttcagtgacatattagaaactatatttagaaaacaatttgtaatcttacacaaatcatgtggactttaatacataccagaaaaagttcattttgtacaaagttgtctgtctgctaattttaattttctttataatatagtagctttcatataggtatgtgaaccaatttgctgacctctctctccttctcctattctgcccccaaacgggatgaaggtagcacttcagagtgggcagatcaaggagacttagtcctagacaggctgtcctgcatctgtttttcttcagacaaattgaagcgttccagttgatggtgccaatcaactggaaagcccatttgcataaccccagggcatatacctctgacaatgtagaatgaggtatatgccctggggttccttgtctggcaccaggaaaatttaggacacggacacacacgaggagtttaggagtggaggtttaacaggtagaaaagaagagaaggagaaacagctgtctccatagagagaggggtctctgagcggcaaagaccggctggtggcaaacgcgccgagttttacagtccacattgaggaggcagtgtctgtttaacatagggctcatttgatcaggtatgacatttacatagtacatggggaaggctgctcaccccaccctaatcttcttatgcaaatggactttccagttgattggcaccatcttgtctgctcctttacagtacacgtggctggcaaagaagggaagatggagccaccatcttgaacacccctagtccttagttcccaccagcattcatccagcaagctcccagcttgcaggatgctctttgttagaaaatgatttggggccgcttttcattaaaaagacaagccttactgaggactccatgcccttctatctgcctaagtgatttcttcttaactcctgtatcaaaattactgaatatgtctggatggcttactttccttacttgtaaaatgacaggaagaacatctgccctccctaccacccaggtaatggggaaagagctttgaaaattctgaagcagaatacaaatgtaaaacactaacatgacatatcaccaagaaagtccctttttgcttctggagagtgactctacagctgcaagccttcacccaacttctaactggaatgtgtgggaatttctagggagactggccttatctggaagtacacggaactatgtgccttactctgtaaattcagaggcaaagctgctgagattgtgccagctatgccacaatagagttggccaaaagcatttatttaagataaaccaattcggaaaatcctactggatctggtttatacaaagaagcctgggggtagagggtgtcctcaggttgagatgatgaagatgtgactatctgttacgggctgaatatgctccccttccttcaaattttgaagtcctaatccccagtacctcagaatgtgagtgtatttggagataggacctttaaagagataattaagataaaaagaaatcactagggtgggacctaatccaatatgactggtgtccttgtgagaagaggaaatttggacacagacaggtacagagaaaagtgtgaagacaaagggagaaaacagtcatctataagtgaaggagagaggcttcaaaagaaagcaaatttgttgacaccttaatcttagacttctagttttcagggctttgagaaaataaatttccattgtttaagccacccagtctgggtactttgttatggcaaccatagcaaattaatacactctaccttcatctttctttccccctgcaagaagggaatacactggaacttaaacctctttttccctcaaagagtatgcccaagtctttcccctattaggtaggtcagtggtcactggccttaaagttgctgagtcactgaacttgtaccatatttgattatttgatgttgaaagggtaagaaagatggtaggagacagagggtaaggctgcaagggaaccccaagagcagcttgcattggcgccacttggtatgagaagaatactcaagtctcctgtggacctagtggatgctgtatagagcagctggatcccatttggagaggttcctggtagagcaagaggttataagggaagattttccactgggagaatgagagtcaagaagaagctaggccttggcagacccacctttaccaaggaggagcagagatgtatgccctcacctggaggaggtctccaatgagccacaggtgaacagctctcggctattcaacattcaaacatgagctgctcaggagaatcagtagctgtttagggatagaccccaaagtcagcaacctactaaaagggggatggttaacttggaactgcaaccatgctggtgatcagaaagagaaagtctgtttcctccttccatcatcaaggaggttgttggagaggacagactatatccttccttaaacacaccttcctttccccaagcagttccatcttccaagtctggcccatgaaagtggataagtggaaaaattttagtaaatagtttgggttatataaattaatgactgacctaaattttacattgcattgaggattaaagaaaaaaaaaagaaagtcctttctggccagaatgggaaatttggggttcaaatgtgtgcagccttgagactcaagtaagttacatcttgtgtatatcagctctgaagctccccagccaaaaccacttagtacaaatgaaatataacaaagttgcttggtgggtattttactcaaacctagtaaagttctctttcatcctcagcacttttttttcaaaattttgtaattcacctcaatcttataatcccactctgaaatttcaatgttgcttctgataaaaaaaaagactagcagtatgatcctgagtaagtcacttaatttctctgacaattaactcatctgcaaaatggggataatagtatcagtttgccgggtggttgtaaagaaaaaatgatatacagcatataatgttagtctggcccatactacgtacttgatcactggtagttactattattattattaacaatacttatatgagtgaatcttatattctaggaacactaatctatcaacgttatccaaacagggatactgatgttcccacacaagctatccatccagaaaatatatggcactcaccctggaacacataccctgatgtcagttgtcacctccttggtgaagccttttttgactcctagtttgtcttccctttatcctcttccccacactgcagaagtaactgtttacttcactgtgctttgttcaatatgctggaaaagcacttagtacattagtctctccaacaaaacaatgagcctagccaaatggctagggatgtggtttactcagatttgtgcctagtagatagtatgctcaatattattactttgaatcaaattgttggctgctgtattctcacttgcaaatgaggggttggactaggagatgctctacgacaactgtgtcagaatcctctggagagcttcttaaaatgtaagtttctggcctccatgctcagtgagcctgactcagccagtcaggatggggtccaggactttttaacaatcttttaaccccttcccatgattactatataagggatccatccacgctccccttcatctctgggattccatgattacatgagtcagataattcacatctgaacatgcccttcactcatttcctaattcaactctttgtgggagaaaaaaagaggttttactgttttctttccaatgtagcagccaatttgtactgagaatcaattgctcactgttgagcatagaagtattttaacatccaaattagttcagtattgatgaagcatttcatgaaattgtttcagggcccacaaactagtctattttcatgcagatgccttaaaatggcctatcaagtatcatctacagtatttccagctccaaacagtctttcaaggagctttaggagctttggagttctagctccaaagacccatgggtaaaattctgtgagctcatgcagcagatctctaacctgtaaatcttgtgtatcaaatctggtcactttctttgtaatagtactctccttccttcaactcaaatatcagtattaaaagccctacatttttttaaacaaataaaaaaatagctgctttaaggttgcaacatcagctgtgaaggacatatattagaatagttccaggttttaaaatggggagtgcctggccattttgcatcctctgaactatccagcatcttcttatccacttagcctatgtagctagaggaaagagacaaaatattaaaacctttgaagaaggatctaagacctgtggtcactgggcagaaaaggaagaagcaaaagaagtaggcatctggcatctgggaagttctgtttgtccttggcaccttctgccaatatttcctttcccttaagaaaaactacgagagaagagacattgggcatccttccaaacctcaattgaattgctggcaaactctgattaattattctggggaatcctggttgaaaacctaacatgaatatgctacttcagcaactatcattagaaaaaaataatcaatttaatgtatctgcaacagtgctcattgggaatgttttctcctatgataaacacaaaatttacttcttctttaaaacctgtaaattatctttgttcctctgtaaatattggagaatgttctctgttctggccttagtatactcaggacaacccacctccaagcttgggtttcctaagacatagatcatagagaaccctcaagcacattatatttatccttaaacatatctttttctccaaatttctgctacttttctaccttgattatctggtaaggtctacattgcagaatgctggtctccacatggcacatgcactgccatttctcctccctatgccaatagcagatttcattatttttttatttttaaaattttaaaacatactatatagagagatgagtatacataacatatatgtacagtttacataataataaaaaatcaatttatgctctactcaggttaaatataaaaacatctatggtattttagtagctcctccctgatttttgccacattttactgctttcagagaaaacaactgtgctgaattttatgataatattttcttccttctctttgtagttttaccactgtattaggccattctcacacactactataaaggtatacctgagactgggtaatttatgaagaaaagaggtttaattaactcacagttccatgggctgtacaggaggcatggctggggaggccacaggaaacttacaattattgcagaaggtgaatggaaagaaggcacatcttcacatggctggcaggcaagagacagcgaagaggaaggtgccacacactttacaccagccagatcatgtgagactctatcatgagtcagcaggaaggggacagtgctaaaacattagaaaccacctccacgacctaatcacctcccaccaggccccaccaccaacactgggaattacaatttaacatgagattttggtggggacacagattcaaaccgtatcaaccacctaaatgtatatccttgctatagtctaaatgtgtgtcccctcaaaattcatatgtaaaaatttagtccccagtgcaacagtattaacagatagggcctttaggaggaataaatactattcatgagggctttgctcttataaatgagaccagtgtcctctaaaagaggcttgagggagctctccagctcttacagccatgttaggacacagctagaaggtaccatctagaaagcagacggtgagcttttaccagacatctaaactgctggtgccttgatcttggacatcctagtgtccagaactgtgagtaacaaattctaaattaccgagtctaagatgttttgttatagcagcaggaacagactaagacaacccttaaaaaacccagtttttgttgctagtttttgacttttatacaaataaaaacatattatatattttcttttgagagttgcttctctttctcaatataatgtaaaattctttcagttgatgcataaagttgcagttcacttatagccatcattatctcctattctatcatataaattaaccataattcatatatcaactgatggacatttaggttatttccagcttgggctggaacttgggaaaatgatcctgccctgccacctcctctttcttgttttctgattttgtccagagaacatgacacctacacctgctctagccatatagtaacgttaggaaaggaatagctgaaatgccgaaggtaatagtaacattaggaaaggaattgttgaaatgctgaaggtagcaaatctgaaagaaaggaagagaatccagtcacatcactgaactgtctctggaaccaccaacctccagaaattttgttacataagattaataaatccctattatttaagtcacttttatacaaatattcttatttgcacagcctaaagcacacttcttcatacaagggtctaagatgccccagtgacactgttctaaggagaaggatggttccaagcctagcttcatagttggtgaaagaactacctctgtgagatgtagatgatttggtcatctgcctcttcctggcactggtcttaatcaaattgctgaaatagataaattgtcataccatccctccaacattccttagtaccttctccttagctgggttatccagtaagaacaataggcacatgctttgggcacgagcagagaaaatccaccaataatttatactaattgttataatcagaaaatataaaaataatattttaatatcacatatacacaagttctgtgatttacactaaaatattgctttgaatttgagtaactgtggtacagagatgtggtgcacattcttatctggttcttctccccctcctgggcctactggaaaactgtgcttcataggccatcacaggcagtcagggctgttgactaatcctagtccatgaaatgtgaggagaaagactgaagattttcagaaatgctgctgactagtgactactatgggttttctacttttttcttttctaagtggaaaatttattgtagtttcctgtccctgcctcactgaggtatattggaagggtggggagcaagataaacctatcttttttattcataggttaccagactaagacatgtcacttctagaaataatggagaaggctatctagatgacatggagatcttgaactatacaaaggatgtggctcaaggatggcatttttaatacatcttcctgaggaagtgattaagtgtgttcttcatgtacacagaagaattaaacaattatttggtgatcaagaaggcatgttgcactggagatgacatgtgctcagatatactctttcctactctccttcctgggaagattagaattcccagtcaccttgcagttaggcagggtcctgtactagttctagctagtcaaatgaaagaagaagtgatatgaatctcttctgagccaagtattttaaagtaagtgtgccacctttatgatctttctatctccttgagcaataaatgtagtagccacattttattataaaataatggcctacaaaatataggaaactttccatatagaagcagaagagtgccccctaacctgcaatagactttacatgatatattggttctaaaccactgagcctttggaagtttgttgctgaagcagaacctattgtgttctgactaatataattatataattggaaacaaagaagtacctgcacgatatttaggacattgtttcccatctttctaggcccagtgccccttaaatgcttagagataactccttttgcagcccataagactcacgtctggacaatctgatcataccccaaatctattcccttctcactgactaccaaagcatcttcttcctgtctttggcaactctgtggtcttgcaacctatgtgctgaagaattcacatttaagtattaatatggcaatagcaatctcagaatatgtcaaggaaaaaaatagattttaaaattttacttacttgagcccctggcctgagtatctatatataaatcagtgtctacaggaatgcatttgcttggaatcttgtaaaagttacagtaggatttattgagagtcattgagacatcttgtaataaaagctatttacagtttaaaaattatgtatttctagaaaactgtaaggaatataccagtgtacctggttccagtcttcatttttttaatctgcaaggaattggtgaccatccttaaccagagttaagcaaataatgtagtctccttaatctttattctacactgcttatgcatccctcagtatctcacttcatactgttctctgtggggcatcctaatcttgctttaagctccttattacttacagggacacttgtttgaattaatttattattaaatattcacataaaataaaacttcatttcaaattctcttagagacatttgttgtctcattaagtacaaagaaataagtgagtaccaggtatgctttgatcagtgacataacaatttcaccaagaagccaggtacttctttgtcttttattttctttttttcttattcttttttaattaattattatttttttttgagacagggtcttgctttgctgcccaggctggagtagagtggtgtgatcaaagctcactgcagctttgacctcataggctcaagcaatcttctcacctcagcctcctgagtacctgggaccacagacacatgccactatgcctgtcaagttttttatttttagtagagacaaagtcttgcaagttggctaggctgatctcagactcctgggctccagtgatcttcctgcctcggcctcccaaagctctgggattgcaggtttgagccattgttcccagccccagtgtgttgttttttgctttttttccctctgttctcccatcttatgcatttacttcattttatgattgatttcttttgtggtcatctgaccgtagcattcccagaagtaacattcagacaagacaaaacttagagtcacggcagaaagaagatgcccacttcccgacttaattggaagccccacagcatacttttttccttcaggtctcactagccaggattgcatcacatatccattcccaaatcaaaattgacaatgagaataagaacttagaacagcagttttcaatgtgtggtgactgggtgtctagaaaatcaacaggccctttcaggaaatttatgaggtcaaaacagtttcataataatgctaacatgggatttgtctttttactgtgttgttattcacactgattgtgtaaaagcaatggtgaataaaactactttatcttagcatgagtcaaaggagaggcacaagagttgtctccagacacgaaggtgattgttttccccatcaagcctcctggctcccaaattggcataagaaaagatgcaacaacaaatgacacaagaattttgcataggagttggaagatcatgtcagctacaaacaaaaactaaggtggttgtgagttcagtgtaagcaacagtaatatttgaagatgacaatcacagaaatgactgttcagacttgaaccagcaaatactgttttaaaagagccacaaaaaaaagaaggggttcaattcttaaagatcttttgaaattttccattaaccaaaaaaaagacccaaaacgatgctaatgctacaaaaagtgttggcaactatttctataataaaatattttaataaagacatttgtaggccatataatctctgttgcaactactctgcttttatagcaatatataaaagaaataaatatggctatgtttcagtaaaaattatttacaaataaattttttagaagcagatgtaccatactttattagtagttctcatattttcctttgtcatgcacttggagtaagaaagaataccatttcactcaaaaatgtctttgatgaagccataaaaagcaataatttaataaatattggtgcttgaatttacttctttttaatgtcctgtgtgatggaattggaaatatatccatgatgcatttctgctgcatataaaatatatctcaaaaaattgtctggacaactgtttgagttttaagttgaactagtcactttttaatgcaatatcatttccttttcaacaacaaaagaccgatggacaaactataattattcagcagacattttgcaagaatgaataaagtgagtgaacctccacttcaaagaaagaaagagatggggagggagaaacaaagataaagatgatggaaaagaggaaaacaagaggaaaaagaaaaggaatggaaaggaagggaaaaagacaagataatagttgactatattttttgtcaatgaaaaaatttgaacttttagaggaaaattagaattctgaaaaatttgtctctgccaccatgagcttgtcaccttccaaatacctaaagacattttaaatgagattgttggttatattaatgaatgtaatactttttatactaacatttgaggaagagttacacaattccataaaccaacattcttataattaccaatgcacgatgttgcaaatttatgcacggttaaaagattcacttaacacataatataagtcaatggattttaaagcagtggatgaaaaatccattaatatgattttagttcatcaactaacccttgagaaactaccacttgtcaagttttagtgtagtaccggagaaatatctataattacattaaaagcttgtctattaaaatgctccttttttccaacaacatgtctgtgaaaggacagattttcttcatatattttaatgaaaacaacatattgcaacagattgaatgcagaagctgatacggaaatcggctgtcttttagttgaatcaaatattaaagattttgtgaaaatgtaaaatcatttaactctttttattattattatcacactttaagttctagggtacatatgcacaacatgcaggcttgatacattgatatacatgtgccatgttggttagctgcacccatcaactagtcatttacattaggtatttctcctaatgctatccctcccccaggccgtacctcctgacaggccccagtgtgtgatgttccccgccctgtgtccaagtgttctcactgttcaattcccacctatgagtgagaacatgcggtgtttgtttttctgtccttgcgacagtttgctgagaatggtttccagcttcatccatgtcgctgcaaaggacatgaactcatcctgttttatggctgcatagtggtgtatatgtgccacattttcttaatccagtctatcattgatggacatttgggttggttccaagtatttgctattgtgaatagtgctgcaataaacatacatgtgcatgtgtctttataatagcatgatttataatcctttgggtatatacccagtaaaaggatggctaggtcaaatggtatttctagttttagatctatgaggaatcaccacactctattccacaatggttgaactaatttacacttccaccaacagtgtaaaagtgctcctatttctcgacatcctctccagcatctgctgtttcctgactttttaatgatcgccattctaactggtgtgagatggtatctcattgtggttttgatttgcatttctctgatgaccagtgatgatgagcattttttcatgtatctgttggctgcataaatgtcttcttttgagaagtgtctgttcatatcctttgcccactttttgatggggttctttgtttgcttcttgtaaatttgtttgagttctttatagattctggatattagccctttgtcagatgggtagattgtaaaaattttctcccattctgtaggttgcctgttcactctgatggcagtttcttttgctgtgcagaagtgttttagtttaattagatcccattggcttttgttgccattgcttttggtgttttagccatgaatccttgcctatgcctatgtcctgaatggtattgcctagtttttcttctagggtttttatggttttgcgtctagcatttaaatctttaatctatcttgaattaatttttgtataagttgtaaggaaggaatgcagtttcagttttctacatatggctagccagttttcccagcaccatttattaaatagggaatcattttcccatttcttgtttttgtcaggtttgtcaaagatcagatggttgtagatgtgtggtgttatttctgaggcctctgttcttttccattggtctatatatctgttttggtaccagtaccatgctgttttgactactgtagacttgtagtatagtttaaagtcagttagcatgatgcctccaactttgttctttttgcttaggattgtcttggcaatgaaggctctttcttggttccatatgaactttaaagtagttttttttttttccaattctgtgaagaaagtcattggtagcttgatggggatggcattaaatctataaattaccttgggcagtatggccattttcatgatattgattcttcctatccatgagcaaggaatgttcttccatttgtttatgtcctcttttatttcgttgagcagtggtttgtagttctccttgaagaggtccttcacatcccttgcaagttggattgataggtattttattctgtttgtagcaactgtgaacgggagttcactcatgatttggctctctgtttgtctgttagtggtgtataggaatgcctgtgacttttgcacattgattttgcaacctgagactttgctgaagttgcatatcagcttatagagattttgggctgagacgatcaggttttctaaatatacaatcacgtcatctgcaaacagggacaatttgacttcaccttttcctaattgaataccccttatttctttctcttgcttgattgccctggccagaacttccaacactatgttgaataggaagggggagagagggcatccttgtcttttgccagttttcaaagggaattcttccagtttttgcccattcagtatgatgttcgctgtgggtttgtcataaatagctcttattattttgagatacatcccatcagtacctagtttatcgagagtttttagcatgaagggctgttgaattttgtcaaggccttttctgcatctattgagataattatctgcttttgtcattggttctgtttatgtgacagattacatttattgatttgtctatgttgaagcagccttgcatcccagggatgaagctgactttatcgtggtcaataagttttttgatgtgctgctggattcagtttgccagtattttattgaggatttttgcatcaatgttcatcagggatattggtctaaaattatcttttttgttgttgtgtctctgccaggcttgggtatcagaatgatgctggcctcataaaatgagttagggagaattccctctttttctgctgattggaatagtttcagaaggaatggtaccagctcctctttgtacctctggtagaattcagctgtgaatctgtctggtcctggactttttttggttggtaagctattaattattgcctcaatttcagagcctgttattggtctattcagagattcaacttcttcctggtttagtcttgggagggtgtatgtgtcaaggaatttatccatttcttctatatttgctaatttatttgcatcaaggtgtttatagtattctctgatgatagtttgtatttctgtgggatcggtggtgatatcctctttatcattttttattgcatctatttgattcttctctattttcttctttattaatcttgctagtggtctatcaattttgttgatcttttcagaaaaacagctcctggattcattgattttttgaaggtttttttgtgtctctatctctttcagttctgttccgatcttagttatttcttgccttctgctggcttttgaatttgtttgctcttgtttctctagttcttttaattgtgatgttagggcatcaattttagatctttcctgctttctcttgtgggcatttagttccatacatttccccctacacactgctttaagtgtgtcccagagattctggtacgttgtgtctttgttctcattggtttcaaagaacatctttatttttgccttcatttcgttatttacccagagtcattcaggagcaggttgttcagtttccatgtggttgagcagttttgagtgagtttcttaatcctgagtttgactgcactgtggtctgagagacagttttttgtgatttctgttcttttacatttgctgaggagtgctttacttccaactatgtggtcaattttaaaataagtgcgatgtggtgctgagaagagtgtatattctgttgatttggggtggagagttctgtagatgtctattaggtctgcttggtgcagagctgagttcaagtcctggatatctttgtttgccttctgtctcattgatctgtctaatattgaaagtgtggtgttaaagtctcccattattattgtgtgggagtctaagtctctttgtaggtctctaaggacttactttataaatctgggtgctcctgtattggatgcatatatatttaggatagttagctcttcttgttgaattgatctccttgccattatgtaatggccttctttgtctctattcatctttgttggtttaaagtctgttttatcagagactaggattgcaaaccctgcttttttttttttttttttttttttttttgctttgcatttgcttggtagatcttcctcgatccctttattttgagcctatgtgtgtctctgcacgtgagatgggtctcctgaatacagcacactgatgggtcttgactctttatccaatgtgccagtctgtgtcttttaactggggcatttagcccatttacatttaaggttaatattgttatgtgtgaatttgatcctgtcattatgatgctagctgattattttgcccgtttattgatgctgtttctttatagcattgatggtctttacaatttggcatgtctttgcagtggctggtactggttgtttcttttcatgtttagtgcttccttcaggagctcttgtaaggcaggcctggtggtgacagaatctctcagcatttgcttgtatgtaaaggattttatttctccttcacttatgaagcttagtttggctggatatgaaattctgggttgaaaattcttttctttaagaacattgaatattggcccccctctcttctggcttgtagagtttctgccaagagatctgctattagtctgatgggcttccccttgtgggtaacccaacctttctctctggctgccattaacattttttccttccatttcaaccttggtgaatctgacaattatgtgtcttggtgttgtcattctcaaggagtatctttgttgtgttctctgtatttcttgaatttgaatgttggcctgccttgctaggttggggaagttctcctggataatatcctgaagagtgttttccaacttggttccattccccatcactttcaggtacaccaatcaaacgtagatttggctttttcacatagtcccatatttcttgaaggcttcgtttgtttctttttacttttttttctctaatcatgtcttctcactttatttcattaattggtcttcaatcactgataccctttcttccacttgattcaatcagctactgaagcttgtgcgtgcatcacgaagttctcatcccaccgttttcagctccatctggtcatttgaggccttctctacactgtttattctagttagccatttgtctaaccttttttcaaggtttttagcttccttgagatgggtttgaacatgctcctttagctcggagaagtttgttattatcaaccttctgaagcctacttctattaacttgtcaaagtctttcttcaaccagctttgttctgttgctggtgaggagctgcaatcctttggaggaaaagaggcactctagtttttataattttcatcttttctgctctggtttctccccatctttgtggttttatcgacctttggtatttgatgttggtgacctacaaatggggttctggtataaaaatcttttttgtggatgttgatgctattcctttctgtttgttagttttccttgtaacagtcaggtccctcagctccagatctgttggagtttgctggagatccactccagaccctgtttgcctggttattactagcagagactgcagaacagcgaatattgctgcctgatccttcctctgtaagctttgtcccagaggggcaccagcttttatgaggtgtctgtcagcccctacttggaggtgtctcccagttaggctaaaagggggtcagggacccacttgaggaggcagtctgtccgttctcagaactcaaacgccttgctgggagaaccactgctctgttcagagctgtcagacatagacgtttaagtctgcagaagttgtctgctgccttttgttcagctatgccctgcccacagaggtggaatctatagaggcagtaggccttgctgagctgcagtgggctccacccagtttgagcttcccggcctatttgtttacctactcaagcctcagcaatggcagacacccctccccaagccaggcggccacctcacagttcaatctcagattgatgtgctagcagtgagcaaggctccatgggcatgggacccactgagccaggcacaggagagaatctccttgtctgccagttgctaagaccttgggaaaagcatggtatttgggtgggagtgtcctgtttttccaggtaaaatctgtcatggcttccctggctaggaaagggaattcccctgaccccttgcacttccctggtgaggcgatgccccgcctgcttcagctcaccctccatgggctggacccactgtccaaccagtcccagtgagatgaaccaggtacctcagttggaaatgcagaaatcacccgtcttctacgttgatcacactgggagctgcagacaagagctgttcctattcagtcatcttggaatccccaaaatcatttaactcttattcattttgttttgaagaacttggtcattttctttgaaaatgttatttatgcaaatatgcaaagggtttatttttattttaaaataaatatatacataaatatttaaaatattttttaattttaatttctaaaatgataaatgttgatagatccagaccataaaacagaagttctttagggtcctgaatttactaagattgtaaagagctcctgagaccaaagagttggagaactgctggctaaggctaatcaagacacatccactgaaactaaggttgtagtcagatttcctggaagcacatagatctctgatgtagagatagatatcaaaataaatgtagagttctgttagcaaagaagaaggcggtattaatgctgcagaaacttcctactgagtcacttattaatgacccagctgccatttggatcattattaagaatagctttgtgatgtgacagctctcaatctctctgatttcaatgctgtgtcccctacctccacccaatgactctgttttctctgccataattagcccctctacattttctggctctgaatctggtttgttaagataatataagaatgaattgagtaagagactggcttgttcttacagactagaggactgggccattatcacagatgatgtttcttggtttcagtccagccagggtggaaataaaaactgagaaaacgtcataaactcagtaactgtcaggcagcagtggctgtaaattttctacatagtggagcgtaaggtcagtaacctggttggaaaggagagtctataagacttattttcaagctacatttatagagcaagcatgcagttgctgttgtttttaatccatttggtacactacagataaattaacatagcaaagtttggtcaagatgtttttgttcatgcatttcttcagatttagaaaatgataactatccagcttaaataataagcctccaaggagtgacctgcgtggtgggatagttgatggagatttaaaagcagggaggttaaaacgggactcattttagttctaaaattactctggaaccatctctgccttgagaaagataaggaggaaaagaacgaaggaataaggtacaaaatccactgctaggtcaaggtcactaagtaaataataatacatgtggtggggtaaacaattcctgcttcctttgatacttgaagtagatcaagggtgcaggtgccagggaaggagtgatcttctgctggagacttggctaaaaggaaatttttggctacttacaacattcagcacatttaatagagtactagaaaatactgagatgttgatcacagaaataatagcatccacaaggctgtatgcttgattgagaaaaggattaatgaacagggttcagggtcagggaaagacattatgcagcctgagtttgctcatgagttatcagtgacaatgtaagagtctccccacctaatatttgagacattaattacataattccattaagtaacttgtctaatataatattgtgctgagagctcttttcttgtgtttcaaatatccccaagagttttctgggaagccattggaaagtggcatattatctaacaatatcccgtgaaattgattatctggggaaacacattataaatctcacggatgaacaaactacaacttagtaacataacaacaattatacctcatgtttatgtaggatttaagtctctacaaaaagcattcatattctctgtcaccctcatagcatctagcatagcccctggcattacctcaagatatcctaaaaacacacctgcaagatatgctttatcttcctttgacatatgggaaaactgtgacatacatagtataagaaacttgccccaaatccaaggacaagtagcgatagaaatataatttgaacccagatattctaagttctagtgtcatgttcttccataacatcacagctggctgctctttgtaaacctgttcagctacatctggaaatgtgcatgtagcttccaaagtcatctgacactcactccatgacactcatgctttgatatcaagatgatcccctcctccaccttcctctagtgctttactgttcctgtctggctgcacttaccactcactgccttacggtattcatgttgtgtaatatggttttcctctgctgaaaactccttgagagtggataaggactaacctcaattatctttgttttctccacagaacccagctcagtgcctggcctatggtagaaattagtaaatacttgcccctggttgataaagtgctcaaattgcagctctaagtgctgtatggttccataagaaaattatcatgaaaaataaattatctggggaattgtctctttcaactgaactcaggatttgactggagaagaagcttgacttcagccaggtcagccaggctcattgtgctcattgaagccatccttgggggactttgagcaggctttctagcttcttccctcttcaatcacagtgtctgaatggcctttctcttgactttcagtgttttctcccaaaagatctgtttgaagtgtggtggtttatggatattttggttcctctctgtggaagaggcatttcccagctgcatctagtcggccatcttgctgggaacttgagcccttctcctcgttttaaaattcaagtaggagaatattggtaagttggaaatgaatagtattgagaacagggaggtaggagttggggatgttaatctaagaggggctagttaggagggctgattaggggtaaccagcagaggaaaatacatcattgttgagctactgctttgctctaggtgctctggttacattcacttattattttattttcttaacatctctgagaagttggtattattacccccatttttacatagtagtaagctgaagctcatagttcctcagaagcctctcaaaggcactaagctcctgatttggagttgaaactgagttcatgttccaccaccaccccacactgtttcccagcaaacttgcagttgcaagcgtatattagcatgtacttcacataagcttcctgagcttctcatgttccctttacagggcttaggagagtgggtccggggcataagggtgatgacagccagggaaaaagagataggacagtgtatcatagaattggagggatatgggaaaggatttatctgcttattgcatcaggctgccacaattttagaaaccctatcattgaatgggcctttcttgggaaactaatatattgccaaagctcttctttaaatagcaataatacaggtgttggtgcttgaagaactgatttttgtaggtccaatcaattttagtcttggatgtgttatccttcttctgtcttgtgctaccttgtgatctcttattcaacaaacatgacaatagtcatggtaactgtaataataataattgatgcaattataataatagggccaatcttaattctactcatatgagattttagtcatagtaattattatagtgatgcttctatgtgcttggcactttctcatgtgcttttaaaagcattgcctcatttaaatataagtgtagataaagtcccctgcatttgtcataccaaaaacaaggtaaaagaggacatatcaggtgtgtttaaactatcctctgtgctgtccacttggaggctttaactcttcaagctttgtgtcctccactgtgggtctctgttgggtgatctcattaacgatttgtctccactttccaagtagagaaagatggtgacatttgagaagagcctgctctaagtaggttgcttgcatacattatctgagaaaacctcatgttctgttcatccatctttgcaccataggaagactaagaaatgaaacgtgcttggctccagctcccagcgcttatatcaggaaatgattgtctggctgcttagaacggcatctgttcttgctgagtgttgctgcacttggaggtctaagccctgtaggtcatacccagccaaaagacccagattcactatggcagaggtgattaggtttttacatgtaaaatgggcttcaggaatagatgactttctggagctctgatttttttgcatccagatgacctgtggcacattgaaaagagagaatgcacaatttactacggagagctgggtttttttttgttgttgttgtttgttttttgtttattgatttatttttacagctcatatattcctgcagtgcagtgcagttgttaagtctttacactctgctctcagacattaagaaaagaaattggggcttttagtagaaaggttagtggtatgactttcatgaattggcatgtattcctaaactggtaaaaaatgtagtctgggcagactggtgcctatgcactattttgctcatagatgaaccgctcatcttaggagacagagtggaaaccagggaagaattcttagctgaggattcttctcatggctgatcttgtgatttgttgtctggtgttcattaagtggcttaatttttctggaatctgaaagtcataaatacactgtaaaatgctgttaaccttcagaatccacagcttaccttctctctcaatggagcagttccattctgcttgtctttatttgatgcacttcactggttactgaagatattccttctaaatagctttcagacagcaatattctccctttcctcagctagaagttcacagtgtgccccatttctttcctagagtgtgactacttgagctctgcccccggcacatcataggggtaagtcagaactaaacttttgctctcactttttattaaatatcttgtgattctcttaggttcatgagtatccagggtgcttcagtgctatgtaaaacacagactggaaaatttgcaggtgatgtaccaaagtgcagaaacagttggtgtctgactgcagagtgacaatctgtccaggcacgttgttgttggaaaagtagtctgaaattggtcttcaaatttgagcactgtctgggtgttaacacaatgctcatgagagctatccatttccctattgactgataagagatctaccaagccctgaacaattccagcattcccaagtgtgttaggctgttcttgagttgcggtaaaggaatacctgagactgggtaatttattttgaaaaaagagattggctcacagttctgcaggccatacattcatggcaccaatatctgcttggcttctggtaagagcatcagtaaactgataaccaaggcagaaggcaaagcaggggcagtgagtgggaacaagggagaggaaggtgctaggctctttaaactatcagctctcttgtgaactatcaaaatgagaactcattcattaccatggggaggagggcactaagtcatccatgagggatcttcccccatgatccaatcacctcctaccaggccccaccccccacattggggatttcaacatgagatatagaggggacaaatattcaaatcatatcacaaaataatgatgctgttgggtgccagataatttacaggctcagagtcccaacatttttcctacatcctgtttctcctttagagtgttcacacttcacctttgagaatgggaccaagaggtcaaaaggaaagattccacctgccattcaggacctcaaaacttccaaagaccttcaaatcatgaaggaaactgggcatagaccttctctgttgcaaaggtgaataaccacttctcttagccatctataccactaagtagcatttttactttgggcaaaccacttacatgcctttgagtgttgggagttaagacctgccttaacagattgcagtgatgattaaatgagatgatactacactctgaggatgagagaagtgatttataaatagtaaaattgtggcaccaacattaagtgtcatttttgttattcttagtgattattatttaatttatttataattgcaagttttggtgagtttcccaatgtaattaatttttagacctattgttcagtctttctcaacacttgtggaaattccagaaacataagacaagaattctcaaccaagttaccataaaagatttaattaacagaaactattatacacatatggggtgtgtgtgtgtgtgtgtgtgtgtgtgtgtgtgtgtgtgtgaaacgttaagtgggtagacagcatgtagacattaaatttctggccagtattggtctgaaaatcattcccttcttatcaaatgcttgttagaatcagcctcttctcaaatgctcatggaagttttttagagtgcctttacttccatcttcagcctatggaaattttctataacactattaaacatgatgaatcttgaaagcaggcagatgttaattctcttttagctgggcctccagcaaaaggttatttctcccctggagcccacttctaccccacttctgcacctgtgccacctttcagtttgcactctctttactccctcctttcatggaaatgttcttggcagcaattgcccatccagtttctccctccccaagaccttccctaaattttccagagagagggaaattattcccttcttgcaattattgtttattatttgtatcacatattctgcctcaatagggggttactttctgtctccaattggtcttcagtggtgttcactgaccactgaatacacagatccttttgttttaattgtgctgaaaaataagcagcaacagtgtaccaagttggactcataactggaagaatttaatgcagcttcccaaattcatgagttattccccaaaagttatgtttgaagaatctgactcatgaactatatgatctatataaacagaaacatttcctaagagaaattaccattccacagttttatttttccctgagacacaaagcatgagaaataatgtaatttaatacaacataatgcaaagagtagaccattactcacacaaaacagcgcattgctttgcagctgacaagaattcctaggaaacttcctgcagtagcaatctacatgagcaatagctaaagaatatagttctctctttctctcaccggatggtcaatatacactattttcgctacataggagaattcagaatcatagaagagcatttaatacaatccatcaacagtgcttctcagaaatcagtataaataagaataactgaaagatcttgttaaaaattcagacccccacatcctcattccatagatgctgggcaggtgtagattcaggtagagaccaagaaaatgtgtatttaatgagtactccagggaatctggatgcagttgatccataggccacactttaagtaacattacttctacaccacagatacaaaactgcaaatgcagaaatataaatcagtgtgcccaaggtcaaagactcacttatcagcagagccagaacaaggaataataatactgtgtaaaatgatttatgtataatcagaaacaagtgtcctgcattccatgcagaaaaaaaaaaatcccacccataagttatcttttagttccttacatacctttcctcatcatccagacttcattaaaatatttattgagcatctactatgataaaacaccaagagtgaaatgtttaaagatagagacttggtctccttcctaatagagcttacaatatagcagattatttacagaaataagaaagaatatataataaaaatgaaaaaaatgttctggttaaagcaagacattcttatgaatctgctcaataatctagcagttaatgtaataagaatgaggagagatatttcaaataatcactggtccatttattcctttattccacatttttatgctttgtacatatgtgcaaagcactatgttaggcattgtggatacagcagaaaatatgaaaggcaacatctctggcttcttggaggataatttctagtgggatgaggaataaataataaacataactaaacaacacagatgcatactaagaaaagtgctccaaaggaaataaataggttagtgcaataccatatgaggaaggagtagagggtagttgaaatataatggccagagaaagccactttgggaaaataacattttatctgatatctaaaaactacatgggaagcagccatgcaaagcattggagaagagaacagcatcccaggtaaacagaacagcaagtagaaaacccgtgagataggtgtaagcttgtcatgttatagaaacaaaaggaagaccaacttggcattgtattggagcatagggaatgaaaagcaaagtggtatgacatgaagtttgagatgcagtcagcggccagagattttaggatcctataggtcacgttaaggaatttgcatttcataccatgtgcagtggtcagctgtgaaaagcaggaagattagattattatttgcatttttaaagcttactggataatgggtgaagaatgaattgaaagggagaatggacataggaggaaaacaagtttaaagactactactgtagttcaaggatgcttccatgctcaaagtgtgaggacggccattatgcagaagcaaggaaaagggagatggatgggtattgggacatctcttgtcattttgagtagatctgactatgtgcacaggtcctcctggctaaagaagtaagcaaacattgctcagcctggcatcctaggccatcttcaccacggcccagccccacattgtcagatttattttgttacctgggtaccaactaaattggactgcctgttcttctgtcagtatctgtgtctagcaacctatgtgttctcattttattcccttccatcataattttttcttgcccatattctctttatctaaatttgagacttttacaaatgtttctttcttcattaaattatttctctcaatcatatacaatatcttcctctttggaaacacattttaaatcacatggttagccccagaataattgctatttatttgcacggctttctttgtctacgacaccacatgctgctgaaagaagaaatgaagtctcactcatttttatgactcacagtgctttgcacagggtctcagaatggagtataaggagttctctaacctgagctggatacactccagagcctcatttctcacgctcacccactacctgcacatgctgtttcaacttgcagttctgtggaaaagactgtgctatgttatggctcatgactttattcttcctataccatatctttgtatgcttttcagactcttgtctacccagcaaattcctctttatttttaagacttagctgagggtgaacttctttatgaaatattttcatggcaccctccctaggtgcctctcttcaagtagaactaacggttccttgttatatgtgctcttctacatggtatacgcttaaaataccacactctacatatacaatttaatatgaaatgtaaaatatcttgcagaacattgctattatatgaaaatatgtaaatgtaaaagttatgaaccgacaatgacaaagagaacaagagaagagacaatagaccaaaaatatgataaatttttagaaggtggaaacactagttagcagagcagacaaagttgagttccaaaacggctggatactcagctaatctttctacagtgacacttaccacttcaaaagccctgtatacacacaacaacaatcacattaaatttgtgcgtgtatgcatgcatatgcctagctcttaatatgcacatatgcacactaaatatttgtgaaaagcctctaacatggacaaagggtattcagaagctatagaaacagacagcagtgggaaatggctccaaatctataattaagttctccaaagaaaagtggaaagatgctataaagagtaacaatcatacaatttcaaaaagagctctctgaaattaaaaatatgtgagagcaagaacacacacacacactcacatttgaagatatgattgagaatatctcaagcatctccctcagaaagtagaacaaaatgacaaagagatgaaaataatattttttaaggataaaactaggggatcaatctgggaagttcaaataacagaaagaaagtctaggaaatatggaaggtagtatttaatacaatatcaaagaaatgatattcaaaacactcccagaacccgtatttctggaaggaaaatattcactgaaggcccagcttagtgattggaaacgcttactatggcacatatttgtcaaatttcaaaactctgggtttaaagaaaagatctgaaaaaaaggcccagaggaaaaaaaattcagctcatttacaaataatcaaaaataagtataccatcagatacactaggaatactggaagctagagaacaattgagtcatgccttcaaacctttagggaaaatgattttcagcctggaattccatcattggaaccatggttgatgtttaagggtagaataaatatatgtttaggcatgcccgcttagcaagctgcaggaggatgttctgctccagagcaagggtattgcatctggaaacaagggatccaaccctggtgagaatgaaaaagaggcaagagttgaaatatatgtctagaatgctgggagaagaaatccctgggatgaaaactgtgcagcaggcctagaaatttaatatttcagattgggcagaaaaatataatgctttcaatgtgagaaaaaaaaggaactcatgtatttgatcacagtgaggagaggtcttcaactctgttagagaatatgggagtagcagtggataagaacacggaaaacaactattaatttcaatggcaaaaaccacaattacttttgcaccaacctaatacaaaaaatgcaactattaatgctagaaggtaggcaagaaaggaaatgtgattataatatattaagtgactcatctgaacatagtattttcataattataattatgtagcaataaatattgatttaacaaaatagctggtataatttgtattaagcaaatgggaagaaggaaagtgcattggaggctgtcataaaatgagaggtaaatattagatctcactacatgaagagttaatctagtaaattttcttaaaaatcaagaaatagcagtgtaagcatatcaacttcatggaaatagttttaaaattagctgaaagaaatgaaagaggttgcctcttgagagcaggaaagaggttgaatagaagtaggaaaaaggagtaacaagcacgttttagtacttttacccaaaacgtttaaaccgattgttggtttatgaactattaacacagtcttttactttacactatatgaataagaggacaacaacatatagaaaaatatgttacaccatccgagcaacagtacactttgcacaatggtgattcattgatgtgagtgattcagacaaataataattttgaaggtgtttgggtggcttttatgtgatttagaatcagaaagtccttttttgggtacatcaacttttccttattcaaagactgagaaaataatatgctatttacctggatcacaaattatgattagccaaagtgtgttcattaactcagtcattcttttacagagtagccactatgtgtatcaggcacccacattgatcctaagaacaatggaaaccttttaaggattttaagcaaagtagtgatagaatcagacttatatttcagaatatcctaggatgttgtatggactggatgggggcaggactagatagcaaggacttattggaaaacaccacaagagctgatagtgttgttccagttcttagggaattgctttcaacttttctccattcagtatgttgttagtatgggtttgtcatatatggcctttattattttgaggcatgttcattatattcccaatttgttgaaggtttttatcatgaagggatgtcgaatttgttaaagattttttttttcatctattatgatgatgatacagtttttgtccttaattctgtttatgtgatgtattcattgacttgcatatgttaagccattcttgcaactctgggaaaaatcccacctgtccatgatgtattatctatttgctgcattgttggatttgatttgctaatatttcgttgggagtttctgcacctatgctcattagggatatttggtctgtacttttctgttgttgtgtccttgtctggctttgttgatactgttcagggtcatactggctttatagaatgaataagaaaagattccttcctccttgattttttggaatagttttacaaagactagtaccagttcttctttgttagaattggctgtgaatccatctggtcctgggttttttgttggtggggggtagggggtagatttttttaattactgattcaattttgctacttgttattaatatttttcggttgaggatttctatttcttcccggttaatcttgtgaggttgtagttttccaggaacatattcatttcctctaggttttatagtttgtgagttgttcataatagtctctcatgatcttttgtatttctgtagtatcaattgtaatgtctccttttttatttctcattttgtttatttgaatttttcttagttgtttatgtcaggcctctgagcccaagctaagccatcatatcccctgtgacctgcatgtacacatccagatggccggttcctgccttaactgatgacatttcaccacaaaagaagtgaaaatggcctgttcctgccttaactgatgacattgtcttgtgaaattccttctcctggctcatcctggctcaaaagctcccacactgagtaccttgtgacccccacacctgcccaccagagaacaacccccctttgactgtaattttcctttatctacccaaatcctataaaacggccccacccttatctcccttcgctgactctcttttcggactcagcctgcctgcacccaggtgattaaaagctttattgctcacactaagcctgtttggtggtctcttcacatggacgcacatgaaagtttagctagtggtctattaattttgcttatctttttaataaccaacttttcattttgttgaccttttgtgatttgttttggtttcaatttcatttaatgctgctctaatctttattatgtcccttatgctactttggatttggtttgttcttgtttttttctagttcctgtgatgttatgttaatttgtgatctatttgtttatgtagacatttaattttataaacttttctcttaacattgcttttgctgtatcccacaggttttggtatgttgtgtctccacttcactcacttcaaaaaatttttttaatttttattttaatttcatttttgaccaaaaggtcattcaggagaatgttgtttaatttccatgtgtttgcatagtttcaagagtttctcttggtattgatttctagttttattacactacggcctgagaagatatttgatataatttcaatttttaaaaatttattgagacttgttttgtggccttacatatggtctgttttggagaatgttccatgtgccactttcaccactcccattcacatagtactggaagtcctagccagagcaatcagacaaaagaaccaaatataaggcatccaaattggaaaagaggaaactacattatctccattatctctgttcattgacaatatgatcttttcttttttttctttttcttttttttttcttttgagatggagtctcactctgtcacccaggctagcgtgcaatggtatgatctcagctcactgcaacctctgcttcttgggtttaagtgattcttttgcctcaacctcccaagcagctgggattacaggtgcccgccaccatgcctggctaatttttttatatttagtagagacggggtttcaccatgttggccaggctggtcttgaactcctgacctaggtgatccacctgcctggtgtcccaaagtgctgggattacaggcgtgagtcatcatgcccagccaacaatatgatcttataaacagaaaaccctaaagatttctcaaaataaaaacccttatattttttataaacgtatttagtaaacaaattactaaataatgtttgtaaacatagtaaacaaaataattgtttactaaataaacatatttagtaaacaaatttgtacataaacaaatttagtaaagtttcaggatacaaaatcaacacacaaaaatcagtaacatttctatacatcaataatggtcaaggtgagaaccaaatcaagaagaaaattccatttacaataactccaaaaatcctaggaatatatttgaccaaggaggtgaaaggtatctacaatgaaaactacaaaacactgatgaaaaaaattgtaggtgacacaaacaaatggaaaaatcttccatgctcatggatctgaagaattgttaaaatggccatactacccaaagcaatctacagattaaatgcaattcctatcaaaataccaacataacttttcacaaaattagaaaaaatttatgaactctaaaattcatatagaaccaaaaaagagcctaaataacaaaagcaatcctagcaaaaagaacaaagctgaaagcatcacattacgtgacctcaaattatgctaaacggctacggtagccaaaacagcatggtactggtctaaaaatagacacataagataaatggaacagaatagaaaacccagaaataaagttgcatatctatagccaactgatcttcaaagaagttgacaaaaatataccctaaggaaaaagctggtggtagacaaaatgaagttagtgacagtggagatgcagagaggtatctttatttgagatgtattttggaggtgatagcaatattatttggtgattcattggatttcagggtttacagaaggaagtactaagtataatttctgtttgaagggggcagagtgataagcaaaccgttgcatagtgttgattgatattaattgagatgagcaacacatattattgtcttaatgtaattatcttatttatggctcttcctcagcacagctgggttttcagtcaactgaaacataaatgaagcacttaggaacttcaaaaaacacaaggcctcacttcccagcattttggtgttgattgattgattgactgattgagaaagggtctcactatgttagccaggctaatcttgaactcctgacctcaaggaatcctcctgcttcagcctcctgcgtggctaggattacagacatgagccaccacactcagcagtttgttttgaccctaataagaggacacaagaaattatctctctttctgcatctactcaaacaagccttaaccaagtaagtccagtttggggccagaattttttgcagtaaaaactaaaagctgctcttttcattttattgctttcctcagactgtagtaggttagtctatgtctgtctgaatctaattgtgtccctaggggttggactgagtgtctgactctggttcataaccccaggaaacacacccactcctcaggtgacaccaaccagagcaaatccagggcttacccctctgcgtggtatggaaaatcccagaaatagtatgttctgtggccagaaaaatgtggaatgcatgatctgtactcatggtgggatggacaggattggaatattcggtccattggagccagaggaaccacaggactacacaagagcaaggatgcatatgtacctgcttttccacttatgggattgttttcagtggccagaaaataaatggatattttaaacatattcactttcactaattcttgcgaagcaaacacttcaaggtgaaactcaagcttgaatccagtctcggctgtgaagagaaagataaccaaaactgttgtgaagggacaagagggctagacagaagtgatgtggagtgaggggcgagcactctcttttgatccaaaccaggcatttgagattctgtccaggaaacaattggagaaaacatcagccaagcaactaaatatgtttttcttggacttaaaaaaaaatcaagcatgttttgaaactcttaggggaggcatttcttacctcttttattagtaaagagtaaaaggagcatcagcttcatgaggaagaaattaatgcatcagagcccagacagaaacccagatgcagactcaggataacctcattctttgcatgacaagcattaaaaggtcatttacccactaggtcctttttaccttctccactgcacttacctgaactaaaataaagaaattattagtatttctcatctcaatctcatgtaaatgtttttgtcttagcacgtgtgcttctgtgtgtgtgtgtgtgtgtgtgtgtatgtgcacgcacgcacatttatgtacatgtcccaataggtttgtatggcaaagagctttccagggacatccaaagtgatcgtgagagaatgaaataaaaattacttttttctcatctggaaagatttctgaggtcaaataaatgagagtattttaatagagagaaatgaaggaacattccagtcatggcaaaaaatctcatggggggggtccttcactagggtcatgcttaaattcagcatagtttaacaagataagaagatagaacataaatatcactaaaacttcttaaacattttcttatcatttcccatgttcttcaaatatgagcatgtacaagctcctattacattttgttctttggaaaccatgaataacttaataagcaccaagtattatctatctggattaaattttttaaatacgcacatttctttctatctagataatgcccatggaaacgttctcagtgtcttgttaaagtaatttaaattctagtacagtcttcaagctagacattgaaaaataggcatacttcagctacacaaatattttcttagcattcttcatgcatcatctatgtaagtattttctcagcagtcctcaggtgtatctcacagaaaactcatatttatttcaattcctaagaaatgacaaaaacttcctttcagactttcaaaaatatggcatttggttttgcaaatcatgctcccacccatgaaatggagcatggctgaacattatttgtctatgaaataggcctcaaaaataagaaaatgctttttaatataattttctttgttaaagtttctcaatcctttggatcacatgccaatgttaactacagacttagaattctccctgggataagggagcctgtgtgacctcatttccacagtgccccaggacctgtgttgaggaacattgggtttgtaggtcttctaaggatactcaggtatcaatatttggaaagcagcaattcctcagagtcatctcttctgccaacacatgtaagctaatgatatctttccttggccactttctttgtaatcatgacctcttccagaattggggctgatattaggcaaattatacagtattgaaaaattgtctttcattctctctccactcttttttcattctccatatttctatcttgggcttactccaggaaataccagtacctaagcttggttttggctgctcagagtcttgcctcagattctgcctgcctccctgaatcatgtaatcagtattcttcaggagctagcccagattaggacccacaaaaatcaatccgaccaattaatataagtcaagtattaatgattcacaacagaattatgggtaacattaacactagggtgtttcctagaaccaccaaattagtccattctgttggctgccattctgctcatcataaccaaatcccaatagaacatgaatataagagaatagcacacatgccaccatttctcctgtcctgtgtccatggcagacacttataactaatggactctcctttcctaaggagtagagaaatcctcaaaatcctttgcagcacccttctcgagttagccaatagcaatttgtattgcttacctattgctgtgttacaaattagtctaaaatttagtgacctaaaacaagtagttactatcttataatttcaatgggtcaggaatataagcatggcttagctggctgcctctccctcaagatcaaaggtcagctgggttagaatctgcttctaagctcattcatgtggctgttagcagacctaaaatcttcattggcagttggccagagacatgaggtccttatcacttggaccttgccatagaagagctcacaacatggttcttgactttccttagaaatagtaaataagacggaggggagagtaagagggagagagaggagttcacggccttattatagcgtaacctcaaagtgacattccatcacttctgccatattttatttgttagaagtgagttaccgggtctaggcctcattcaaagggaggggattatgtaaggatgtgaaaccagaaggtgggaattgttgggagccatctcagggatagcttcccacattattcatcaacctattagattaggcatgcattgtgaaactcactttttccaccttacaaactatttggcgattaaataatttcaactgaaagcatgaaaaacttaagtttagtaaacgatgaaaaatctaaaataattgtttttcttgaaactgttattttacatggattcatttctttataattcattcttgcattagtaatggactacctcactcaggaaaatagcaatttccttagagttccagaacagcaataccaggtctataattagatttcctcttataaataatctttatactttttgatttaaaaatgtagtaagtagccattttgaaagttggtaaagccttgaaaagtataagaaaaataaactttaactataattctactgttcataaataactacatttaacagtttggcctattattcaaaattagcacataagtgtgttcatattctacatttcttatttcacttttggttgtgaaagttttagcattgacctgtggaaaaacaaaacttgaaatgttgcgttgtgaagtgcatgtcaagatggggtattcacttacaggcagataaatatatacttgaagggaatagttggaaaaaacatttggatcataacatagtgtggatctgcagtgactttgttccttgtaaaatctctgcaacaaccacaataatagtttaacaataaatgaatctccaagagaagaaagcatagtatattttctctgcttaactggatcgttatgataatagttagaagccttttttaaggaagaagatacaatttttcttttgaactcaacctccggttacctctttagtatctcagctaattaccagtcaactgtacatataaactgtgtggacgtgtgaaactgtacctaattacctagctaagctacctacctacctgccaaatccacctactcctctagaccccccgacacccagaaaaagagatgagataatgtacttgtaaataaccagctctagtctctgtgtctccttgaaatttcactgtcttgcccctgggtccaatcagagaaacgctgccacaaaatagcaactctctaatggattttgaaaagcaaagcacaatttaactgatacaaggtacaactaagttcactgtggtatcaggtagcataagacatacctgaatagctaagcagggaaaaagagcagaggtgggaagtccaaattaattactaaacaccagaagtttgggtacctgctgtaaaaaacctagaaacactatccactgacctcagtgacaaggcattggctgattttctggggtataattgagcctcaaataatggttgtactacacaactaatgaaccctgctgaaggtgggtatcaaacgtttcctagacagaaggcaattgtcaattccactttctgcatgctatactgattgacactctatagagtgtttcactatctagcagctccccttagggctgctaagatggagtccattcaaagagcagattcacacgtgttattgtatctgtaaggtggggacctgcaaaattggccccagccattctcctagtcacacaagacctctgatggtccacatacaactaaacaggatctttgcaccaaaaacaacttcaaagaatgtataccaaaaattaggcaaatgacatataattcagaaaacattgtaaacataaaacgcatataattttagaaatattgtcatgggccgggcgcggtggctcacgcctgtaatcccagcacttttggaggccgaggcgggcggatcacgaggtcaggagatccagaccatcctggctaacacggtgaaaccccgtctctactaaaaatacaaaaaatcagcctggcgaggtggcgggcgcctgtagtcccagctactcgggagactgaggcaggagaatggcgtgaaccccagggggcggagcctgcagtgagccgagatcgcgccactgcactccagcctgggcgatagtgagactccgtctcaaaaaaaaaaaaaaaaaaaaaaaaaccagaaatattgtcatgtatatcttttaattttacttattattttatgttgataaccaaaaattcattaagctttcggtgttatttagtttggataaataataaggcatcttttgaatgttattccttataacaaatgtaactcacagaacacacagccacatttatcaaacctaaataagcactggctttatttgtgccttttaaacaaagtactcttttactacatctatactaagacccaggtcaccaaagtagacctaaattgtttaaatgttggtggatcactgtggaagcacaaattctgcattagaatagcaatacggaaaagctgctatgagaatcaggccagtgcctatacagattgttctctctctcttcctctttctctctctctccctcttaggaatggctcataatgaatgagctttttatggaggaagaaagtggtgattctgatgaagctaataaggtataatgtccacatgatttgtaggtcataaacagtaagctcaaattatacttaattcagaattattcaatcaattaagccatgagggctatgaatgacccgatggaaatagaagataattattctgtgacacctagattaaaaaacacactcacctgaaatactgaggtattaagtcacacattttagtctttttcaagaacacatatactgtctcaattccccagctcaatttacacatgtggaacacaattctaaataacatttgcacagaatgtgacttataccatggttgacctgggattcataaccagactcacctattggctgaagggaatattctgagctttgtcaagattaataaaagggctttagtgatggtcaatttatttattttcccaaattagataaactcactttttataccaacaactatttcacttatttacagtctccgaataatgatgaatttttacattctaaaatgttagtaggttaactaaatagtcctgatagatagaagtgggaggaagtaaagaaagagagggtaattaaatgttgtaaatatctcctctgtgccaaatactggggaagaagctcttatacatgttaatcattacaataccaccacaaggtaggaactataatttcagctttacagatgaaggaactgaggcttgggaagctacataatttgtcccaaaatatgcaacttgtaaatgttagagctggaattctaattgtatctgtttgattctaaatcccttgttcataccactatatcctcctgcctctcacttcctctatgtcacatactctccttgttggttaagttcagctcgttagtatagggtcagtggaaacagatttgtctctattcctacaaaacagtgagatatgggtaaaaagcctggtacaaataactctaagtcataacagactaacaaaaaatatatatatgaaattatcacaatgacaaattttcctttcagactacttgacaaacaatatatcctagaaaaaaagagaccacaacacttggaaactaattatccaaatgttgaacagctgactataaatcaaagaaattgcacataacaaaaagtaaaacatctgtaagaggtttttagtgctttccaaaagattccaagtgttgctcagatgtacagtgacccacttcctctcgtgaaaaagcatatcacctaaccaaggacatagcaaagaaagaaagaaaaatatcagattcaaatctatccaaagttgtggctttcaattctaggtaatcagtaggctgaatagtcttgatgatagttcaggccaggagctggaaaacttcctataaagggccaaatagcaaatatgttaggctttgtgagctgcatgttctatgtggaaactactaagctctggccctgtagcatgaaagcagacatagacaatgcataaacaaagagggtggctgtgttccaataaaactttatttacaaaatataggggggtgagccatatttggccacaggttatagtttgctgacctctggcttaggctatacttcttgcctagagtaggcatagaggagattcggttgagttaatgtcatttacaagacaataggctattgatgagaagggaaggagccaacatggggctggaaggaagattacggcattgtagtgatgctaaagttaacaggaaggtcagtctcttcagagaatctgaagggaactatataaatcttacatggactgaagaaagaagaagatgactcctttaatttaaggaattcattttccccattagcaaaatgaaaggctgaagttgaccaatgggttcaagaaaactttcttcagattaagtattgtggagtcccagtatataaaagacattaatccactatcagtctgattaaagctgtaatggggaagctttatcttacaagattgatcctgagtcaattaaaactcccaaatctctccccaggaaatctggacttcacagagtgtaggtcaacaaatataaaggctctttctaattgtgacattctgacgttctatgattatgtgatctttgttcctgcttttaagttatatctacatataccttaaatatatacataaaatattcctattttaagatgtcattatcttttgagggcatcttcagagcaaatatatgttaatcactagatttcccaagaagtaactcagctggttaaatttaacatagtgttactctctctgtgtacaaaaaaatgcccatatttgctcaattattcaagcaaattttctagaaatttaaaataacacaatccaataggcctggtctaggtgtccacgtgaactgattaaatttcagatttcacccgtttagaccttgtctttgtctgtttggctgccataataaaataccataaatggggtggcttaaataaaaaaaatttattttcttaacagttctggaggccgggagtccaaggtcaagatcccagtataatcagtgtctggtgagggctcttttcctggcttgttgatagccaccttttcactgtttcctcacatggcagtgggtatgggagagagagagagagaaaactctctgatatctcttcttgtaagggcactaattttgtcatgagggtgaagctttcatgaccttatccaaacctaataatctcccaaaggccccatcttcaaataccataatattaggggttagggcttcaacatgtgaatttgtaacctgtaagatcagttcatagcagatcttacaggttacaaagagaaggtctgaggggaaaaaagagataactttcaacaattggtgttgaggaaagagatattagtttttctcccaaggtgtttatagaaaccagaaaatagaatattatcttttgcttatctctatctagcttaccatatgttaaaacaattttgctatctttattatttttaactcattgaattacttccttctagtcagatattcaggataagttgtttttgggtaacattacttgaaaggccaaaataaaaattagatgttggaaatgtcactgctatacttggaatggacacattaataggaaacattatcttcaatttcaaaaaaaaattataaatattattttaattgacaaatcataattgtatatactcatgagatataatgtgatgttctgatatatgtatacagtgtagaatgattaagatggatatattaattagcttcatttaatctttaatttctttttgattgactaaatataggaagacctaatgaggtattttttcctccaaaattacagatttgaatcgtggctctcatggtctgcttcaagcaacaagtatcttgattgtgtaggtgttttgcagaagtttcccttatatactactggaaattgagttatttctctgagactggaaaagagactgactctaggttttatagaagggaaatactgcctaggtagtaactgactttgggtttccatcagaggtggaaattatcctgctaataagtttttatctttggtgaatgccttgctccagtttctagcacaacactgggtaccaaaaaaaagcaatcggtataggcttaccagtgttttattgtcaggataaagtctctgatctgagactcaggaccacgtgggaagataacacacagaaacattggatgggttgttatagcaattgttttgtgactagaataagtttgctcctccaaggatagttctggttgtttttcaaaaagaaagaggcagtggggggtggggagggaggagagaagagagagagagagagaggccattttgaccacattttgtcacagatagctatggcactttctacagcagttccttttatatttcattcccataacactaataataaagttttcttattcctcttttaaaacctcacaatgcataatgcatagtcactgcaattatttcaagagatagcatgtacttgcatttaccccattttatcacccacctgaggacactatatttcctattagtggtagtgaacttgatgctattatgtgtaatttcttccagatgagctgtagcacttaactttctgcttcaaagtattgagttgtgcttaaagcaagcctggcttctatacagagatttcccagagcagagaattcaagtctaattaaaacacatcacttccccatcaatattttctctgtacccaaatagtgtcttaagaggtagacaggtatcagatcaagtctggaaataatttttagattttgagtaggcattaataatgacatcaacttatagaaatataacaatagtatgagtgaactaaaaataattcatagaataatgattttttaagttgcaatttaggactttttgactctctgcttcattgcactttcataatcccctttaagttcttcctcttatgttgaaaacagatatgtgaatttaaaagatattttttggaatttagtgccaaccacaggcctaccatgtgcccatatattagacaagttatgtagtttatttctagtcctcacaactccaagaaaaaaagtattacagatatgcattcccttattcaaaacctttggaggcagatgtattccagaattcagaattgtttgaatttttaaagataataaggtgcatatacagcatgttctgtaaccaaatagggtctggtgtagcatttcggaggcaaataaaaaaatatttgcactgaaatataaaagttctcaaagtgagatttaaaaaaaaaaacagcagcaaaaatggcctcatatcagattttgtcaccaaaaacacttgctacacatttgcaaaaaataaaaaaagattttgcaggtttttctgattttgtatttgtgaattaaaaattgtagatgagagagattaaataacttgctcaaagttatgcagccatcttaaacacaagaaatatacatggaaatgtttgaacagccagaatacagttgggttggactcaaacttgggaccatttgtctcaaaagtctatgttctaatagatgaaaagaatgaggcatgccaaatgaccttggggaaggaaacacagaaaaaaatagggatcagacaagagaaggaatggtaggtaactataacatgagctccccaaagtaggcagagagataatgaaagcagccataagaggactatgagctgaatgggaagaagagaatatggtgctgaagctcaatgtactcacatggaaaagatgagaacaagtggattctgaacagactgcagtatggcataaacctgcccattgtaccaaaatgatttccaattgccatagctcctggctatttattaaaatatatttaaacaatgcctaccatgtaccaagcactggggataaagccacgaaaaagactggcttgtctctgcacttctggccccaataattattagctgtgtgaccttagcaaagttattcaaccactctatgcagcaatcagttcatttgtaaaataaaggtaataatatctacgtcacaaatattaaatggtgagaattaaattgtatagtgcatgtaaagagcttaacacagtgcctagcacaaaagatacatagtataccttttagtatactataatagtataggtatacctttggtaaagtataatagtcaatattattataggtattttattcttcaagacaattgacttctccaaccaaaggaaaacaatacacattctgagaatatgtgcagataacaaatcagagtacaaagtaccaaattctggacaaatgtaattgctgttcaatcagcaaccctggtgagtttgctctatttttggcttcagcactaacttgttgtgctaccctgaatgagtcattaataacatctgcttccccttctgtgaattgtcttctgctctttaactcaagggtattaaaggaggctttggggataaatgaaggagaaattattgctccagctaatatgctgctccaaagagaactcttttgaacttgttgattagaagataggagaagtacacacagaaagaaaaaaagcttttcttgcatgcttatacctgaatgaattccatctgtatggatgaccagtgtaagcagaaggattctgaacaatattgcttttctcaattctgccataaatactcattgaaaaatgctgtggtcatttgaatacaactgttattctctctcaagcccaaaatttaaacttgctaagagaactgatctattgcagttgcttttataatatagatttataatccaaatgacagtcatttgtttctggcaacagtcagctgctcaggggttatcaataatatgttttattgacaatcacattctcagaaaaccaccaattgtgctttgcctacctatatgatgtagtcatgcacaggaaaagagtcaagacctaggatatatgcaatgccttgggtgaacaattgggaaagtagctgaaaggagataattaattgaaggtacagtgtttacttatatatttgctgtaaattattagatgtagagaatcgatgtttaaacctcaagtagaaagcagccatcttaaacacaagaaatatacatggaaatgtttgaatcatataactgtggcaccctatgatctatgggatataattcctaaggttttagggcaataaccaaggagcacaaaacattctcatttgtttagaatggaaatggaaaactaaagtcatgcaacaatagcttagtgaatagatctaacatctcccctccaagtatagatactctaggtcagaattttctcatcttccaatcattctccagttttatttaaccacttgcagtttaaagaaaaccctgctgagaattctctttcagtctttgtcattttgttcactttgcatagaacactttcttcattcttccttctcttgatgtcctggttaactcatactttctgtctcagattatttgtcactctgtctgggaaagcttccatgtcctcctaagtgcctctctcttgtgctcacatagcacttcttcctctgcatggtaaaattgtctctacttgtctgtatcttccacttgacaaaaagaaaattgaagagagaagcttagtcatagttacagttgagttctgagagtctatctcagttctagtcacgtaacagacacttactacttatctgcaggatagtgactgaataaataaatgaggctacttggataaaataaatcaaagggctgttaattttctagtttattgtatcaatgtatatcaacaccacaataaaaacttagaatgggcaatattaagaatgaatgcttaaggagtttacagccatccagagagctggaagctctagaccattgtgagattctaactctagttcagagtttaagtatggctataacctcagtgatagaaaaacatgtcttggcagcttatgggtggttttgttgatgagaatgaatagaatgagaaatggaaatctcattaagcttgaaagtatttttagctggagaacattgacattagactgtcagaaaaccaaatggaagtaaattatgatgaacagtaaatatgttagcgaaaatggtcaagtgggatcatgactcaaagaagtgcctacaatttttacccaatcacagcctggttgcccagcaaccactctatgggagttgcatgcatgatgacatattagatcctaatctcagaagtagattgacaagccaaatcattaagtcttgcagtccggcctgggttagttctatcaccttattaaattctgaataaaactcaacctctgcctacacaaaaggtaaggtctgtcaaaagagtacacaattgccatgggtaccctgaaaatccttggatatctttagaatagaataatttaatatgtatacaaattggattgcctgtgtgccatcccagaccctttccgttgtaccagatggtgtgtcagtaatagaaggtaaaacctaggcttgtttcaggagaaagagaaagaagatgtatgttttccatgcaatttgagtttcatcttccttctgacttctcacttttactacctaatccaaaatacaaagaaaacagcaaactgtaaagccaatatttctattaatattttctattaagcaataggagaaaagaacaccttaacagaaaatagacaaaaggacatcaacaaatctagatacaaaatgagaaaacaaatgaataagtgaatgcataaaatcaagttaacacttgttaaagattaacatatgccagacattcttatatgtacttgggttaatacactgtttactcatatgacttagttttatgagatagatactattaatatcatcttcaattttcaggtaaaaaaaaaaaactaaagcacagaacatttaagtaattttctacaagttaaatatctagtaagggccaaaatctggattctaaccaaactgcatgactccaaagacctcattctcaactaagcaatactgtctttcaagaagaaacgaaggagccaataagcatatcaaaagtgcttctatcactagtaatcaaagaattacaaatcaaaccaaacaaatggcaacctattattcaccaattcacctattatttcaaacaataataaaattcagtgtagcatttaatgtaggaaattgctattttactcccaattttttgtttaatggttatcaccaaggaatgacaaaaaaatcggaagtgtaatggttattctccatattaatcagctgtatgtacactttgagtgaataatagagtttttgtattttttttcttggatcctatgtactatgcattaggtggctttggaaaacatactctttgacctactctaagaagtatttctaaagaaataatgagaatctcaggcaatcataaacattaaaaaatattcactaaaacatcatttagcactgtaaaaaattgaaagtaatcccaaaattgggagatggttatgtaactattaaagaatatctaaagaattaataatgaaataaaaaaacactgtaacaagaagaaattagcataatgtgaagctgtgtgtattgaatgaccccaatataatatatccccacatatacaaatattttctacagatagagataaagagaggaggaaagggagaaaaagaagtttcctatgaaatatattaaccatgattactttgttttggatgataaaattatttgtttttattcttaaattttatatataaaattttgtatatattatttataatgcaaaataatttaaaaaattaaaatttgtgctaccctgtaattattctctttgaacctgacttagatgatcagccagaaagctaatctagagatgaattatcctcaattgttaatgctatccagtggctcaatatgtttactactctcatttaatactttagttaaaataaatatcttcaacttcttaaagcagaggagagaatgttttaaaaatccttaaaattaaaataaatccttaaagcaacatagtgctttatggtttacaaaatcctttcccaggaaatacaaaactcatttgaccccaaaacaacttttgaggaggcaagttataatattaaaagttaagaaaatgagcagacttcactgttagatgtctgaggccacattcatcttctttatatccagcactgaactaagcaaatgagaagtttgcctagccaggaacacacttttcattaagctatcagaataatcatgtggtcattctgtgagggatacaacagagagggagaatttccacctttctgatgtagaaaagcagcatagagcacataagctttcacacagactactcttgggattatatgcatagccacctgatcactccatgacctttgcaagttacttaagtcttctaagccttagtcttctcgtctgtaaaacaagaataataacgctcacatctatattgctataataaagattaaataagatgagatatgtaatatgcacttggtgccacatgaaatcatgcatagcagttattgctcagtctgcctcctacttccatcccactcaccacctcattgatgcctgggcacagccttaatttaagcctgccctttttccttctgtattcaagagggcactgagttaagcaccattctgcgaagaagtaaaataaagaacaattggtataaatctttaaaatgcccattttctctagatatcttataactctagacatttgctgaaaagtgttcaaattaatataacccattaaatctcttttgatggtaaaaataagaagctatttaaataatgtatcattcagtcgtatgctcagcttagagactgttaactgaataaaatgtaattttgactgtatgcgaccaaggcctttttaaagctttcatttttattattttctttttaaacatagaacatctggcttgaagatatgcaacaggaaaatgcacatatattttatcttgtcattcagagggctttatcctaagtctgaaagcttttggctagagtgcaaaaacactagagacccatgttgaatagcaagagaaactgaaaggatttcaactcatctttggttccagtagctggcaggaggtacctttctgaattgatttttcaaatgcatataagtcattaagcttgcagatttttaacctttccagtagagtattaataaaccttctgaaaaaatgagacttttgaaaaatcttaagtcatttagattctcaccctaaaagaggagagtctagagacattgacagcaatcttaatggaataagggttcccaaataaactttggatataaggccaattcttaactacttgtatgaataaagaggagagacccaggaaaggcctcatttgagcaactccctaccgcaaaactcttgccagcaagttccaaaattgggctcttttggttacctcatcccttcccacatccccacatctgcttgccttgtatgtagtaggaatgtttaaatgagatatttatgtcaaataactacaaggagaggccaaggggtgattaatagctcaaaagaaccaatcatttaatggccaaatgccactaaatcagagtacctgtggtcagcatggctggttaaagccctctggtgccttgtcctggttcattcaaactgaaatgattctaaatcataagattaaatgtgataaagttcagcaatattctcattttatccttcatgatcatgtttttcttttcatttgagagatctaatattaaatgataaacatctactttttctcatttattttgtggttgtccttgctggtgccctgagcataagtttggtctacatgttggattatcaagtactgaaaaaaataattatttttcaaagacttcaattgtactaactgtgttctagggaaacaaatttttatgatttataaacaatttgttgtgtttttttctcttatttgttcttcacatctcagagcattgaataatagtgctgtgaacttacattaaatattttatataaaagcatataaaatatacaatattatcttactccattttgtgctgatagaacacctgagactgggtaacctataacaaacaagttatcggctcacagttttggagactgggaagtctaatatcaatgtactggcatctggtgagggccttcttgctgcatcatcacatggcagaagatgggagggtgacagcaagaaaaaaacagcctcacccttttataatggcaccaatccaacctttaaggcaggagtcctcgtggcctaatcacctcttaaaaattctacctcttactactgtcacaatggcagttacatttcaacataggttttgaaatggacaaatattcaaaccatagtaaatattatacaaaatgttgatttcttttccttttggtgttattgattgtatttcttgcataatgagaaggagacttttgaaaagttgcatgattgcccaaaatcagtcagcagaagagacagaatcagatcccagatgacctttctaaagccctgaaagtgttttttccactataccacccagtcttccagaaccatgtgcctcaactttgtggtgactgagttaaacaagtaactgcactggttgcaaataatacaaccagtctctgaggtgtatttatgctgcagatagctataaaagagctttattccattaacttaactaccaaaattagttatatttactcataaatataaatataaatgtgtgattattaaatgaagtattgctaatttcccagccagaagaatcactttttagtgttggaaaatactctcttcttgcttttgtctgaactctcagccactttctggctgagaaatcttttgctattcaattagtctaaagatttgaggtgagagaagataaaaaggaaatcagaattttttgctggctgcttctttctacaccttatatcttccctgacataatgcttaaataggaaaagaacacagtagggggacaatgacaagagtatgcaggaggaaaaagaataaaatgtatatcttaaacattatccagccataaatatgtatagatagatagatagatagatagatagatagatgatagatagttataaaaatcagcaaaaaataatacaacagcaagaatatgagttgaaaattttcacaagaaaaaataaaaatataaaatatgtctcatttatattttcaaaataatcaatttcactagtaattacataaatataaattaaacaatttttggacttgtacttgcaaagattaaaaagtgtgacaatatcttgcattgaagagagtacgaggacactcctgttagcagactcctcaaggaaactgaaaagtctgtttgaaaagccttcaaaattttcctatattttgaccccaaattttcacttttataaatgtacctattgaaaaataatcatagaaattcacaaagatgttttttggagatgcttattataaaaacttgaatgttcagcaatagggaattggtttaaataggggctgcagcatgtaatgattttatttttgcagttttagaagtaatgctgatgagttaaaatagaggtagataaaatagtattagattctacccttgaatatttatatacctacaaaaaatctgacatgccatgtaatttgaatggtggttattcctggaagttcattttggagattgttttattttgttctttaatttttaaatttttctttctttttagtaatttctgagtatatgttactttcataattagatatgtattacgtattatagttatttccatttttgatagaaaaatatggaaggaaagagaagatgaaaggaggcagaggaaagtattcctggtaaaattggagtgacatcacctaagccaaagtttttgtcagcaaagagtgttgatgggaggaaatgatcatctgcataaataagaagctcttcaaagggactttgtccttcagctcccctaaagttcttctctatgcctaaagtctattggccaggggctaacatataataaatacattattcccacctcttaccaattttcctggtctttcttcttcagggcttcccacagggtcccaatcccagttccctttatgaacttaaattcataattcacaaaattgcatattgcttctccccatgattcttgttccaggttcatagctttcttacctgccaaaatacatatatttgacctctgctaaatagcaattgataccaatgacctaatacattaactatcactcaataaatattttttgagcaaacatttcattataagggaccatgctaggtgctttgaggagaaaaataaacaaatagcaagcctgatttttatacccaggtttgggagactgtaaataaaatagggacaactaaataatgctagagatttaaaaagctaacaacaacaatggaacctaatgtctgttgcattatgtgttttgggaatcagtgcaatgtatgtttaaagaattagtggtgtcagataagctgagtatttggatccataagacctgagtttgagattcagatcttccactttctctatcaaagtcttttcattcctctgggtctgtttcttcatcaatacaatggattctataatattaatggctttttcataggattgaaacagattaaaaatttacaaaatattgcatccatgaatgtatagttatgattaatgtccttcaatatgctccctcacattattattccccatgtgataggccacttggtcttctccctgccctgggaagagtactgggataaaagccagacataaacaacaattgagtcacaaaagcagccacacagctagacagaatatcagataccatcactgtcccctgaaccttgcaagataatgagtcagttctctgaattgtaaaccaaaaataaaattctaagcctctccaagcatctgacgagattcctccttttggcaaaggcattccaaaactaacctgaaaaactagttcaggacacgatggtaaggaggatgtcagacatgcctcattataccctcctccttttggaattaccgatagaagagattctttaagtctgataagacatatttacaatctattctttctggagcctgctacgtggaggcttcacctgcatgataaaatctttgtcttcataaacccttatcttaacccagacatttctaagtctttagaaaagcaagtaagaaagaaaagttgctaatgttcagctaatatctatttaataggcagtaaaatgcagtagtgtcattttccatgagtcaaaaatattcattaaaactgatgatttataatcattctgcggtaatattagttagaatatttgaccaacaaaaatgacaatgtttaaaaaatgatgttatggtactcctagaaaaaaaattcccagtttgaagacttatataaaggatatagatttgatcataaaactaataatctggcttatattgcaaaactactttacattcaagtattaccaaaatggaaaatgacttaggtcactaaaagaaaatccctttgatcataagacctgccatgaccgcgctaaattcaagcacttgagactagttgattgggctttagaaatcttatctggtaaaataaatataagcctgggatatacagcatattaagtcagatttagtcattcatatcttagattaatttgtcagatcttttcttaaatatagaaaaattttggatgactgatgttcactgtaattctgttaggaagactgagaataaagatgggtgcaaaaacatcctccagtctttactgagtggctttgggatagaaatacttcactaatcagtccagctggtattctaaggatttctcagatcttttctatggctatgccagctccaaacctcttgttccatctgtgggaaggggagttacaggagaagtctgaggattacatgccttttcaatccactaagccaggtcaggtgctgagagcatcccatttgctttctctaggttcaataccctgaaatgcttgactttgtgtgtcttcttccaatcccacagagtcaaataggctgtcagttagagacttgcactgggtatctggttacatttgtggagccaacaggagaggtaaaatgaggctcacagggcacttgaggtgaccatgagccagttgggagtgcattcagaggcaaggggtcctatatatcttgtaggtaggcttcctgattgtctgaggagcaaagtagttaggtccagggcttttcttccctgctgccagactctcctcagcactcagccctgacaatcacctcagtattctgagtggggtgagaaagaagtgaacttcttggtcagcatctcaccctgctaaggtagctgggcacctactcactacactctcacattctttcagaaataaataaccaactaagggggttctctcccccagccatggcagttagctgtgctgccttgaagtgggggtgctttgccctcttcgtgtatctatcctcaaacttttggctccaactgttctgtgcaggagacatgcgaggggagaagaaaaggcacacacacaatacctttatgggtaaaaaagctttatcccatgtaaatggcaatgcagatataataagcaaatgatataataaggaaattatataataagcaaattgcaatgggaaggggagaagggaaaagatatatatatatatttacattcaccaggctatggaggattcatcatcagactggggagcaacagcctgggctccagagttggacactgcactcaccagactatggaggattcaccaccacaatgggaagcaacagcctggggtccagagtcggccactggcccatgctcagacaagtagaggtctcattaagtttcagtacagtctggcaacctagctctttttgtaacgagttgtttggcatgaggcccagtcatgagggcccttcatgactgggctcaaggaacacaaaaagttcaacttgtttttgcgattgcctgttgtttttcaacaactaacatatagaaatagattgaaatagagacttgtctgaaacaatgctggatcaatgtctcaaggggctcatacaactcattctgggacttggtgaccattgtttgtgtccatgttcaattgagttcaaatgtaatatttagcttttcctccacaccaacaccatgctggaacttctccactagactcttagactcccacaggacactctctttcatggatagcagtcaaaatcaatccttctataggtgagggggatgaccatagaaagcgcctattctgctatgttactgtcctcatctcttttttctaattggcatatttagaccacttgattttaatgtaaaacttgatattttaaatctgacatcttattttttgttttctgtttatctctgttttatatttcttttttcatgcttttcatagattgaaaatttttatattcccatttgatttatttaatgtatatttaggtgaatatccttttgtagcttttttagtagttactctaggtattaatttatatatacaaaacttaccacagtctatgatgtcaatattttatcagtttgagtaaagtattaaaaattatcccctttaccttttatactctttactccttaccctctttaatatttataaaataattgtcttatatatttcctctacctacattgagaacgacattaaaatataatgggatgttacagtcaaagtactaaaagaaaaataaaaagaactaccaaacaagactactttatccagcaaagttgtccttcagaaatgagaggagataaagactttctcagacaaacaaaagattagggagttcaccaccactagaatggccatacaaaaatgtgtccagaatttattccttccagtgggttcttggtctcactgacttcaagaatgaagctgtggacccttgcggtgagtgttacagttcttaaagatggtgtgtccagagtttgttccttcagatgttcacatgagtccagagtttcttccttccggtgggtgtgtggtctcgctgacttcaagagtgaagccgcagaccttcgcagtaagtgttacatctcttaaaggtggcgcttctggagttgtttgttcctccctgtgggttcgcggtctgacttcaggaatgaagccacagaccttcacagtgagtgttacagctcataaaagtagtgcggacccaaagagtgagcagcagcaagatttattgtgaagagtgaaataacaaagcttccacagtgtggaaggggacccaagcaggttgccgctgctggctcaggtggccagtttttagtcccttagttggccccgcccacatcctgctgattggtccattttacagaatgctgataggtccatttttacagagtgttgattggtgcttttacaatcctttagctagacaaaaaagttctccaagtccccgtctgaccaagaagaccagcggtcttcacctctcaaaaatgctaaaggaaaaattttaagcttaattgaaaggatgctaatcggtaacatgaaaacatataaaagtataaaactcagcgagaaatgaaaacattaaaaataactataactacaataatttgttaatcatacacacagtaaaaagatgtaaattgtacaacagaaacctaaaatgtggggacagcaaaagtatagagttatatatgtgaataaagttattatcttaaatcaaactgttaaaactacgttttataaaactcaaggtaaccacaaagaaaaaaatctgcaatagattactcaaaaggtagagagaaaggaatcaaagcaaaacactatagaaaatcatcaaatcacaaaggaagacagcaagaaaggaagaaggaatctataaaacagcaagaaaacaattaatagaatggcaatagtaagtctgtatttatcaataattactttaaatgtaaatggatcaaattatccaatcaaaaaatatggagtggctaaatggatacaaacataagaccaaactacatgctgcctgtgagagactcacttcacctgtaaggacacacatagcctgaaaggaaatggatgataaaagctattccatgcaactagaaacttaaaagagaacaagggtaactatacttaaacaaatagactttaactcaaaaactaagaagagacaaaaaagtcattatgtaatgataaactggtcaattcatcaagaggataaaacaacagtcaatatactatgcccctaacattaaagcccctaaatacataaagtaaatattaacatatctgaagggagaaagagacagaaatacaacaattgtagagtacttcgataccccactttcaacaatgtagcttatccagagaggaattctaaaaggacacattggtctcgaactgtactttagactaaatgaacctgacagacatataaaaaacagtctattcacagcagcagaatacacattcaagtacacatgaaacattctccaggatagattatatgttaggcaacaaaacaaatcttgaagattgttaatcttgatatttaagaagattgaaatcatactaaacatcttttctgactatgatggtacaaaactagaaatcaacaaataagaaaaaaaactgaaacattcacaaatatgtggaaattaaacaccacacacctcaaaaaataaatgcagcaaagaagaaactacaggaataatttaaaaaaaaattgagccaaaacaaatggaaacacaacatactaaaacttataagatgcagtaaaaacagttctaagatggaagtttatagtaataaagacctacataaggaaatattatataaaaagatcacaaataaataatgctacacctcaaggagctagaataagatcaaactaagtccaaagttattagaaggaaggaaaaagtaaaaatcagagcagagataaataaaatagtctacggactattgctatggtgatagcaccccaactatcactgttcgtattctctgcaaagttttggttgtaaaatcaagcctccatcttgttttacatcctgagggtatgacttgtaactctggtggcaaggctttgtttagcaatcctatcttagggaataactttctttatggtttgatgtctgcatgttttcctacccctgtctcttaaagggctctacccagcaactgggttttcttgtgcctgtctgtgtatgtgttgtgtgtaatgtctggaaaagagctctagttaatttggcctaaagaaagacaactgcttgcatctaatattttttaaagggaggataaaagctgtggtacttttcagaaataaaagcagccttcaatcttgttggtaaaatgcatgtgtcattaaaatgtaaatagatgaactaaactatgcaggtctgatgcaagatttgctaaatgttttgaggttgcaaactgctttttgggtttttgagaactatctgacttgtgggcttcacaattgcaagacctggggacatatggaactaaccatacccttaattaagaagggaaaccttggctgcacttagcacacaatttaaacaacttaccaggtttcacattaaagttaaaaattgctaagagttaccattataacatgtaattgaaactactggaaatagatttacatgcaaggtatgtaagaacagtaaaatgtgttttttagtaaaaggttataagaaggcatggaaatataaatttgtgcctagtgttaaaggattgttttgagttagataggaaaagccaaagtttcaaacaagtggtggaagaactgtggaaattaatcttgcagaagaggttctctatgcaaacatattaacaaaattcaaaagggttataaaagaattttgcttctttaagacttctgagtcatcattttggcaaaataaatgacttatggtaatctggaattctgtttcataatatcgagtgctttaaacatatttaacaggcttcccaaatgaaaccccagtttcaaaattgtctttcctgacccctgacatcggatacttcagagggcccctggaatgtccagaaaagagaggtaaacaggattattggacgggtttagatacatgggattgacaaaatgatgttcattcttctttaggttacatttttggtgaataaggctaatatatgttccaaaatttatgagaattctaatgtctaagtatatgctatcaatcataattaaggttgttatgttaagttgttgtaaaccacagagatggccaaacttctttgtcaattgtgttgctagctgtaactaccctggacattttgctattcacagacaattgttgtcttgttttaatccttttcaaaagatggttcgtaataagctatagaaatttaacagatcctctaaaatacaggcttctgataactttggaaattgtaacattggaataaaggaaaacatacaggactcgtgaacagctgaaatgttcatgaatattaagcaaaacaagagtcaactaaatggactaaactcagaaactgaatggagcaaatctttctgacttttgcttgaaatattgctgatccttgttatgtttttcagagtcaaagaaacttattttaaactatttatggcctttaattattaagatacactcctagatcaaaatttggagcatgtttgtttctctctgcctgcttcccttagaatttggaaagtatctgtgagtattcttaacttacagcaatatagttgtttgcatcagtgcaataagaatccatctttcttttgcaacagaacgcaattggaaaaactggtcatttcaccaaggctttgactggaagggtatgcttccctttaaggagtcaatctcgacttgcagagccaataaaagcccagtggggagactggcctcataactttgtctatgcagtccctgtacagggttcctgatgtgtggtcagtaatgattgtcactttctaacaggtccaggagctccaagtttatcttgggaccttatgaggagaggatgaccccactcacaggtatttgaggatactaacccatggctgggctcagttttaaaataccttatctgagactccttgtggaacaaagttccatcaaagccaatccaaaaggcctatgtagaaatgattattcttgctgcactttatgtaaataatcaggccaagtgtaaaaccaaagtctatttttcaaacaacccagtcccattatgatttgttttttttaaacaaacatgaggactggagagagtaaaattatattccaaactttctcatacatttgtcattaaattctaaactaactaattgtttttaagttttctcctacattttagactaatcctgcttgttcctgtgaaccaaccagcaatctctggctgcagctcagaaagaacaaaaggggatgggtaatgtagaaatcctgatcaatattctagttctgtgcaattatcctgcaaatcttgccaggtgatggaatacatagggaataaataggatcccatcactcagaggtttccttttggggaagtaagaccaagggagctaaccaaagccagacaccatgcacccaaatcctagcaagcataactatagctaccagttatctgggggtgtcataagacatcctttctcaccctcggaggaggacttagttccacagtttcatcatagcatttggcttatgataaggagtccacgcaactttccccgagacacatttttgtcccagactcaattacaggctttgggttaaagccctagaaagaaaattggatataaaggatccagaggcagacaacaacagaggttaaaaggcacagcacaggggagcatggctgattcctgttgattaagccaaccccaaacttcctgtttcatggataaaggccacattaatatccatggtgtaaatgaggtctagggcactccaaggctactgacagtagcagtgatagaggcataggtgagagcagataattcctattctctaggccttccctgcttcatgtgtgcaagctgctttggcactcatggcgggacctgcctaggtcacagggacttggagatgcaaggatggaagaggaaaagaggacactcttccttttctccctcatgtaccccaggtatctgctaggaagaaaagggagccagggatgcctgctcccctctttctagatgggtagctattaatcttcagtatgtaccccttttgaatacatcctgaaccccggggactcccttaaaaaaatgcctttttgagcttacccttcctattgttttgttttgatacatgttttctaataacccggtttgtctgttcttagaccatcaaactccaaatggtcatgcaaccagagcctctgacgatggccccttctgctgggaacccttaaataggcctctgaggaagctctgactgccatttccccaaaagctctgactgccgtttccctgtcagcaggaagcagttaagtttagtcttcatctttatccttattctcatggcagttagatatacttttttagagcggggaatgagacagccaggtgggagggggtccctggaaaaattctaactgcaccggggtggggactcaggaagttcacgcattttgcagctgggaggagcgtggcccctcctcttcctgcatggaacctgggattcaaacaggggctctggccttgcggaagatccctgtttctctccttcttttcccttttcacccaataaaaccctgccttaatcacacttcaaaccatttgctagcctaaattttcatggccatgggacagacaaggactcagtctttagctgaactaaggaaatgtcctgaaacagtaatatgaatgtatacatgtgataaatgacataaagccatagtgtacatattgtgccaatgtcaaattcctaattttgattttgtgctataattatgtaaggtataaccattggggaaaactggtaaggggtacgtggatcccctctgccctacctttgaaactccctgtgaatctattctttttttttttttttaattatactttacgttctagggtacatgtgcacaacatgcaggtttgttacatatgtatgcatgtgccatgttggtgtgctgcaccattaactcatcatttacattaggtatatcccctaatgctttccctcccccctccccccaccccacaacatgccccaatatgtgatgttccccttcctatgtccaagtgttcccattgttcaattcccacctatgagtgagaacatgcagtgtttggttttttgttcttgtgatagtttgctgagaataaaaaggtaaaaaagaatttaggtcaaagttacttgttcacagtctgtggaggagattcacttgattccttgatcagcatcagtagccttgaacaacaggacagagtcaatcttatgaagagtggcctgaaaagtttcatcatattgaaccttctcctgcagaattcctctaatgaactattaaactacaagaggatacatagcaaaaggcagatttcaaatatattttataagtttgttgtgaagataaagacaaaataataaatgtaaagcctttaaaaactattaagccaagtttagcaagcttttttttgtaaaggagaagagagtacatattttaagatttgtgggccatatggtctcttttgtaaatactcaactctgtcatagtccaaaagtagccatagagaatatggaaaagaaagagcatggctgtgttgcaattgaactacagtcatgcaccgcattacaaagttttactcaacaacagaccacatatacgacagtgtttgcataagatcataatagatctgaaaaattcctgttgcctaatgagtcgcagccatcttaacattgtagcacaattctttactcatatgtttgttttaatattggtgtaaatgtgaaaggaaaataaacctgggagcccccaaattactaagccaaagggtgtcaggcaaacctgtctctcattttattttaaaataactacaaagattttttttttttaagctacatacctccctcacaatttgcccaccatgaaattccttgtgagcctcaaggtcttcaccctaaaacagttctgttgaatttcaccctggcaatgtaaactgatagcttatcttctcaggggcaggacaaaggacagacagaactcagagtcatctctgctcacctgcattattggattgcttcctctgccctattgtttatgtaaaaatgcagattcactgagtcagactaagacacaagtgactattcctctactctcctcttacatgtaaattttatattcagtgaaaggctgattaaagacccaaaaagacctaaaagaatgcaaacttttgtctcttatttacctatgtcctggaagccccaatttctagttgtcccgcctttccagaccaaaccaatgtacatcttacacatattgattgaggtctcatgtctctctaaaatgtataaagtcaagctgtgccctgaccaccttgggcacatgttctcaggctctcctgagggctgtgtcacgggccattggtcactcatccttgactcagagtaaatctctttaaatattttacagagtttgactcttttcatcaacataaacaaacccattgtgctgccagttgtaaaaagtataggacacacaattatgtacagtacataatacttgatgataacaaatggctatgtaaatggtttatgaatttattatactatatttttattgttattatagagtttacttcttctagttacagggaaaaaaaaagttaactgtaaaactgctgcaagtcgatccttcaaaaggtatcataggagatggtagctctatgtgcgttatgcgtggaagaccttctggtgggataagatgtggacatgaaaaactatgatactgatgatcctgaacatgtgtagccctaggctaatgtgtgtgtttgtgtctcatatttaacaaaaaggttaaaaagttcaaaaaataaatatatatatatatatattttttgagacagagtctcactctgtcgcccaggctggggtgcagtagcacgaactgggctcactgcagccttcacttcccaggttccagtgattctcctgcctcaccctcccaggtagctgggattacaggcgtgtgccaccacacctggctaatttttgtattttaagttgagataaggtttcaccatgttgaccaggctggtcttgaactcctggcctcaggtgatcctcctgcttgagcctcccaaaatgctgggattacaggtgtgaagcactgtgcccagccaataaaatatttttaaaatagaaaaaagcttagagaatatgaatataaagaaaatattttgtgcagttgcatgtgtttgtgttttaacctgtattagtacaaaagagtcaaaaagtttcaaaaaactaaaaagtttacaaagtaaaaaagctactgtaagctgaggttagcttattattgaagaaatttctttttataaacatagagtagcctaagtacacagtgtttataaagtgtacaatagagtacagtcatgccgtaggccttcacattcactcgccactcactcactgactcaccgagagcaacttcctctcctacaggctccattcatggtaagtactctatacagatgtaccattttttaatatcttttataccatatttttactctaccttttccatgtttagatacacacatacttaactttttgttgcaattgtctgcagtattcagaagagtaacatgctgaacaggtttgtagcctaggagcaataggctgtaccacataacccaggtgtgtagcaggctgtaccctctataggtttgcgtaagtacacttaatgatgttcacacaatgacaaaaccgcctaatgatgcatttctcgattgtattcccatcattaagcaacatatgactgtacttgcaaaaacagatacaggccgcatctggtctataaactatagtttgttgactcctgccataaagccccttatctcatatagataatacagaagagaaacaggatttcagagagctggcttccagttctgtcactgaccctaatggctatgttgttttagacaatctccttatctcactgcctacttgaactataaaaagaaaaaggtaaacactaagatctcttccaaagtctaaaatccttaattattgattaccctagataattctcataaaacctcctttcttaggttgtagaacctggaaacaatttcatcatcgcaaaccattaaagcttatatttagcacatggatcattgtcatgggatattggccaatgaatatgaataaaatttctttattagaaagaagaagtttatgctaaaaggaaaaactagttggaaaaactttaatggtacagcgaatttatttttggcatttcatattttatcaagctcccatattatgttgaatgtatcaaatgtactcaaatcctttctaattttttaaatatttcattcaaataagtattttattaatgtggcatcattatttcaaagtttttaccctacttaatataaaatattatttggaagaaggagttaaagtatttaatgaaaataaacatataaatagttagaaaatcaaattagctgtcaactattccattagagacagtggtggttgttataatgcttaaggacagaaaagctaataaaatacattaattataaatgtgtttgaatttttaacacacatttaataaaatttataaaaattaaacttttggaaatttttcttaaatacaaacaaaagaaaaatataaaataatgagcattccatcacagaaatagatcaagaaatacctgatgaatgttaaacgtattcttttataaatgtgtacattacataaggatttggatttaccaaagataattccagttttacaagtttataaagtcaaactaaattctacttcttactatgttaactgaaacactttaaaaatgttctatctatctgtagtagtgtcaacaatgaaaatgaagttaaaaataaaaaaaaagttctttgtaggcaggatatagcagagaagagtcaacaggtgctgagacatggatgagaaaaatttaaaacaatagactttttaataaaatgtgaagacatttttacagatttccacagatgaggaacattgcaaacccaaagttctaactcacctacatcatacagttgattattggcagagctgaagctaaagcttgtgagtcttagttcctattcttgggttatttctactctaccactttcagcctatgtggtgaaaagtaacatgaaaacagtaaaatggcaaagcctaaatgtgctatcagctggaaatcaaggctttctttgagacaaccacagaactagtctaagcatgctgcctgaaagagatgaaacgaaagaaagtgtgggaaaatgggaaatgcaaataacactaggcaaagagaatatctggaataattacttgaaacaacaacaaaaactgtgtaagatgagaggactgttttatatactctcttgagagcaaaagaaatataagaggtcttgttcattcatgcagtcattcagcaaacattcttaggacctactacatgatatttgcaggtctgggttctgtgaaaccaacagtaaaccagaaagactttcttactaagcaacagaaaaataacaagagctattttagagaagacagagtatttaggggagaaaggtgcatagtcaaggactggtaaaataagacttgctgaaggaagtggtatttatcttagtcaaaggtttgagttagagttagccattcaaagaaggaggaaaagggaattccaggtgaataagtctttatttgttaccatctctgttgactttactgcagaccctgcaggattagtagatttcatgacaccactagccacctctttataaattctctaggcaggcttagcctctattcaaatctaaatgtgcagccccacagtcctctcctctatctacatcctcacatttggtaactttatccagatcactggctatatctcaccactgagctataaaccagtgtgtccaaccacatgtttctactctctacctgttggttattagacatttcaaacatagagtggcttggctggggtagctctccacatttcttccatttttctccatagagtgtgtaagctctcttggaacacactaatattagcaagaagagccaaggttagtgaagacagaaagggacaggtatttaagccaaacaacaaaagattagcaataattgactatgcattgaaggagaaaaacaatattccgagccaatgaagatcttctctatttttagcttatgttttctaacaatgattatcactataaagcataagtggtatttatttgattctttcttttgtgtgtgtgtgtgtgtgtgtgtgtagcctaaattcttacaaaaaatagactatatccatactcagtaatgaagtaatcttgaaaaagaaacacttatcatcctgtatcactaagagaatgttagtgatgctagtgaaggctccaggtatagccattagttttatttatttatttatttatttatttatttatttatttaattattatactttaagttctagggtacatgtgcacaatatgcacgtttgttacatatgtatacatgtgccatgttggtgtgctgcacctgttatctcgtcatttacattaggtatatctcctaatgctatcccccctccccctatgccatgacaggccccagtgtgtgatagtccccacactgtgtccgatattccccacactgtgtccaagtgttctcattgttcaattcccacctatgagtgagaacatgcagtgattggttttctgtccttgtgatagtttgctcagaatgatggtttctaggacaggaactcatcctttttatggctgcatagtattccatggtgtatatgtgccacattttcttaatccagtctatcattgatggacatttgggttggttccaaatctttgctattgtgaatagtgccgcaataaacatatgtgtgcatgtgtctttaaagcagcatgatttataatcctttgggtataggctcagtaatgggatggctgggtcaaatggtatttctagttctagatccttgaggaatcaccacattctcttccacaatggttgaatcagtttacagtcccacccacagtgtaaaagtattcctatttctccacatcctctccagcacctgttgtttcctgacattttaatgatcgccattctaactggtgtgagatggtatctcattgtggttatgatttgcatttctctgatgaccagtgatgatgagcattttctcatgtgtctgttggctgcataaatgtcttcttttgagaagtgtctgttcatatcctttgcccattttttgatggggtagtttgattttttcttgtaaatttgtttaagttctttgtatattctggatatcagccctttgtcagatgggtagattgtaaaaattttctcccattttgtaggttgcctgttcactctgatggtagtttcttttgctgagcagaagctctttagtttaattaaatcccatttgtcacttttggcttttgttgccattgcttttggtgttttagtcatgaagtccttgcccatgcctatgtcctgaatggtattgcctaggttttcttctagggttttggtggttttgggtctaacatttaagtctttaatccatcttgaattaatttttgtataagatgtaaggaagggatccggtttcagctttctacatatggctagccagttttcccagcaccatttattaaatagggaatccttttcccattgcttgtttttgtcaggtttgtcaaagatcagatggttgtagatgtgtggtattatatccaagggctctattctgttccattggtctatatctctgttttggtaccagtaccatgctgttttggttactgtagccttgtagtatagtttgaagtcaggtagcgtgatgcctccagctttgttcttttggcttaggattgtcttggcaatgtgggctcctttttggttccatatgaactttaaagtagttttttccaattctgtgaagaaagtcattggtagcttgatggggatggcattgaatctataaattaccttgggcagtatggccattttcacaatattgactcttcctatccttgagcatggagtgttcttccatttgtttgtgtcctcttttatttcgttgagcagtagtttgtagttctccttgaagatgtccttcacattccttgtaagttggattggtaggtattttattctctttgaagcaattgtgaattggaattcactcatgatttggctctctgtttgtctgttattggtgtataggaatgcttgtgatttttgcacattgattttgtatcctgagactttgctgaagttgcatatcagcttaaggagattttgggctgagacgatggggttttctagatatacaatcatgtcatgtgcaaacacgacaaattgacttcctcttttcctaattgaatacactttctttctttctcttgcctgattgccccggctggaacttccaacactatgttgaataggagtggtgagagagggcatctttgtcttgtgccggttttcaaagtgaacacttccagtttttgcccattcagtatgatattggctgtgggtttgtcataaatagctcttattattttgtgatacgtccctcaatacctagtttattgagagtttttagcatgaagggctgttgaattttgtcgaaggccttttctgcatctattgagatactcatgtggtttttgtcatttgttctgtttatgtgatggattacgtttattgatttgcatatgttgaaccagccttgcatcccagggatgaagccaacttgatcatggtggataagctttatgatgtgcagctggattcagtttgccagtattttattgaggatttttgcatcgatgttcatcagggatattggtctaaaattctcttttttgtgtgtgtctctgccaggctttggtattaggatgaagttggcctcataaaatgaatcagggaggattccctctttttctattggttggaatagtttcagaaggaatggtactagctcctctgtgtacctctggtagaatttggctgtgaatccatctggtcctgggctttttttggttggtaggctattaattattgcctcaattggacttagttttgaatggttcttccactccgttatctgaatacacatagccaataaaatctcacagcaatttgaatgaatcattatgaaagcaaaagacaacaaaatggtttgctattttctttgaattcctaggtatatgaccttgtacttcagtcaaaataatctatttttttaacctaaccacatccttcactgatggcattttgttgcatatacaaaatacaataataaaaagagtgagtagttcaactgtaagactgatttataatgacagtttttcagatacaggggaaatgaagaattgagcagattctgtgaagtgaaaattcccaattatgttattcccttgtattaattaaacaggtgctaggtagttttcagagtagcacctctgagacttgtgttatgcagaattacttacagttgttaaatgttatgctcttctcagtgaaagcactaatacaaatcctgattgagcatctattaggtagaaagtacagctcctcttggactcccttgaggagataactgactaatcctcaggcaactcttctatttccccaaatctttgttcattaagaaaaaagtccactttggagtccttccaatgtttatcaaatatgcttctgacaaacttactttctttaaaaatcttagcccatttcaccactactgtcttattatatcatttccttcaagaaataccttcactgggtcccacatacataacagaaatagtccatatttttagcctaatatttacggtcttccaaacattgaacaatctcaaccatgcccatggcttaaactattctgtttgtgaccaaaacctgcagcttttgacaaaacttcatatctgagctccagaatctaagaacctgatcaagctctttctttctttctttcttttaggtggaatctcattctgttaccgaggctgcagtgcagtggcatgatctcggctcactgcaagctccacctcccgagttcacgccattctcctgcttcagcccctcgagtagctgggactacaggcgcccgccaccacacccggctaattttttttgtatttttagtagagatggggtttcaccatgttagccgggatggtctcgatctcctgacctcgtgatctgcctgcctcggcctcccaaagtgctgggattacaggcgtgagccaccacgcccggccgctcttttcttaaatatctggtggaggcctcaaaatcaaaatgtctaaaacagaactcatcatcaataaagccattcgtccatttatattctctgcttctttgaacggttatccagtacctccaaccagaagtcaatagcttaccctggagtcttttttatcattacctttcgtattcagttcgtcagcaagtatgtctaaaatccttccattcttcctgcttctctgttaccaactgtgctgcacagtgtatgccctaccacatctcatctggataatttataatagcttcactaatagttgcttttcttccagccatgtctccttcccagtgagatggttcatacaatcatggaattttatctttctaattcatacattcgatcacatcactatcattttcaaagtttctttatggctcaccatcactctagaacataatctaaacttctttgcatggctgacaagacattttttgatctggcttcttgcctcctctcctgccagccttaacctctctcccatacttccctaaacattttattttccagttctcataaaatgcctttactcactcatatctccatgcctgtgcacaattacgttcttctttgcatagtaccctttcttgtctatccatcaaactctcatttataattcaaatctatactcagatagtacgtactgtataaacttcccctgactcctgagatcttagaatctcctttccctttatacattaaatatatttaaaatataataattatatttttataatgatatatgtcgtttatgcagtatgtctgtctcctactaggctatgcattccttgaatcctgcttgtacaactttgtatcatcacttaggaacacagtcagactcagaacttttaagaaattgacttgagtgaatgaatttttcagaatttttaagaaattgacttgagtgaatgaatggatatataaaaataagagtgagtttgactgaaaaaagataaggaattattgttatttcaacagcttaccagcactaacgctcattattccagtaggctaagttgccttggaaaactaatgtttgaatccttccttcctgttaagagtttttaaagtcagttttatggcatttcttgtagacagaggcaggggtaacacaggaagaacagaggtacaaaaggaaaatgagtttttctttgatcaccacgaaaagtcccttacatttcaatcatgcttgtatctctgccaagggtcaaggtgaatgtctgttattattgatgaattattttaggtcatttatcagtcacacatactggctggatttcataaacagcaaaagaaaagtttgaattaggtgaggaaaatgactaagcaaatgtatatcctcctgtgaaggtaagaaccaactccgagtttgcaatgcatcaattccaaaattggaatgctcctttttctgttttacttagagactttcccactgcaggccccaattgaactctggaagacacaacagtacagaagatctgagaatagatgccaaacacactgagccttctaaactcacacgaacaagaccaaaaataaaaatatgaaataaaatagaaaaaaagaggaagtaactaataccctttatgtcaccaagctagcaggtccatactacataaactcaatgtatttattcagctttctaaaacttacaatttttaagatgtcacatgtcgaatctgatactgtagtggtagaagagacctagacactatgtagtgtggtgcttatcagatcataatctctcaagaatctttggattctgatgtgatgcctcagggactaaacttgggagagcaaggaccagcttccctaccatacttcaattcaagcagcaatctttttatctgtttcatttgtttgtttagtaatgaagtcccatgcaagattttatttggtgttgataaaataattctttataaaagttaaaaatactgtcatctattctaaattccttgatttatagatgaggaatccaaggctcagaatggctgcataataactcaagttggtgtccaatgagtagaatctgcccaggtcttctaatgctcattacaatggcaatggtatacctgggcttgagttttagagcccaagtacctggattcaaattaccactgtcacctgactttgggcaatttatttatcctttttgggcatcagtcttcatctgaaaaatggggttcatattggtacatacctcatagagttgttttaaggagtaaaggggttaatataaagaaagtgtctaacacatagtaagcactcaaaaatatcaccggaactgtaatataactattattctattttaccaaactgaaaaacttcagggttaggcagtgtgttcgtttctatacaatgttgttgtattgttgctacagcaaattactaccaacttagtggcttaaaataacacaaatttattatcttaaagttactgcagtcagaagtccaaaatgggtctcactgggctaaaagctagatgcccgctgagctgatttccttctggaggctctaggggagaatctcttcccttgacttttccagcccccttcattccttggctgtggcccctttgcccatctttaaaaccagcagtgtaccactattcagagtctgactctgactctcacgctcctgcctcctctcaatgctttcacttacaaacaccctttgtgattgcattggtctcacccagataattcaggataatctccccatgtcaaaatccttaacttaataaatctgcaaagaccctgttgccatgtaaggtaatatatttatatagatatatttggagaatcattattctgtctatcataagtgggtaatgtaaatatgcaaaacagctttgtataagaagagggagtggtgtatactgcataaaccttacctaaaggcaattgtgtgtgtgtatacacatacacacagaatatatgtgtttcatagatatgtgtgtgtgtgtgtgtgtgtgtgtgtgtatactgttgccttatatatatatatctctgtatataatactaggctagtcaaactaatatatcctagacctgatttgactgaggaatctggtttgggatccttgccctatgtcattccattatgtggttagaccaggtctatataatctaaagcaaagaggaaaggtggtgattgcctgagtctctgctatgtaagcatcctagataattccagatattttttcagagtgaaacaaagtgataaatatcctcccaaattcatgcagtctgcttcctacttgctttaaatacctggatgtgggaaatgacccagtttttatctacctttattgactatttcaaattaaactctttagcagtcaataacaacaggagtcacatcaacagctgcttcatcctacactctgattttatgtctctcttttagccattacacctggttgacttggaaatcctccagggacaacatctgttatcgctgtctcccttgaaattctggcccatggttgtttaactgcaaatgtggaagaaaatccaaactgtacttgtttctgttgtctcatggctttgtcaccatatgtcaaatcaaattacacttcacagttgacagttgaaagaaatgaagaaatagtcagtgcaaagataccttttttgaccattagagaacaaaaatataaaacctgttgacttatctcctttacaagaggacctcaaaaagttcatgaaaaaattgaattaaaagataagaattttaaatacaaactttatttctcaacataatctccaacaagttcaagacacttttgtgagcaatgatgtcacccatttagtctatgcctaaaggactgagagtgttcagaatttaagcatgccaattcagtcgtttttacgttattaatggaagaaaaaatgggtgccatttaaaggattttttagtattaggaaacaaaaaggagtcagaaggagcaaaatcagaactgtaaggtggatgcctaatgatttcacatcaaaactcttgcaaaattgcccttgtttgttgaaaggaatcagcaggaacattgttgtggtggtgaaggatgctgtaataaagctttcccaggcatttttctgctatagctatggcttcctcaaacactcttaaaataagtaaacgttattgttctttagcccttgatatggtttgggctgtgtccctacccaaatattatcttgaactgtagttcccataatctccatttgtgtcatgggagagacccagtgggaggtaatggaatcatgggggtggctatctccatgctgtttttgtgataatgagtgagttcttacaagatatgatggttttataagggttttccccctcacttcactgtacttctccttgctgccaccatgtgataaaggacatgtttgcttccctttccaccatgattatatgtttcctgaggcttccctagccctgcggaactgtgagtcaattaaacctgtttcctgtataaattacccagtcttgggtatgttcttatagcagtgtgagaacagactaatacagccctttaaaaagtcaacaagcaaaatactttgaacatccccaaaaaactgttgccataaccattgctcttaattggtctgtttgtgtttgattcgaccacgcccacctcttggaggccattgctttgattgtgcttggtatttagaattgtactggtcaagacatgttttatttcttgttacaattctttgaagatatgcttcagtatcttgatcccacttacttaaaatttccattgaaagctctgttcttttctgaagctgatctaggcacaacagttttgacatccattgagtgaaaagtttgcttaactttaattttttagccagactgcgtaagctgaatcaattgaaatacctctgatgttggctattgcttatgctattaattatcagtccttttcaattagggcacaaacaagattaattttttctttgcaaatcaatagggttggtctgtccctgcaggcttcatcttcgacattgtctcatcccatcttaaaatgaattatctatttgtaaaccgttggtttctttggggaattgttcctataaactttttgtaagcatcaatgatttccccattcttccactcaagcttcactataagtttgatgtttgttttgcttcaatttcagcagaattcatgttgccctgataagggctctttatgaactgatatcttatccttcataatacctcaaactagctactatttacacatgttataacaagttagtatgagtttattttgatgcaaaaattttgaaatccatgcataattttttcatagtattcattttctgtaagctttttgaagaccccttatacttggtatgattgttatcattgccaatgtggaaatcagcttttttaaatggttatcagaaacctcgtctgagctcacaattcagttcctaaaatgtagattagtctccataaacagaagtgagtgagaagcatgcaaggcaaggcaaccaagtatccttgaggtgctgacactgaaggaagggtgaggaagaaataacaagcagggagaagagaaatgaaaaacagaaaatgaagttgtcatgtgtccatatgtatggtatggtgggtattcatagtggtcaaaagtcttacataaaagaaggaaaagatttgtcctaggccatgtctgcctactaaatattaataggtaaagacctactaacagttaaaggtaaaagaatctgaaacctgtggaagtcattaccttactgactgtgagtttatgagccattgtttatccagtagataaaaggaagcaacttttgccacatgccatatttttagaaaagaagcaaactcttaagtcttactccactgaatcagttcttttgtcactaaagatatattgacatggccaccaaaagcagtggaaagatactggtataaatgagggtgcaatggttgttttattaactctcagatagcatatacatttgctattgctgttattacaaattaccacaaacttagtgacttaaaacaatataaaaatctatagtttcagaggtcagaagtctgaaagtagttttagggagctaaaaatcaaagtgttggcaatcctgcattccatctggaggcactaggggagatctgtttccttgtcttttccattttttatggcctactagcattccttggcttgtggctccttcttctgtcttcaaagcatatcatttcaacctctgccttggttgtcacccttcctctttctgacttagaccatcttgaccccaggggtctaaggacccctgagattacattggaccaacctagataatccaggacaatctctttatatcaaaagccttcacataatcacatctgcaaagttctttgtgccaggtgaggtgatatgttaacaggtactagggattaggacatgaatatctttagggggctattattctgctattatttagggggctattattcatagatccacttgtcaataaagaccttatctagaatttacaaactcaagtgcccacagaagatagacaagtaatagaagtgaatgagaaaaaccaaggagtggtggaaactgaggtaaattagagagtgaatagcattctaaagcattcacaattttaataacatatgtagttaccatgtggacaaaaaaaaattgtctctggttcatgcctacctatttgcaacctttattttaaaccaaatatttgctccgaatgagcctcttctgccattataaagtgagacactttctgttaaaatgtctacatgcactctgcagccaattacacacttacatatatagaaaaggttaaaatacaagaatgcagtaaaaaataaccagaatgtgatttagaggcatgtgttaactgaaagacccaccaagaactaattggaaggaaaaggccaggaaggaaattgaccattacaggaaatacaggataaatttctttaaagatggtgatcctgctcccagcaggctcagaaagacttctctgatttagaggcaaataagagccagctaagtagtctgcaaggattaatgacccatacatttttgtaaacagcaactgtgacagtctagcacaagttccaaagacacaggcaaggggattagcaaagtcatgtttctgatggactttctcttgggtttctgttaatccatgaggtttgatatgtgttgtaagagaaaggagctgaacataacattttaaagatctattgagtatttggccacaataaggactaaatcattaccattttaaaagtcccaggttagcagacatactctgaggcctgcatcacaatcagaacatatatcagatcttataaacatttagatcaaagattaagattataaagaaaaatttccaggaaattcagtgtccatgtccacatacacagtattttttttttttttacgtgtagtggggaggaatgaaaagatacatagtcaatgaaggaagacaactgtggcagctcatgcaccaggagagctgaagaatcaattaaaattcatgtgagaaaggtgacatattattttattcaaaaccaaaacaaacaaacatgaactttcgcttatgcaagagaaagctctacgcttatatctaggagaaaggagttgaaacaaagaaagctaaatttattttcacacaaacaaaaggtctttttctctctttgtatgtctctctctctctctctgtcttctatttttcttttctttctctctcctgttccctgtgtgtgtgtgtgtgtgtgtgtgtgtgtgtttgtgtggagagagagcaagaaagaaagatagagacaacaagagagagacagaattagagagagatagagaaactgttttattgaatgatctgtgctcagtaaaggtgaaaatataaattagcattttgttgttgttctatgccactgccttccgataagtattgtcaatcattttcttgcctctggatgaaatctcagaagcataaaatagcattatccatcactgtcatatataagtgaatgctatcttttgatacaaaatgcccagtttaggccagactaatatcgaagccttattctcctatataagtcaaaccttcttcccggtcatcttgcatcttgggcctgatttagacttggagatatgcagtagagatgaggtgcttaatcagcttctgagctttgctcttatttccctttctttctactctctaggctatctctgttttttccagaaatagagaggatgatgggagaagagagatgaggcagaaagtttttacttaactggtatggttgtccctgacattggtggccaccaaaagtgctcttccttctctcttcctctctctttctctgtctgtctctttatccctccttctctttctctttcacgagggccctctctggggtcttcagaaaccttcattactatggatctctcccctgctattcacttgtcatgaaacacgtcacctctgccatttctagatgattattcatgatgtttccctaagtcccagcatctagtggtccatctcacacatacttcctctcatgggatcaccaggccctctcaggctatcctttagggcagactctttcaagatggcctaatttcagctcctacattagtttacatctgatccatatctagaagagcaggccattttgaattcagccctgtaccttttctttcttgctacaaatggttccctttaggttctttactatataaattgtaggtgtaaatcaggttcctaagtatcagtgaggacagcccaagcttaccagtgagtttctggaagcatccctcagcacatgtgaagtaagagttaaagacctctctcctctgttcttttatactctcctgtggtcacacacaatcttaatatattttgtttcagatgatctagcagctatgatagtcagtgttgaattccctcctggaacttctagatagagcgaaaagccatagttgatatcctgttacatagataggtagtttgacagatgatagagaaataaaaagatatagagacatagatgtccaggtgtggtgagctgtctgagaaataataaattggagcccaataattcaaggaagagatgagaaggtagagtagtagattccaacaagaaaacaacagattggtactaagaagagagctgattaataatggtgtggaggcaagaaacttagaatagtgatgactggtgtttaatttttagttacttttggatctgggcagaaacgcccttcattatcccccaaatcttcaggacaatctgtcaccaattctataaccacactagcattgacttaatgcagtactgctttggataataaaaaaaaaggcattttcatttttacataggagaaggaacaagaaagagttggagcaggcagtgcccaatgaggtaatggtgagaggttctcaatgactcattgaaagtaagaagttacaggcagctttaagtcagtgttagcccctcttcttgaatacctgcaaaaatatcaagagtcttggacttctggttatttcagttggaagcctgaattagttctcataaatttcaaacaaggtggtgcctccagaaggctggagaacttggaggtgttcaggatacatatgactaatatagtatcccttgtttcttaagccttctaatgtaaatctgtggttagagtatctgatcaaacttcaaaatcttccatagttattgaaaaatggaaataagacaacacagaaacattctaaagatttaaatccctagaataatccaagtacgaactatacattattatcacaagtcgcatatttcattaaaagtgggagagttttgaggctttgattgagcaattttctttccctgctgtttgagcctctgtgattttagtgttttattccttgaccccttcacttcgttgctgcaagtttccttacccaaagcacatgctctcaatctcattttttcgatgaggaagggattattactagacaaaagcagagggcaggacaataatttgttttcccagtactccagaagtctctcacataagtcctgctttaagctaacgggcagtgtgcagagccaagttgaatcctgttatgatgccagagcaggctgtgctgggctgagctgcaggctttgctccctgtaggccaagctcttataccttctgtggtgttattatatatatatatatatatatatatatatatatatatatatatatgtacacacacacacacatacatatatatacacacatatatacatatatatgtgtgtgtgtgtatatgtgtgtgtgtgtgtatatatatatatatacacacatatatatatatataggttttcatccacagttcctgagtcatagctaccatagcccttgttacagtcttttgttattaggttgggtgtgttaggcctcaggggcaggactcaggaaaccgaatctctttgaccttctcctgtcctcctttcacctgcccaaaggccggactctaatattgctccacctttctcattgtaggtcataaggccctcatttcagagaggctcttgccccataccctgggagaaagaatgctgatgtcaagaattttccataaaaacccaagaggattgggttccgagagcttcaggatagctgaacatgtgcaggttcctggagggtgacatgcccagggagggcatggaagctccatgtcccttcccccattcctctttccccatacctcaccctacacagctctccatctgtatcatttgttttgttttgttttttgagacacagtctcaccttatcacccaggctggagtgcagtggtgtgatcttggctcactacaacctctgcctcctgggcacaagcattctcgcctcagcctccccagtagctgggattacaggcacccaccactgcacccagctacttttttgtatttttggtagagatggggtttcaccatgttggccaggtgaatctatgatctgcctgccttggcctcccgaagtgctgggattacagacgtgagtgaccgcacccggccatcatctgtatcatttgtaatatcctttataataaattggaaaacataagcatatgtttctctgagctctgtaagccacgccagaaaattaatcaaacccaaagacaggggcatgggaaccccaacttaggccagttggtcagaagttccagagccctggatggacttaagactggttggggaggcagtcttggggattgagccctcaacctatgggatctgacactatctccaggtagatgtatcagaattgaattggaagacacagagttggtgtccactgtagaattaattgcttgctttgtggtaaagagaaaccctcacacatctgttcacagaggtcttctctgtgttgatagttattgtggtagtggtgtgaaagcaaaaggaaatcacagtttgagagttttttcccaaacaccttatgttccagagccttgcaggttgactcattaaagtcatgctcaggctcacccaagtctgatttgtaaaccagagaattaatttgctaatttacagtgattcagattcagctgccatttgttttgagcacgttacatgtcaaacactgagcttgaggctttctcaccaatgatctcatttaagcctctcagcagcagtcagtagatgtccccagaggaaagcctattcagaaaaatgaataaggtttataaagtttcttagaaataccaagccaaggcaaagagaactggatgatctgtggagattatcttgaagtaggaggatgctcttgaatctttgctctctacatatatctgcttacgggtcagttcctagcaaggaaacccagcctcttcctcactgtctttgctgaacccccactaatcaaagtcttctcacatttttcagtatttcatgctgccattttgtgccttcctatggcatcttattccctcacttacaactagactgcttctctagaaggaatctagacacagcttgcttttcttactacagtagaatgtcctccatctcctaaatagatgcaaaactctttcttgaatctgacttatatcactttctacaataggagacctgactatttgtttctggggaaaatacctggagcttttctgcacctatgctgacaacaaactgtgtcctttctgtagctccaggcatggcatgaaggtgtgggagggagcagtggcatagagagattcaaacttttatagctataatcacataagaaaaaactggctcatgtgtataagtttggtattttaatttatttatttatttaagtgtttatgcagtgccatgcattgagtatacagaaatgaataaggcacattgctctcaaagaattcattgtccggtagagaatacaaacatgtaaggaaataatttcaatacagtgagctaacggttaattgaaatatggacatggtgccatcagagaattgaggttgaggaaattgtgtctacatggtcagggaaagtctcacagctaagatgacctttaagaagttttaaattaaggacagaagttcactggacaggaaaaaggggggcggtgggaggaggcatgtggaggaatgttaaggaaaagcattccaagcagaagggacagaagcataaaacagcataggaattttaaaaaggtatgagatattggcatgcctatagcaatttatatgagtggaaatgaagctgagagttaggcagggtcttatcaaaattgactcctattattaagattagaaatttgaattacattcagtaaacagtaggtattgaacttaagcaatgtaatgtcatttgtgtttttaaaagatgacttttatagtattacaatttggagaagttattttgccttgtaactgataactaaaattaatatataaatggtaatatttgttttaaggaggtttttaattttatcccaatgtgtttaaaatgttattttgataatattatagttattttgtaatatattttcttcccttattatagtcttccctgacatacccacaacttaatatatagtataaacctctgttgtagtgggaagagggctgaacctagaaacagaaaatggttctgagaccctacccttcttctttctggctttgtgtccttgggcaagtcacttaacttctctgaaactcaagttccttatcagtgaaagggggatattgatactcaaattctggtttgttttgaggattaaattaaagaaaatgtgagctatctcttggacctaaaaggacttcataaaagtatagaaatatatatgtactctctatatacaattttatatatgtataagttatatatttttatataaattatatatatatattattgtataaaacatatatatttatttttctttccccagggctctccttcaggaatttcgattcttgatatccatgatgaagtcagatgatatttaagaaaccctactgatcctgacctggccaacttagatgtctgcctttcttttctgcatgaaaccattaagactcagagagtgataattagtgatgaagctgtaactaaagtctggactcctagaacagtgtactttcattaattcagaaatggtctagaatggcttcataaacagcaagctgaaaccacattcaaaattacaacttacatgagtggtattaatatgtatggaatagatcttgatgccttgatccaaaggtactgacttgctatttgaataaaaggggaaatctgatggttagagagggtaacatatatcccaactccttttccccttgatggaagaagttaggtctcttccttactacaaactatgctgtaaactcttaactatttctggtgccatcaagtgattaaagattgatttgcttgaagtgaaagcatcctaattgaataataatccagttaagataaacaataaataaccaatattgtctttgtggtggaattttcactagcaagactctagataatatggcaaatacgtttttaaaatgcagcttttcaaaaaagtaaacaaaaccccacttttgtgtttttaaattaatttttaattaattttgtgtttttaaattaagattcaaaaactagattgaatagagtaagtgaatttaagtaagatcattcaggtggaaaaggggaaatttctttgctagtctataataaaaattcagagtaagaagtttgattttggagaaaacggtgggatagattctcaaatcaatctcctgaggaaggaatagcaaaaatacaaagagaatgtatctttaaaaaactccttgggagaggcttcaggatggttgactagatgcttattagatctggtacttgcctcttccatgaagagaaactaaaatagcaaatacataatcacacttcaaatagatcatcaaagagtgaacactagaatttaataaaaaaatgacaggaagcactgaagcaaggaaggagagaaaggaaagacagcctgtttggctgtgattggttaggagtctggagaagctccctaatgaagatgaagggcaagtgaggggcccccagaactccaaattcccaccacaggctcttataatccaagttacagtagagcccctgaacctttatggaccctgggactaacataaagagctagagagcacgtgaaggcactgctccagagagagagctcacacggggtcccacacaccccaactcctaagcagctgtgctccagtgccattttgagagccaagtccccaccagactgcatcctgcctggaggcccaatagcggctgcatctttgcatttctggagctccattgatatccttgtctgctgcaactggggcctatgcaagagccactggcagtagtcctgccctcctagcagagggcagtcatgcattttcatgcaccctgaggacaaattctgctgcccacaatcaccactgctgtgtgctgctttggggctaaagctcaagcaaagtgcatgccccgcaccgccccccccacaaaggcacctgcctatggttgctccccagtgtcagggctgcagtgcagccactgctgcctccaactgggcactccaacaggggcctggggatcacccaatctctgcctacaacagccagtgcctgtttgcatcactgggatgcctgagaacagatccacctggccaagctccactccccactcagtacccagatataccatccagggtcttgagaattgcccagtccagcttaccacctttggtacctgaacacttctcccaaggtctgtggtcaagtccactgaacctgccactaccaccacagctggcacccaatgcatgcatcagcaaggagtctggagattggcccaccaagctgattgcagccatcaacatcatcagcatggatcagttgagtcccaaagagttgtctcaccattgctacagccatcaaccatgcaatgcctaatgcctattgcctactgcctaggggctcaagaacctgtccacctacccagtccactgacaatccctggaacctgagaaaactgcctagaagttcaagaactgtctttcctgaaccaactaacatcagtgccagcatgcaccaccctggagtttaaggacagacacattcagcttactgctgccacaactagtacctgaagactgccccatctggtattccagtcccgagtaaaactttaccacaacctctactaacaactgcaccctaagccactgagaaaatcacaaacactattgatgctgttacaactaaagaaatcatacagagactacatactgcacacacccagaatcaaatcaaaagtgacctacccagccattaccataaatacatcatcaggaaaaatttgtctcacataaaagcaaattcaaaaattggaagaagcaacaattacatcatgtgcatagatatcgacatacagacacaagaaacatgaaaaaataagaatatattacacactcaaagaaacacaataattctccagcagcaggttgcaatcaaaaacaaatttacaaaaccccagaaaaacaattcaaaatattgatactaaagaagctcaatgaaatacaagagaatactgaaaaacaatacaaataaatcagaaaaacaattcaggatatgaataagaaattccaaagagatagatatcattaaaaaagaaccaaatagaaattctgaagctaaataatttattaaaagaaatacaaaatacattcaaaagcttcaacaataaactagatcaagcagaagaaagaatcccagaacttaagtccttttcaaacaacccagtcagacaaactgaaaaaaaaaaagttaaaaagattgattaaaccctttatgtcatatggaacaccataaattgaccaaatatttaaaatttttatattcttgagggcaaagaggaaataaaatctttcccagacaagcaaaaggtgagagaattcattacagctagaccagtcctacaagaaatatttaagggaattctattcctggaagaaaaaaaaaagctattatgtttcctgatattttcatattatattatcatgaaaacacacacaaaaataaaaaccaccagtagcacaaacacacaaacaaggaagagaaagaagctcaaattttatccttatagaatactaccaaaccacaataataaacaatgagagagaaagaaagatacaaaagatatataaaacaaccagaaatcaattaattgaatgacaagactaagccttcacatatcaataaacttgaatgcaaacagattgaacttttcacttaaaagatataaactgaatggatttttcaaaatgatctaactatatgctgcctacaaggaattcgtctcacctgtaaaggcacatatagacaaaagtaaagagatggaaaaagatattccacagaaacagaaactaaaagcaggcaggggtagctatacttttataagataaaacagactttcaatcgagaacaataaaaagagaaaaagaagggcattatataatgataaaaagattagttcagcaaaaggatacaataattctaaacatatctgcactcaacaatggagcacccaaatatataaggcaaatatgattacatttgaagaaagagaatacaataatagggacttcaacaccccactctcagcgttaaacagaatatatagataaaaaattaacaaagaaatgttggatttaaactacccattagaccaaatgggcctaacagaaaattagagaacatgtcatccaacagctacagaatacagagctagaaaagcaagaacagaccaaaccccaaattagtagaaggaaagaaataataaagagcagagcagaaataaaatagagaccaagaagacaattcaagggatcagtgaaaataaaacttggtccttttgaacttataaacaaaactgatgagtcacttgctagactaacaaagaaaaatgagaaaggacccaaataagtaacatgagaaatgaaaaaagagacattacaaccgataccacagacatacaaaagctcatccaaggctattatgaacaactatacactaacaaagtagaaaacttagaaaaaatgaataaattcctggacacatacaacctaccaagattgaatcaggaagaaatagaaatcctgaacagaccaataacgagtagcaagattgaatacgtgataaatactgtcacaacaaagaaaagcccaggaccagatggcttcactgctgaattctaccaaactttcaaagaagaatgaacagcaattcttctcaaaatattcaaaacagtcgaagagaagaaattctttctaatttgttctataaagccggcatttctctgataacaaaatccaacaaggatgcaattttaaaaaagaaaactacaggacaacatccctgataaacagatgaaaagcctcaacaaaatactagcaaaaaatccaacagaacttcaaaaaataatgcaccatgattaagtgggatttattccagggatgcaaagatggttcaatacatgcaaattagtaaacaagatacatcacatcaacaaaatgaaagactaaaatcatataattatctcaatagatgcaaaaaaatcatttaataaaatttaacattccttcaaaaaactaggcatagaagaaacatatcttaatataataaaggccataaatgacaaacccacagctaacatcatattgaatgggaaaattctgaaaccttttccgcttagaactggaatagacaaagatacctactttcaccactcctattcaacatagtactggaagtcctagcaagagcaataaggcaagagaaagaaataaaaggcatctaaattggaaaggagaacctaagtatttaatacattttggatatttgtacctgcccaaatttcatattgaaatgtaatccccagtgttgaaggtggggcctggtgggaggtgtctggatatgaggttggaaccttcatgaatggtctgctgataagtgagctctcactctgagttcacacaagatattttcatttaagagtgtgtcacctccccctgcccattctctcttgtttcctactgcttttgctattcaatgtgcctattcctccttcaccttctggcatgattgaaagctccctgggccttcaccagaagctgagtagatgccagcaccatactgcctctcaagtccacagaactctgagccaattaaacatctttacaaattacccagtctcagatttttctttatagcaatgcaagaacagcctaatacagtgtccatcatcaaatgaataaagaaaatgtagaatatatatatgtgtatgtgtgtatacatatatcatatatatggtcaaactggactactattaggtcataaaaacaaatgaacttaaatcatttttggcatcgtggacagaactcaaggtcattatgttaagtgaaataagctagatagacaaatttcccatgttttcagtcacatgtgggagctaaaaagttgacctcataaaggtagagagtacaataatagatactagaggctgcaaagggtctgtaagttggggggatgatgaagggagactggtcaatgaatacaagcatacagttagacagaaggaataaattctagtgttcataacagagtagaggtattatagttatcaacaatgtattatatatttcaaagtagctaaaagagagaacttgaaatgctctcaatccatagaaaagataaatactcaaggtgatcaataccccaaatacccttgcttgatcattacacattctatgcatgtaacaaatcttaactctaagtggagctctgaaactgcttttgttttatggcatttaccaaaccttttattttaagttcaggggtatcatgtgcaagtctgttatataggtaaactcgtgtcgtgagggtttgtgcagattatttcatcactcaggtgttaagcctagagccctttaggttttttcctgatcttcttcctcctctcaccctccactctcagttaagatttcatgtttatccttagaatttaaactggtaatatcttactgtcttttcaattcttgtgtgctcttgaacaatttttattttttaaatttattttatttttattctttttatggaaaatttttattgatacatcatattttatatattatacattatgggtacaagtgatattttcttacgtgcaaatttctgactttttggtttgatcttctaaaattgaaaaactgaaatcctgaatgaaaggaaactgagactttattttgttaactttcattttaagttcaggggtaccatgtgcagttttgtacgtagacttgtgtcatgagaacttgtacagattatttcatcactcaggtgtttatcctggcacccattaattatttttcctgatcctctccctcctcccaccccccacccacaagtaggccccagtgtctcctgttcccctctatgtgtccatgtgttctcatcatttagctcccacttataagtgagaacatgtagtatttgttttctattcctgcattagtttgctaaggataatggcctctagctccatccatgtttctgcaaagggcatgatcttgttcattttatggctgcatagtattccatggtgtatatggaccatattttctttattgaatctaccattaatgggcatttaggttgattccaggtctttgctactgtaaatagtgctgcagtaaacatatgcatgcatgtgtctttatgaaagaacaatttatattcctttaggtatatacccaattatggtattgctgggctgaattgtatttctgtttttagctcttttaggaatagccacactgctttccacaatggttgaactaattgacattcccaccaaaagtgtttaagcatttcttcttctctgaaacctcaccagcatctgttattttttcacttttctataatagccattctgactggtgtgagatggtatcttgttgtagttttgatttgcatttctgtaataattagtgatactgcatattttttcatttgcttgttggctgtgtgtatgtcttcttttgaaaagtgtctgttcatgtcctttgcccactttttagtggggctgtcttttttctggtaaatttaagttccttatagatgctggatattagaccattgtcagatacatattttgcaagaattttctttcattctgtaggtcatctatttactctgttgacagtttcttttgcaatgcagaagctctttaatttcattagatcccatttgtcaacttttacttttgttgcaattgcttttggtgttctgtcatgaaatctttgcccattcctatgtccagaatggtaattgcctacgttgggaatgacagaatcttaataacaaatggaagatgttaaaaagccatagataaaagaaagattactttcaaagaggcagtagttagactgtgaggtaacttctcaacagcaataatagaagtcagaagacagtcagtccaatgatacattaagttggctggaaggaaatagacaacaacctaaaattccaaacccaggagaaaatatatttcaagactgacaacaaaatgaacattttttcaggcaaacaaaacaagaactcccccctcaccaaaaggaaacatacaatatgcacatcaagtagaaggaaagcgatccgggatggaagatctaacatgcaaggaggaatgaggaacaaatatcaggtggtaattatgcaaacttgtcattacccttgttctctgtttttcattgtggctgttaagaaatttctattcctttgaagtcaactgtccttattctctggataattttaagacttctctttgccattgttgttctgcagtttagttataatactcttgagtgttgatttctatttatttattttatttgctacacatctggcttcttgaatttgtagattaatgtgtttcaacagttttggaaaagtttctgcaattatcttcttaaaaatgtcctctgaaaatattgtcaacacattattgtgtgatgcatgatcagaaaaagtacatgtatgcagaatatattaagaactattaagtatgtaatacaacaatccaataaaaaatgaacacatgatttgagtagacacttcacaaatgaagatatatgaatactcaatgtgtatatgaaaagtcatcattagtcatcaggaaaattaaaattaaaacacaattaaatacaactacacactcatcaaaatgactaaaattaagaaactaaccacatacagtactagtgagtatacagagtaactagaaccctcatactcagttggaaagaatataaaatattaggaacacatcggaaaacagcttggcagttttttttaattaaataaaaccttccatatggtacagacactccacttcttggcatttacccaaaataaatgaaagcatatgtccataaatacttgtgcggatattcttagaagctttatttgtaacagtgaaaaactggaaacaatccaaatgtctgtccataggtgaataaagaaacaaattggggcatatcaatgcaacaggatattactcagtaataaaaatgatgaactacttatccaaacagcgatattgatgaatctcagaatcatgacacagaatgaaataagccagattgaaaaaaaaaaaaaacctacatactgtatgattccatttttataaagttgtagaaaaaacaaatgaatcaatagtgacagaaatcagataagtggttgattgcaaatagaggaagagggaggactagattacaagaggcatgagaaaacttttggggttttggcaatgtttgatatcttgattgtagtgatagctttatgggtatgtacatgtgtcaaaattcgttattgtatgtcaattatactcaaagacctttttaatagcaaaaaacagaaccagtcgcagaagataaataaagttggggaaaggtaaattatggaattatttggttttactaaattacccatcctcagaaagttaaatgatcaatgaaaacctttcaggcattttggaagcaattattttctgagagtttgacacagtccagatattctgcataccagacaagagatttctcatgaacaatcatttttcaaaacactaggatgtcttaagattctattacttatattcaatctattgacataaaattagaatatctcttctacctcattttgcataaaattgccagtcctttttttgaagcaaagaaaattattgaagcaaagaaaattgtccattatcctagatatccaccatcaattattttttaaatttagttgtctttaaataccgatttataaaaataaatgtgatgtttgtcaattcagtagatcaataaattggaaggctgattatatattcaagcacagttaacatattatttgttttctctttttaataggaagaatgttttaattcaaaaaaagcatcatgtgaaataggtgtagtgcttcttttgagctggtacattttggtaagctataatttggtaattataattcaatgtcttaaacattaaattcaattgttacaatttattaaataatgttcattttcatataaccaatattttaaaataggtttagcttttgtttacatgtgtgatattgtaatacagcaatgatatggtacactgtaaatgttaaaaataaatcatattgcgatgttgtcagatatatatgcacagattacatagttcatgtctctttataatggcagaaaaattataaataaccacactataaatttgaatgcaaaaaggaaattccaatgactttttctctctattattgccttttggaaattcaattaaatgtgttagaatttcttactttgtcatccatgctttgtaaactcgtctccatactttaatctttttgtctgtgttgcatttccagtaatttcccctcatctatcttcaagtttacacattttatttcaggttgtgcctaagttactgttaagtctactctttgagtttttaattctgtttaatgtaattttaatttatagaatatctagttggttgtttgaaatcaatttggttactttttattttttccttttccctctagatgttttcaagacgttcttttatttgtttagaaatataagtgttttgtaatagatgtttagtaattttaatattggaatttggccttgcctgaaaaatctagacaagggcaggtctcaatttttctccctcccctgctcaattgcaaggcaagccttttaggactcagagttgggtgaaagtcagccttacatccaggtcactcttgttctgtgtatattgagctatttggggatcccagcttaatgcagggagagtgttctattagacttcatatctgggttctagaattttatttttgtttccttaacctcttgtggctgtttacatcaaaattcaggttggcaaattacctccaggcaagagcaattctgatggtcagtttacttttctgggttttcactcttccttcagtttttaaccagataattctttgctattttaccagctttttgataattttaacaatatatatttttaaatgtcttcagcaacttatcttttcggtgtaaaaaaaaattatttttggtatggtggtggggaggaaatggcaggctaagctaaacacctggcctgtcactagaggaaattgaaccttgcaatttgtttgaacaatttttaaatgtaacagacacacacacacacacacacacaaacaatttatattgattggcttattttgggtattgatggagtcacttgtgtgatttatctgatacatcaatgaagacagttataaatagaagaataacaattttcaatcagttatttgttgtcaaacatggaacatttgaccatttacaatctgagagtaaaactgcacaagagaaacatccaaggaaattaattctctttttaaggtcatctataaatccagtccccatagcaacacaagtacttatctagattccttcctttacactatatattttgcctagtcatttcttttgcaattaaattaattgcttcattgttaatccaactttcactctctgtcctttcaaaacattttaaaaacaagctgatgaatggaaaagtaaaacattgttgcagagctagttatttataagcaaataaaatcaattgtgtctgaaatgtcaataatgtataaataagcatgtttctaaatttaattgttaacttttataagatgaatggtagcaacaacaatgtgatctgttatttattcttcctgagtcaaactaaatattttacataaatcagccccttctggataatatttacattatactacaaatattgacaatgactagaatttaatattttaaaaatactcatccaaacatacaaatgcagggatgggtggttataactggatcagtagttgtgtcactccaaatcacaaatctcttgttttccctcttgctaatctctactatcctccctctttaacccatggctatgaaaaataacaaaaggagtagttcaaatcttcagatagttctttctggtttccttgtagctatatattttaatttgcctcagacttctccaaatcagtctaaggaaacacaaagtgatataagtactacatagattagatttagatatagaggtataatcttttccccctacagaactccaaacatgctattctccatttaggaatgtaaagcaacccacaatcgtctgaagaaagatacagaactcaagaattcatatagtcaaaagctggacagatctggattcaaatctgattaactgtgagaccttgggcagctgttgaaattctgcatatcagtcagaggttggttagaaaaacagaatatgcttgagatttcaaactgaaagggatgtaatacagagattggaaagttaccaaacctttgggatgagtgataaagcaaggatcagggaagtcattgctagtgttcaaaaaatcagtatgaataagaatcacaggaaactgccacttcagaatataatgacacaaggaagtcattcatcaaatcttacctcagttatctctgcagtccacgtgttcatgccactgactcgggaataatagtggcttctcctcttgcaagcaagcttgttggcagaatatataaagtggcaactttctggtagaaataaattctaaggatataataccctgggttttcaccctctaaaatacaagaaaagagaaatgggaggaatgttgttagatttccaacaaaaaatctagcatattctagataacccagtgtcttcaaataaaaaaatactgtcaagactaaatcaagattgtggactgagcatttgctccaatattccttctgcatcaaatcccttaaagtgagagaaaaggtatatatgcaaacatgcatacatatctattcagatatagatgatatagataaatatatagatgatatagatactgataaagcataacaggacaggaacacagaaattatgaagtctttaaaagataaaaagctgacaaaatcaaattgataacaactatgacaaagtcatatcaaacaagttcaagaccatatcactgcaaagactgaaaacagattctaaattggattgaagtgaaaaagcagaaaagtggcccagaaaatcattagggtaaattaattaaagaactgaagtcaaaaaaatgagaccagacctcatcacccttgtgatatacaatagacagcaagtttttgatgggtttttatccatctgtatttgcaatgctatattatttttttcattatcactttttaaatactttttgtataatttaataaattttgatattatattttgcattatctgagtttcttgtttcagcatcagttaatagaattttttaaatgtgatttaaaaatgtgtggcattgcttttgatagtgattacatagttaaacaaaaacatcttttacctgtcataaagctttagttaaaagctactggggggcagcgtttcacaattcaagcaaaagggatgtgtatgtgtatgtgtatatacatatatagaaatatttttatatattataaattatatataaacatgtatatattctgatacatttatgtacaattttaaaataattcaaattatagtccaaaaataaagtcagaataagcttttttttcttctttttttgagacagagtctcgctctgtcacccaggctggagggcagttgagtgatcttggctcactgctacctccacctcccaggttcaagcaattcttctgcctcagcctcccaagtacctgggataacaagtgcccaccaccacatctggctaattgttctatttttagtagaaatggggtttcgccatgttggccaggctggtcttgaacacctaacctcaagtggtccacccaccttggcctcccaaagtgctgagattacacacttgagccactgcacctggctagaataagctcttaaagaaaattaaagattatataagaatgacacatatacactttagtttgattagctcttaatactatttcaagactatctactgtgatgctggtgtacaattttcttgaatttagatacaaaggggagacataaaaaggggcacagccctaaaggcattagcaaaagatacaagggctctgcttcctggaattgtgttgtataaagtcagaacctcctggaagcaggtgccaagacaggattaatgatgaaatggtgtttattaggagaaatgcttgtgagaaaaaaatggaaaggagccaggaagggctggaaagggcatcaaaccacgatgcaagcttggctttaagtgaaggagagagagggaaggaagtcgggtagaagtgtcctaaattatcatgcatctaagaaacgtttgtcaaagccattggggaatactcagctaaaattcagccgagaggaggcttgtgaaccctcaggaatggaactatattagtattgctgcctggctcagtggttggctgagacgcacatatgggaagcaagggcaaatgcatgatggactcagatgcagaagttgatctctagtcgcttaggttccccgaatttggaggttcgccttatgcattctcatgtccatcacataaagaaagggacagtctgcaacagcaggattgctttctaaagaacgttttctttggggagtactctgaaacctttcttcaaatgatgacgtactctgaagttcaggagataattctgaagtagactttgattttatgcgggagaatgtactctattcccatcatcacagcttgtcccttggcttacataaatattttgctcacgattcaaggaagttgtctaaagcaacttaaatgctaggccaaaataacctgtttgtctctcattaaaaagtttttgttttagaagttttatgggttgaattgtatctcataaaatgatatattacagtcctaatactcagtacctccaaatgtgatattatttgtaaacaaagtctttatggaggttatcaagttaacatgaagtcattagagtgaggactaatccaatatggctgagatccttatcaaaaggagaaattcagtcacagggacagacaggtacagagagaagatgatgtcaagagacaacgggagaatgccacatgaaggtggaggattggagtaatgcatctacaagccaaggtatgccaatgattgctggaaaactaccacaagctaggagagaggtgtttcacagtgggaaggcctatgcaaacctataccaaagaccgagaaagctgagaggctgaagagaaaggctgacacagctactttctcagaaagaaacatttattcatttgttatatatatacatatatattgttttaaatattttcttattttaaacttttaggctcagggctacatgtgcaggtttattatataggcaaattacatgtcatgtcatgggggtttggtgtgcatgctatttcatcacacaggtcataagcataggtagtttttagatcctcactctcctcccactctccaccctcaagtaggccctggcatctgttgttcccttctttgtgttcatgtgcattcaatgtttagctgccacttataggtgagaacatgtagtatttggttttctctttcgtttagctcatttaggatagtggcctccagctctatccacgttctgacaaaggtatgatcttgctcttttatatggctgcatatattccatggtgtatatgtaacacattttctttatccagtctatcattgaaggacatttaggttgattccatgtctttgctactgtgaatagtactgtgatgaacatgcatgtgcatgtgtctttatggtacaataatttatattcctttggttatatacccagtaatgggattgctaggtcaaacggtagttctgtttttagctctttgagaaattgccacactgctacattcccaccagcagtgtataagcattcccttttctctgcaacctcaccaataagtgttattttttgactctttagtaataaccattctgactgatgtgagatggatcttattatggttttgatgtgcatttctctaatgattagagatggtgagcattttttcatatgcttgttggctttgcgtatgtcttcttttgaaaagtgtctgttcatgtcctttgtccattttttaatgggattgtttggtttttgcttgttaatctgttgaagtttcagatgttagacctttgtcagatgcataattagcaaatatttttcccattctgtaggttgtctatttactctgttgatagtttcttttgctatgcagaagctctttagtttaattagatcacatttgtcaattttggggtttgatgcaaatgattttggcaactttatcatgaaatctttgccagggcctatgtccagaatgatgtttcctaggttatcttccagggttttataattttaggttttacatataagtttttactccatcttgagttgatttttgtatactgtttaaggaaagggtccaatttcaatcttctgcatatggctagccagttctcccagctccatttatatactagggagtcctttctccattgcttataattgttggcttcattgaagattagatagttgtagccatacggcctacatgatccatttttgttccatgatctatgtgtctgtttttgtaccagtaccatactgttatggttactgtaaccttgaagtatagtttgaagtgaggtaatgtgatacctcatgttttgtgatttgggttcttttttggtgccatgtaaattttaaaatagttttttcctaattctgcgaagaacgtcgttggtagtttgataggaatagcattgaatctgtaatttgctttggtcagtatggccattttaacaatattgattcttcttatccatgaccatgaaatacttttccatttgtttgtgtcatctctgatttcttgcagcagtattctgtaattcttattgtagagatcttttaccttactggttagctattcctaggtatttttattctttttgtggttattgtgagccagagtgcattctggatttggctctcagcttggatattgttggtgtattgaaatgctactgatttttatacactgattttgtatcttgaaactttgctgaagttgtttatcagatttgggtaaagactatggggttttctaagtatataagcatatagtctgcaaatagagtttgatttcctctcttcctattcagataccttttatttctttctcttgcctggttgctctggctaggacttccagcactatgttgaataggagtagtaacagagggcatccttgtcttgttctgtagaaagaaatattcagtggggtcttacaaacagaagtcatgcctgtgtcttgggtagtatgagacaagatggtggatcagggtttataaatcataagggaggggtaattcagaaggaatacgtaggacagtagaaatctgataacatcaaaattgtttgacttaagggcaagatttacagtaaatacatgctcttacacaagggaatatagataaactggaaatctcagaggcaattctggaataggggttaattagaagccaacatggcagattggcacccaagatgagtttagggttgccctggcctgcacaagaagtgtagggcagattctccttcacagccccagaaggaaccaaccttgtcgacaactcgattttggacttctagcccacagaatcatgaaacaataattttttttgttattataagccacccagtttgtggcactttgctatggcagtcccagaaaattaatacaggaggggctactctcaatgaataaaggaagcaataaaataccttacataatttcatagaatgttagcgctgaaagcagcctcagagcaataacgtcaaaagcttgattcatatctcactagcatgctaaaagaatcacccacgttggccacacaatgaataaatattctagttcttactctagaataatgggcacatccatatacttactagtaacaaattaagtttagtgaacattgatttgcaaattggatatttgtaaactaaaattagagcactattaggatttactgagtcttcttttgaacaattaatctgctacctgcttgataagtctgtacgtgcaggttttgaaattcctgaaatttttagggggagttactactgttaacatgtaataaatcatagtgagttaggatggatatggttttcaattgttgctctccttgcattaatgaatagattaggagaatagttgttacaagttttattttaaaaaaatattgatcactggttctttaatggttagatgttctctctaaatctttttgtaatcactaggttctttttccatggaagactgggagcaaatgggataggtaggtcacaggaccttgtgtcccatctaagcaggttactatttttaaaatttggtaaacaatcccagagtctcacttccacctcttttctaactctttcatttctattagtgaggaaactaaagacccttgtctgtttttgacatgtgaatgaatggttgacttcatcttactatcaaaatatttttttttgttttaataaataattgttgactgatttcaaaacagcagagatttttaaatataaaatattatttgacccaccaagcaataaagtggatactgctattgtctcacttatacagataagaaacctgaagttcagagacatcaaacaagtcacctgaaatcacattgttagaggtaaccaagttaagattttaccattgacaagttttcaaagttcatgtgcttattcgctatgccagtgtgcctcaaatcaggcatccatggacctccaaggtcaattgtctttttctcaagggtctgcaagtctaggttttttttccccctcattttggtaaatgcacagcctgaggtttagctggatgagcacctcgcagttgattactgacaggtgattccagtattcatatttgcattagttttacaaccaagtacacaccaagtgaaggccaaatgaggttggctcttgctgatggatgacaggtttccaacagtttgaacagagaaaaagctgggaggcctgaatcatcccatgacaaatattagtagagtcatgccaattgtaaataatctgcacagtagctatgtctcatgaaagttatcttcaactctaaaaatctataatcctgttggattaccatgccatttagggtcaggcaggaaatggatggcataagaaaggagaagaggacagagaatttaacagacttttacaaaagtgtaagcaaggataaaaaaaaatccaagtgagatggagtagtgcaagtaatggtgagtaatggtgagaagcatggaggggttggagagagagttattgctacaatctggggagagagatagctatgacctttagtagagggacataaccaggctttggggacaataaagagagggagccagaagaaatactaccccgtcctcactcttattcctgtggagcaccaatctcttgctggtgatttccaccttttgaacctaaccagaagccagaggacaaactgcctttgatgtggttcacacaggttagcttccctggggcacacatattgggttagagaatgctgaagagtagacctggtggagcaaatgaagatatccagcctgtttctataaaccaatgatgtattgtcttatcctaataataacattgatgttttattttctggaaagcataaatatttattaatctttattattgaatgagaataagatcctaggcacatctttcttcccacagttgcaagaagataaaatggctctatcaagtttttttatttaaacaaaagagtctgaaattttatgtctcccttaaattaacaaataatattctcattcatttgcatttcagttttttgattggaacatcaggaggctgagttaaaattagagtaggcacttgtacgtaaaagtgtatcttccttgttaactgtttcaaaataaaaggctgaaaattgctattagatgacaaatgatttcacaatgacctcaataaaaagtccttaactctgttttaaaaattaaattgctcaaatggaatggagtgaggaaagccatactttaaaagtaattattgaggaaaagacctagtagtttcaatgaacacaaaacttgctatgagacaaaatatgacacaactgattaaaaaattcaatgcaatcctaggccaaagaaaggttaaggaacttcagatcaagggaatcaataattctatgaggctttgcacattcagtgacacctagaatgttgaaacccagatagagggatattggcaaaatgataaccaggtgataacggatttcaaaactaagttatgaaaacaatttagagacactagaggtataaagcctagagaagatttaagaaaggtttgatatagcaaaaatcttaagctttatggcagaggaattagactggctccatgtggctgcagatggccagattaggagggttggctataactggcaggtaaaaagacttggactcaacacgggaaagaatttatgggaaactagagatgtccatgggtagaaagctgtgtctcttgaaggagaaggctgaagaggagagtgaaccttaacagtattgaaagatatgtaaaatgaagtcatggttggattgaatgatttctaaggctctgtgctctgtgatttgatgacaagagaagatattgaagctgatgccagattggagtaactagcatggaggaagaataaattaatgagtttttgattttaaaaaataaataaaaaagaattgagaacactaaccaggaatatatctaatggtgcaaaaaagagaaataaatagggaaagggtggaaaagtccacaaagatagtagaagagaaactgtattctgaagaacagggaaagtataggaagtataggaaggaaaatatatattgtactactgagggggttatttgtctgaaaaagtactcaaaacaattatttataatgttcactttatcacttacatgttatagtttctgacagcagacaaacgccatagagaaggtgatgttttttctatatttttatgccaccatacttgaaacagcatccagaagtaaaaagaaagcagaaaaaaaaaatgcttttttttgtctcagaaacactggatgactatacatataaactgtcaaagacctaattaaggacattagaaagcatatttttaagcagaacatttcaggttttcagcatctttatatctccaaatgtgtaacagctgttatgttataaaacctattcaataactgaaacatcactcttcctcagtaatttttggtgtcactttaaattgtaatgaattcagaaattattgaccaatagtcaattattttgttatatatatgatgaacaatatgaatttaatatcaaataaaaattaaaatttgcaagaaaaataaacaatgtagaattagattaaaattagaccccatattggaaattgtaaagcatatttaaaaataatgagcattaaagttggttctttcatcttccaggatatgatctgagaggttggcatttcttccttggtccttgagataaaaggattctcaaccagaaaactaaaggataagcaagaaaagagatctttgggcatctgtgacaagattctttacccatctttggaaacttataaagaaaatattagaacaaagaagaatgaggaaggcacaaaacagttccagaacttctaagcaaccaaaagtaactgaaaagtcaactgaaaatagtagtagctattttttctcatattgtaagaatccagttagctcagaccaaaggaaactccttttaaatttagagcccacagttgaaacctgtgaggtcaaccaactgaaagtaaatacatgattaaataagaatttccacagttggaattgtgtgcaaagatgaatttgacatagtacctttcaaaagggcctttaagacagaaaagcaacacaaactctccttacagggttgatgacagttagacagaaactgtatgaaactcagcacaatgagaaaagttcattaaaggaaaatcgagaaaatgattagtgttgactgtgagccttgaataatgggcagaattatatccagtggaaatagtagaaagagatagaagaggttttttaaaaaataaaggcacacagcttgaaacgccttgtacgcagaccagcctcttcctcagcaccccagggagcctcctgatacccctagccatgcttttggatctaatatccctaaatggatattccagtaacattgattgagcttgatttaacttgtttccaaagaaaacatgagaaatttccttaggccagctgactaaacaagaaaatgtttcttctactgaatatttaaggccacaggaaggtagaagagtactaaggtctgagttgccaatatgctattgatacatgtttcaaggatcaaggcatagaaagaagggccacaactctgctgggaatgtagcctgagcaaataattaaatagatcaaaattattctaagtgggaaaattcggagtgacaaaataaagaggttcactgaaacaaaggaaactatgtcactgaaacaatgaaaaaaaaaaaaagacaaatatatcatccgcctccttccacacaaacgtctcaggctccagccaattgtactgaaatacactcatttagtcaaacaggatatgcaaaccattagcaatcaatcaaagaggttggctgtgacaagtctctggcccacaaagccagacttcaaattggaaatttttgttccctcaaatacaatgagttcccaaaaccagacgcctgtgggaggtgacttaggagtactttttacagcttaaaccttagctctagcccaaaggctaatacagatgtggttgtagttcattccttattaaagtcttcaaatatactatcttatttagggagaataagctactgatccagttccaggagaacatgaaatttaaggtggttttcacccagaattaaccattattgtacaaagcaaatcacctacatcaccaggacccttctgtagattttactaggttgttgggacatgactatccactggttatgtgagtggcctgaaaccatggctaattattgagtgcacacagtattccaggtgctgtgctaaggactttatatgtactatgtcatttaatattctccagccactgatgtaatcttgatgatattctatagatgagaaaactgagacttaagagtggctaagcaacctgggaattcacatagttgctaaattggagcttacatggagcttacatcctagtaggggaattcagacaactaatatgcaagtaaatgtgaaatatgttagatagtaataaatgctaaggagaaatgaagcagagaaagagggatggaaggaggactgtctctattttttatagggtagtcactattaagataatgcattagtaggtatgacgacaagccttgcagatatctggggaaatatcattgtagacaaaagcaaaggaaaatgcagaggctctgaggggggaatatggctgatgtgttgagacagagcaaagaagctcatgtagctggagcagagtaagcaagaaagaaaggctaagagaggagtttagagctgaaacaaggcctagatgatgcaagaccttgtaaattacaggagaaaatttgtgttttactgtgaataactagtgagaacattgaaggctcttgagcaaagaaatagtatgatctgactcaggctgttatgttagtaatagattacaatgaagacacaggaggaacagagaggaggctgttgtaatctaggggagaaatgatgatggctgctatgatctgaatgcttgtgtccccctaatattcatttattgaaaccaaacctaacccccaatgtgatgatactaggaggtggggcctttgggagataactaggctgtgagagtggagccctcatgaacaggggatttgtcccttgtaaaagaggaacaagggaggttgttttccctttccaccaccggaggactcagagaagaagacgccatctaccaagcagggagcaggccctcctcaccagacactgaatctgaaaacacttgaatcctggacttcccagccttcagaactgtgagaaatttctgttgtttataagccatgcagtttttggtaatgtattgtagcagcttgaacagactaaaacagtggcatagactaaggtaggagcagcagggatggtgacagtgggtcaattctagatacgttatgaaggtagaaaggaaaaggtgtgatggttgctcagaagtcaagtgtgatgaaaactaggctggaggctgactttaaggtttctgactgaacaataggaaggatttattggcatgcaaagttcaggacaggaggaggtaggaggcagttggaaattaggagtttgattttgggcatgataaatttgtgcagtctctctaagttgattaggcaaatggatataaggttttagcatttaggtaagcatatgaattaaagatatacattttggaatcatatgtgcatagataaataatatataaagtcatatgtctggatgagatcacttttggagtgaatgcaaattaagtaaatagatctgagaactcaattcattggcctaagattggcaataatatgtttatcactaggcccatctcatcagatatatgactaccacttcccataatgtacttgaaacttctctacccacctggaaaactcacagactagctctcaactatgctttgcctatgagaatcctcacctaacatttaaaaatgttgagacacatgcacacacacacacaacatccttctgttgagaactgttagagattatctcactgattctgtattttggcaaggtcagggcaatgaggaagaatcactgaaggatactgaaaaggagcagtgaattcagagaactaagagagtatgtgccaggagccaacaggtaaaagtgttcaaaaatgagagaatgaaccattgtatcaaatattcccgatgcactgataagaaaaagataaagaaaatctgattggaatgcatccaggagagaatgggaagagaagaacaaaagataaaagagtcaaaatgactgctccagtttatactcccactagcagcctttaagtgatttcttacgattcatagcaaaagaaaaaaccctccctctaaggcatccctgcatatggtgccactgaaaaatgtctacatatccttgacttctgacttatacacacccattctgcctagagcacagcttcaacttgaaataatgtcctgttttcttcctattcttcagccattaattacatgcacccaattactccctagcagtaatcaaatccctctaagtcatttatcttacaagagttaccccctttgtgtatgctgattaattttatgtttaacaatgtgaagctgcttcactctgagattatctagattgaaacattacctactgcatttttcagtcttgcttagttagacacagttatatcaatccaatcatactcatttgttgaaaatgagggtatattattttctctattttcacagtgaatcacaattcttgatgaacatattcctggcaaggcacaattctaaagcctatttgaatgcctaatagcattttaatctgttagatggttgattctttcagtagcaatgaaaacctttcgtaatgtcaagaggaatacattgattttaaaaaatcgttttagccctcatttccctcaaaactttatgcctgttggggatatgttttcctattcccataggaattaataactaggaccagatctcaattgtttaatcatgactttgttttgcaaaagaggaaactgaggtccgaattttgtgtgtatcaagacatgtacaatggtgggtaattctgtgactccggaggcaaactgcatgcattagaactctgcctccattctccttagctgtatcacttggatcaagtacttctcatccattgaatgggcacagaaatgatgcttagcttatagagttgctgtgaaattgagtgaaatgatgcaaagcttttcatatggtgattggaacataataagcatgcaataaatatagtctcttcttacatactacacagaaaagcagaatctgctgggcgcaatggctcatgcctgtaatcccagcactttgggaggccgaggcgggcggatcacgaggtcaggagatcgagaccatcctggctaacatggtgaaaccccgtctctactaaaaatacaaaaaattagccgagcatggtgggggtcacctgtagtcccagctacttgggaggctgaggcaggagaatggcgtgaacctgggaggagtagcttgcagtgagccgagatcgcaccactgcactccagcctgggcgacagaacgagactctgtctcaaaaaaaaaaaaaaaaaaaaagaaaagcagaatctatttaccagactttgctcctctttcctctgagccaggacatcttttaaacctgacacaatagcaaagcttgtgccatgttggtcaaatcatattagaaggggaaactagaaatgagaatgtgcatgaactctgtgcttaatctagtaataatttcattttaaccagagaaacgtttctttcatcccaggtcatttactcattcagcgtcactagtgggaccttcacaaggcaaatgcgccagtgagttgcactctaacaaggtacacagctgctaggaagggagcagccaaacctgccatcactgactgcagtgttcctactggacataggcggcattgggaacatactggcaatgtggcagggtaaagggttgggtgaagggtgagagcttgaagactcagacttttctaatgaggccagcagcctcacctctggccactttacagcacaccttcctcctgggaattcttccctagagcaatccacagacttgctttcgcaaagcttgaactgttcttttttttttttgacagagtctcactctgtcgccaggctggagtgcagcagtgcaatctcggctcactgcaacctccgcctcccgggttcaagcaattctcctgcctcagcctcccgagtagctgggattacaggcgtatgccaccatgcccagctaatttttgtattattagtagagacagggtttcaccatgttggccagggtggtctcgatctcttgaccttgtgatccacccacctcggcctcccaaagtactgggattacaggcatgagccaccatgcccggccttagctatttttaattcacaaaagcacttcctttggggtggtatgccagccagatctgcaagactatactgtaaatacttgttttagcctagttttatttcatttatttttagctgcttcatctttcactttttatatggaaaggaggaagtgccggaacaagggaaatggtttagagcagagttcttgacataaatatagaatacaaaatgtcttttatttctccagttatctctgcatgggtcatttctatctgagaacacagatgttccagacttaactttaatggaatcctaaactgagaaaaaaagaaacaaagcagaaaagcagaaagcagaaaacagaaagcagaaagccatccatttccaaaacatgttcccttgaaagggctgtggagcactgcctcagcacagatacacctctgagaaatcctacagatgaaactcattttgacattttctaagcaatttttaattgacttaatttttttagaacagtttcagatttacaaagtgagaagacaatacagagaatccccaaatactcccagtttcccccattattgacatcttatattagtactggcaaactcgctcctcaaccagtcaggctcctctaagtcctcttctcaactaggctttgaccttgaacttaaatgtctgtccttgtttggcctgtattgtccagttttagcaggaatcctgttaagtcagtttagaaagaatcctccacttttgatgtctgatcattcctaatatctggccaaatttcttatcccccacctttagcaaatgatcaccctggtatgctttcatcaagaacctgtaagatcagtttagcgagaatatctccttactgctgatgtctcctcttagtaagccaccctgctcctgggctacgaatccccacttgtccatgtcgtatggcatggagtaagccagttttatactgagggctctttctcctattgcaagggttagcactttaactattgtccaactctactttaatataacagtgtggtgtatttattataattaatgaacaaatgttggtaccttattattaactaaaatcatttacaactttattcagattttattcatttttacctaatgcccccttcctattccaggatcccattcaggatactacattagacttagttgtcatcctcattagtttactcttggctgtgacaattttccccactttgtttttaattgcattgacagttttgagaaatactagtcaggtatcttgcagaatgtctccctaccctcccactccctcattgaaattgcctgatatttctcttattattcaaataggattaccagttttggggaggaagatcacaaagtgacatttttatcacagtaaatcaatggcacatgctatcaacatgaataactattgatgttaacttgatcacctggctgaggtagtgtttgctttgtttctccactatagttactcatgtgttctccctttccatactgtactctttgagaggaaatcactatgtacagtcagcagttaaagagtgcaaattatgcaccatctccttaaaagcagagaatctatataatttatttgaaattcttctgcatgggagatgtttctattttcctctaatttattttattctatcatttacttatcttagtatggactcatggattcttacttgatactttaagttataatccaatatttatttattttcttgctcacagtttttcatctttggcctttggaaactttcagttgtcatctatatcatttgacatacatctatcagtgtggatttttgttttgttttgtttttggggaatttctttactttgtggcactactagatactctgcgctcatcttatataatttctgccccagtcttagaatcaaccctttctctagggagctctttttttacttggagaatgatattagaaaccaaaatctgagacatatggaactaaacagagagcaccaaaataaatgcacacatatgtggtcaactcatctttaacaagggcatcaataatatacagttgtgaaaggatagtttctccagcaaacagtgttgggaaaactggatatccatatgcagaaggatgaaattggacccttatcttaaaccataaaaatacaaactcaaaacagaccaaagatctaaataaatccataattcaaactgtaaaattttggggaaaaaaataggaaaaatgctttatgacattagtcttggcaatgatctcttggatatgataccaaaagcacaaacaacaaaggtaaaaataaacaaatgggattattttaaacaaaaaagcttctgcacagaagaattaatcaacagaatgaaaaagcaacctacataatgggagaaaatatttgcaaactatatacctaaaaaggatttaacaaccaaaatacataaggaactcctacaactgaatatcaaaaaataaaataaaataattcatcaattaaaaaataggcagaggataaaaccaaaaatatactgattaaaaaacaggccaaggacttcaatagccttttctctaaagacaaacaagtggtcactaaatatacaaaaagatgctcaacatcactaatcaagaaaagacaaattaagaccagaatgagacatcacctcacttctgctaggatggctattacaaaaaaaaaaaaaaaaaaaagtgttggtgagaatgtaaagcaaaggaaatcttttcacactcttcgtagcaatgtaaagtggtacactgttatggaaaacagtatgaaggttcttgaaaaaactgaaaatagaaccgccatatgatctagcttatgagtatatatccaaaagaattgaagttagtatgtcaaagagatacctgcattcccatatttactgcagcattattcacaatagccaagatatgaaaacaacctaaatgtccattgacagatgaataaagaatggacagattagatagatagatagatagatacatagatatatagatagatagatacatagatacatagatagatacatagatggatatgatagatgatagatagatagatagatagatagatagatagatagatagatagatagatagataaatgatagatagatagagcaacactatttagccttaaaaaataagggaatcctatcatatgcgacaacatggatgaacctggaggacattatgcaaagtgaaataagcagttacagagggacaaatgtgcataattccacttatgggaggtacctaaaatagtcaaactcgtagaaacggaaaatagaatagtagttgccagggactgggggcagggagaaattgagagttactgtttaatgggtgaaaagatctggtgcacaacattgtacgtagagttaacaataccatattgtgcactaggtgtactcattggtactggagtgtcagttcttctaggaccactcagctgacaaagcaagtaaatatatgtgtgtattctaatttgcgtctgtgcctatctctatatgcaataagttgcatctacattaactaaacatcacttcatactagatgtctcccactccaaactagtaacacatggctcattctagctttcttcccttgcttgtctaaactcccactctaacagtgagaaaacagactgccaccattcaccatttgtattagtttcctattgctgctataacaagttaccacaaacttggtggtttaaaacagcaaaaacttttggtctcacagatctggaggtcagaagtccaaaatctgtttcactgggccaaaatcaaaacatctgcctggacacactcactcaggaggctctaagggagaacctgctccttgccttttccagctttgggtggtggccactattacttggcttttggttacatcactccaattctgcttccgtggtcacactgccttttcttcatctgtatgtaatctgtctctccttctctcttataagtatacccacaattattacgttggtcttccctggataatccaggataatctcctcatcgcaatatccttaacttgatcacacctgcaaacagactttttccaaataaggtcacacttacagtattaagtattaaggtctgatatctttgggggccattgttcagcctactgtaccattcatttatttaattattaattttcactgtacatgtgtcagtgacaaacaaagccagaaactaattaagtttttaagacagatttatttaagacagatttattcagtcataactactgcaataaggaagagagtccagcatgaattgaactcaacttcgatttgtgcagaggtgattggccattttaaagggaataaccgagggaatagggagggaaaaaaagcagggctcccacagaatccatggaacagaaattttttaaaagcaggaatgaggggttggtcaatgtgattacgccatgtgggtttgctaactggcccttattaaagttaggcttctgccttctcactgagattggtcttatctttaagtactggatgaaacagtaaattgttttgacagccttgatctttcccagacaagaactaaatggggccaaagtcattatcctagggacacaaacttgacctattagaaactatgctagtgtttgtttacatctcttagtaggggagaagaaggaggtggattaagtaatttgagctgaaagtctgcagattttataggcctagttgagaagagagctctgaggagcttgagtaaaatgtgattaaggagagagtctttgtcatgtatataatagcactggaaatgttaacctgtaccctcgtgggaaacaactttactaactagagctacattgcatatgcttattttttacttggttttacagattctatcatttccaaaattagttaggtgtatcttttccctttcaccaccttcagtaaggttgtttcatatatttgttatagttaatttcccttgttacagtctgcattttcatctaagattctcagtctcctaaatgatttttgcttagttgaatacattaagtttcactctttgggctataaggttctattggttttgagtgatgtatactgtgatacatttatcattacattataacacagcacagtttcatcacagtaaaaaatgccttgtgcttcaccataactctccaccacttccctgacctcctggcaaccatctctagattccattactatttttagagttttttcttttccagaaactcatataattagaataatatagtaaatataatatgtagccttttcagactcactacttgacttagatacaggaatttaagtgctttccatatctaatgtggtttggctgtgtctccacccaaatctcaccttgaattataataatccatacacatcaagggcagggtcaagtggagataattgaatcatggaggtggttttcctcatactgttctggtggtagtgaataagtcttacaagatatgatggttttataaatgggagttctcctgcacaagctctcttgcctgctgccatgtaagatgtgactttgctcctcattcatcttcagccatgattgtgaggcctccccagccatgtggaactctgagtcaactaaacctctttcctttataagttaaccagtcttgggtatgtctttattgggagcatgagaacagactaatacaatgccttttcttagcttagtagctgatttattttttcactgaataaaatttcactgtatggatctactcccattttttaatagagtcatctattgaagcacatcttggttgcttccaattttggtgaccatgaataaagcaactataaatatgtgtaggtttttgtgcatatatacattttcaagccaggaatgtaagtgctggatggtgtggtaggtttatgtttagctttgtaagaaaatgccaaaatgtcttccaaagtggctgtgccattttctattctcatcaatgaaaataagagttcctgttcctctgcaccctccccagcaactattactctcgggttttttcattttcgtttgttcagattgtattttagccattctaataggtgggtagtggtatatatgattgttgttttaatttgagatttcagtaatgaatcttttcacttgccatctgtatattttctttagtcaggcgtctgttggatcttttggcaatttttttaattggataatttgttttcttatttttgagttttaagagttctttgtatattttggatacaaattctttatcagatatgcattttaaaatattttcttctaatctgtagcctgtgctttattctcataacagtgtccttcacagagaagaagttcttcattttaatgaagtttgacttactaattttatcctttatggattacacttctggtgttgtatctaaaaactcatggccaaacccaagattacctagatttttgcctatgttatcttctagaagttttatagtttctcaattaatatttgggctggtgatcattttgagttactttttggaaaggagtaaggcccgtgtctagattctactttttgcatgtagatgtccagttgttccagtaccattttttaaaagactttcctttattgaattgcctttgctcttttattgaaaaccagtttactatattttgtgaatcaatttctgggcttcctactctgtttatttacccatgcgattcttttaccaataccacactgtcttgattactatagcttgaatgtaagtcttgaaactgggtagtgtgagtcctcaaatttcatttttcttcttcagtattgtgttggctattctagatcatgtgactttccacacaaatttttgaatcagtgtgtcaatgtctacaaagtagcttgctgaaattttcattaaaattttattaaatctatatatcaagttggaaataattgatatcttaatgatagaatcttccaatccataaaaacagaataactcaccattaatttaaatctttatttctttcatcagtcataattttctgcatgtttttttagatttatagctaagtatttcttttttgttgttgctttcataaatggtattttaaatttgtaaatccagttgtttatcactgttatataggaaagcaactaacttttccatattgaaaaaagctcaacatcactgataattagagaaatgcaaatcaaaaccacaatgagatgccatctaacaacagtcagaatggctttgtttgtttgttttgagagagagtctcactgtgttgcccacactggaatgcagtggtgcaatcttggctcacagcaacctccgcctcccaggttcaagcgattctcctgcctcagactcccaagtagctgggactacaggtgcccgccaccacatctggctgattttttttttgtatttttagtagagatggggtttcactatgttggccaggctgctccagaatggctattattaaaacataacaaaataagagataatggcaaggttgtggagaaaaaggaaaaactatacactgttggtgggagtgtaaattagttacatcattgtggaatacagtgtggtgattcttcaaagacctaaagacagaaatatcatttgaacgagcaatcccattactgggtatatacccaaaggagtataaatcattctattataaagccacatgcaggcatatgttcattgcagcactattcacaattgaaagacatggaatcaacctaaatgaccattgatgatagacttaataaagaaaatgtggtatgcatacactgtggaataccatgcagccataaaaaagaatgcaatgatgtcctttgcagggacatagatagagctggaggccattatccttaacaaactaacacaggaacagaaaatgaaatgctgtatgttttcacttataagtgggagctaactgttgagaacacaaggacacatacaagggaacaacacacactagtgccttttggagtgtgaagggtgaaaggagggagaggatcaggaaacataaccaatgggtactaggcttaataactgggtgatgaaataatctgtacaaaaatcacacttaactcaagtttacctatataacaaacctgcatttgtacccctgaacttaaaagttaaaaaaataaccttttgcatattaaccttgtaacctgtggccttgctaatctcacttaatttttccggcttttgtttgtttccttgggctttctacgcaggcaatcatgtcttctgtaataaaagagaattttattttttccttcccaatatgtatatttttctttctttttgttgtcttattattctagttagcacttccagcgcaatttaaataagaatggtgggaggaaacatcctgtcttgttcccacttgtagggggaaagcatccaatttctcaccactaagtatgatgttagctgtaggactttggtagatcatcttctctttttaaattttgttttccaaatttatttgatcatgagaccctttgtttaaagtacatttattcatactttaatgaataatagtgttccataaaacaggaaaaactttattatagtaatacttgttcaggagtaacagatcaaatatgtcctcaaagaaaaatgatattaatcctagggaaacatgaggaaaaacactggaatgatgtgaccacctggttgccaaaacaatttgagctggtacataaatatcaggtgtttaatacccatggtttctaacctttatgttcacttcgttcattcattcataaaattttttgttgttgttgtcaggattaatgtgagctacagggttacaaagataataaggcataattattgcggtggaggaatgcacagtctagtggagaaatggaaattgattagtacctaagcagtcgactcccttgtatgaaaaaatataagcacctgaaaatgtcttcccagggaggacttttcaggataagcatctctatgagtctaatgcaagaatcacttagcttttactggggctttttttggtcaaaaaaattttagacatagaaaaaacatttttaaaaaataaatcacccatcatctaccacttaagaaataaaagatgatgaacgtttttgaagcccatgtgtacaccctacaaatgtattcaaattcctctccctcactgcaggtaactattatttgagttaggtattaatcttttccatgaatgtctctatactatactacatgaccatgtattcctaaataatatatagtattttggcacaatttttagattgtatataaatgataccataatggataaagccttctacaacttgttttcttcactctatatttgcaacatccatattgaaaatagttctaacttattgtccccactgaataaagttctgctgtattaatatagcacaataaatgaaaataaatccattctcccctggatgacatttaggctgtttccacttcactgatatttcaaaaaacacgtcatgaacattattacacatgcctcctgggcatatgtgccagcgtttcactcaggtatatgcctagaagcagaactgctgcctggaaggggacatgtaaatttatctttactaatttttgtcaaattgctctccagagtggttgcttggtttttatttctattagcattggacaagttctcatttcttcatgtttttgccaacactttgccaactcaatagctgcaaagtgctacatgttgtggtccttgttattagagaagttgagcatattttcatgtatgtgtaagccacgtagttttcctcttctgtgaacgtccagttcataatcattgccagtttctcctttggggttatttatccaactatcctagatgctaattaatactttgataaatagactgcagatacgtttcccagtctatacttaactttttgctttgcttatttgtatgttttgatacagataagcatttaatattatttcatcaaatgcattactcttttcctctgtggtttattcttgtcttggttaaaaaatcctttttggcacatagttcataaagatgtaaaataattactatttaaatataaccttatatttaaatataatctcatatttaaagctgttaaatgatgttttcaaatttaggttttatttcacctgaaatggatttttttgggtatggcttattttgagctataattatattttattctagggactaacttattttctccaggcactttattaagatgcctattttatcctaactgattttccaaaaagaactatgtcatattgtcatatatcaatttttcatgtatgtgtatatttattttggctttaaaagatgcaaaaaaattatttattaagtgacaattttatagctgtccttttgtggctttgcaatttttaaaaatccaaataacattatcattctccttttattcttatcaagaaaaatatgaacaaatgggtgagtgccaacatgaattgccccagaaattccccaaggccaggaaacttactttacttctttactaatctctatatttttgtaaggaaatgttctatgtttcaagaatttcttcacatacccagacagaaaatatcagtatgcgtgtatcagtctcagttcactcagggaaacagagtcactgtgacacagaataagggggttagtatagtgattatgacttacccagatttgagtgttgctaagggagtgaaggtcttagaaggaactgaagctctggcacaggtgaaaagccagagcttatggaaaagcatatgaaattccatgcatttggctaccaaagtgagaatgcagtgtgtggggttataaagaggtcagcaaagctgccatgtctgtcaaagccactgagtctgacctcgaccccatctgactgccatgacctactgagaataatgatgcctgctttacttctgcctcccaaatctcatatctctctctccaattgaaggagatatggggaagcatagtctctagcatcaaacaagaagagtgcttggtgctggtgacaatccagaaaaatgggcacaagtcacctttgcagagtggtcattagtataaaacatttcattcttctacaaatacaaccaactcaacatatattttttgccagaaagtttaccacaaataagaccttttgatttaccttatttcacaaaatgtgctcagtctcaagatatcattaacaataccaataaagaatgtaaagtatacagaaataaccccaataataaatgcataaaacgtttcagagaaaatgttctaactatattaaaggacataaaagaaaatttgaataaattgggcattatgccatgtttatgcatgggatagttaatatgggatagaggtcaattctctcccaaattaatctgtcagttcaacacaatagtaatagaaagtacagctggaggcatttaaaaactcattctaaagtttatatagaagaaaagccaaagtatagctaagtcaggccaggtgcggtggttcttgcctataataccaggactttgggaggctgaggtgggcagatagcttgagctcaggattttgagaccagcctgggcaagatggtgaaaccccatctctactaaaaagtacaaaaattagccagacgtggtggtgcacatctgtagtcccagctactcaggagtctgaggtgggaggatcacttgagcctgggaggcagaggttgcagtgagcagagatcacaccactgcactccagcctgggcgacagagcaagactatgtctcaaaaaaaaaaaaaaaagtatagttaagtcaactttgaaaaagtagactaagacaaggaactaaccctactagaaattaacatatattactaaactatagcaattctaaaaagagatatgataccaatacagaaacagaaaatggatttagactaataggttaataaaatgcaatagaagaaatagaaataatccctgcacatatgaaaactttgatatatgataaagatagtcccacaaagcaatgatgaaggaatggattgttcagtcgacaatgttatgaaaaagtagatatgaagaaaaatagagctggacttttacattttaacagcacaccaagtgagaaataaatgaattaaaaaccaaacgtaaatatcaaaccaccaaaaaacagaagaacatgtaaaataacatatttttgatcaaatttgtaggtaaacattctaaaataattattcaaaaggctataagttttaaaaatggatttgactacattaaaaccaaagatttcctaaagtacataataaaataatgggtagattggaagacttggagaagatattcgcaacctttaaaactaataagaaaataatatttaattataaaaatagatctcttgacaataaagaaaaagtaaacacaatagaaaactataagaagctcacctgactaacaaggccagaaaaagatgctcaaaacacaattagtagaaaaaatgctagttaagtcaacaatgaaaaaatcaatgtgtatttattggaatggcaaaaatcaggaagatgtgtaatatctaatgttgggaagccatggacttgaacactggtgcactgcaaatgggaacaataattaactgatcctgctgggccagaaagaagtatgccagtgttcagaaaaattaagtatatgtatgacttatacttaagtataagtatacttaagtataagtataagtatgacttatacttaagtatatgtataagtgggactcggtgatcccactgctgaatatccatctcccaggaaagttctctcagagattcataagggcatacactcaagcatgttcattgtgacattgtttatggtgatggaaataaagggtatgttcaatatttatttttagggtgaaagatttgtaaaatggaattgtatgccatggagtactatgcagctctaacaagcaacaaagtagatgcatatacaataatgttgacagatcttaaaaacattgtaagaagtgagcagagtgtgatttatagtgcaaaattatgtaaattaagaaaaaatcaataccatatattttacaagaatatatatttaagaatacataaatataaatacatatatgtaagaatataaagcaaacacattagatagaaaaaataaaaagtcataaaactttgcatgaatccattatgataatgtgatatgtactgaagactattatgagttccattatctgccccaatatcaatagttaaaaaaaaagaaaaaaaaattttttttttttgagacagagtttcacactgtcacccaggctggagtgcaatgggcaatctcagctcactgcaacctctgcctcctgggttcaagcgattttcctgcctcagcctccccactagctgggattacaggcacctgccaccacaccaagctaatttctgtatttttagtagagatggggttttgccatgttggtcaggctggtcttgaactcctgacttcaggtgatccacccaatttgggtgctgggattacaggtgtgagcccctgtgcccagccaaaaaaaaaaaaaaaatttaaagtgcgtacatataccttaatcctgtgggttctctgggacatactacacaatgacaaataccttctggtgcaaggttagagaccagaacacatgattggatctaatctaataatatttctctcatgttggatttgatttattatttacaacagaccaagattttagagaattaatttccccatattcaagtttataggctgctttaatccagttatagttctttgtagcataacagaggcaaagatggatttgctaatccagcataattgaacagtactgcttagcagagttcaataaaggctgtctcctgtgagatacacaacactattcatccccctatggatgagattatctaataaaacataattgatatgtgcctacttttattctgatgtttggtcatatcctgacaatatttttcttctttcctggtctattgtatccagtgactgactgctgaaggtctgaatgatgaaattagtcattggtgccatcttaaagaaactcatcactgacttctccctatcagtccttcttactcacttctagtagggaaaacccaggcagaaaaaaaaatggcagagactggttgtacaactgacttacaaagttaaattttctttaatgtttttgtgttcaatgaagacagtctcttcaaaaactaattgccactaaaacttaaagaaaataatattggctcagccaaaagaaaaaaaaatagtcatgaaagttccattctatcactcaccagtcagaagacaactggaagaacttctctcagttcttgaagtccattttttaaaacaatttatgcaaagtgctatctatacaaacaaaaatgaacatgatggtattgagaatggaaaccaaatcagagctaaggcattggtaccggggaagaagacttctaatatttaggagtgaacagttttaaaatgcaggtgtttgggttctgcccctaccagggtctccaaaggtctgtcccatttacaaatctcacatgttctctaataaaaatgggtttgtttcagtcttcatggtagattgcaaggaagatttagttatcagattagatgctgtactgacaccttatggacccctgcagctttgactttcagggcatctggggaaatgtttttaatgggtaaagggaaatgaagatattctcttcagtgaaaggcatacgcactgagttttcaaattaccgctttcttgtggttccaggtggaattaaataaaaaggagttttcaccatcattctggatcattttattgctagcttgactctattggacacatattactaagactttaatatctgcaaaaacccaagaacacaatatcagaatgagtcactatttgtttatggcagaggctgctgctgaaagccccaatcagaagtggtattttcaaagcgggggctgtggttgaaaaatgttcagagtgtctatctgaaattgtttgattcccctgccccccttttttttaaatgagctgagagactgtctacagcaccttgagattgaagcttaagtactgcaatcactccaagtgagtgatccatgcttttgtatcaaaaacatgaatacaactatatgcctgatgaaaagatcatgccattttccaactggtttattcatactgaatacatatgagatggaaaacaagatttatgttagtgacaaaaccacagagagacaagagaagtgctatttctggatacctctcaagaagaggttgctctgaaacgcaaagtctctttgcacagccattaccaaagacagaagctctgagggcatttttcaaaccaggagggagagcaagggtcccaggcactgttaacctgaagcccagtggaacttatgggtctagcttgcagggtcctttcatctatgccaaaccatttgcagggctcgcttttaatctggcacccctctaaatgtatttaattaattgtcaaggttgaaagtatccaatatgtcagtttttatgagcagtcaaccaaggaagcagctcttggtttctttatatgtgccaggcagcaactcagcaacggtggtctccatcattttgctaatagaacacttctatttctaaaataataaataagtatctaaaacatagaaaccagtaggcctttacttatgcattcatctgtgggaagaagtaaggcagcaggaacagagaattccccattcaggtactgcccaagccagaaaatgtttctgtttttcttggttgtgtaatggaacagtggttctctttagaagtagtattaccctctagggaacattttagaaatctgtaggggagattttctttttaattgtcaccatgattaagaaaccctaaaagtgtttataagtctggatctgcaatgagttggagagtctcacacattgaagaattacagcctgctcaaatttttaatgtttcatagggatttcttatggttgtgaaaagcttaataataacccaagccaagaaacatattgcattatatgcataaaaacaaagtatattttatatcgttttaatatatattgaaattttttggaattcaactaccacgaaaataaaaggaagagagttctttaaatggttttgttcagagccttgcagtaattctgtttcagaaaatcatgacaaggacagcaactctcttcctggtatcattctgaatgacacctgtcatatccaaaatggctctatctttaattatacacatctgactacttcatttatgcattgtaatacatgtttgatgttaaattattttatgtctccttaggttacagtttgggcatcacgttgtttggggatagaattattttgtcaggtgaatgtattgcaaatattttctccaaattttgggcttatctttttcttttaaaaaaaatttttctatgctatctaattttaagcatgtgcatgtagtattgtttcctttcttttatttatttacttattttatttcaacaggtttttggggtacaagtggtgtttggttacataagttctttagtggtgatttctgaaattttggtgcacccatcatccaagtagtgtacactgtacccagtgtgtagtcttttatccctcacccttcttctacccttttcccaagtccccaaagttcactgtatcatgcttatgcctttgcatcctcatatcttagctcccacttatgagtgagaatatacaatgttcggttttccattcctgagttacttcacttagaataatagtctccaactccatccaggttgctgcaaatgccattatttcattccttttttatggctgagtggtattccatggtgtatatttatatatattaatcacattttctttatccacttgctgttatgggcatttaggctggttctatgtttttgcaactgtgaattgtgctgctataaacatgcacatgcagtgtcttaagcgtcttatgtcatagaatgacctcttttccttcgggtagatatccagtagtgggattactggatcaaatggtagttccacttttagttctttaaggaatctccacactgttttctgtagcggttatagtagtttacattcccaccagcagtgtaaaagtgttcccttttcaccaaatccacgtcaacatctattgttttttaattatttatttatttatttatttattttattatggccattcttgcaagagtcaggtggcatcacattatagttttgatgtgcatttttctgatcattagtgatgttgagcattttctaatatatttgttggccacttgtatatcttcttttgagaattgtctattcatgtccttagcccacttttacaggggattgtttgttttttccttgctgatttgtttgtagattctggattttggtcctgtgtcagatgtatatattgtggagattttctcccactctgtgggatgtctgtttactctgctgattgtttcttgtgttgtgcaaaagccttttagtttagttaagtcccatctatttacctttgttttcattgcatttgcttttaggttcttggtcatgaagtatttgcttaagccattgtctagaagggtttttccaatgttatcttctagaatttttatggttttaggtcttagatttaagtctttgatccatcttcagttgatttttatataaggtgagagatgaagatccagcttcgttcttctatatgtggcttgccaattatcccagcaccgtttgttaaatagggtgtcctttccccactttatgtttttgtttatgttttgtttgttttgtcaaagatcagttggctgtatttggctttatttccggattctctattctgtttcattggtctatgtgcctatgatggggacagggttaggcatgtctgaactcagactctctttggttggggcttgctgaggctgctgtgggggatggggtatggttctcagaccaatggagttatgttcccagggggattatgactgcatctgctgtcatgcaggtctccagggaagtggggaaaagccagcagttacaggcctcaccccactcccatgcagcccaaaaggctagtctcattcctactgccccacccaacagcactgaggtcatctccaggcagcaggcatgcaggactgagaacttggcccaggctaccagcgtcctggctgagaaagcagggctttcaagattcgtgccaccctgtgcctgcggcaacttctgtgctgtgcctgcactggctattcaccccctcccccagactccgtccaggaaatttcacattctgtcaaaattgttacaaagttcggctagaagttttcttctccctgtgtttttttcccagttcctctgtcagtcctcccaaaggacccctgtaagacaaagtcggaaatagcttccctggggaccaagagtgcccacagggctcttcccgctgcttcttctacccctgtattttgcttggctctttaagtttctctcaactccaggtaaggtcatgtcctactcctgtgatctagacttttaggttccccagtgagggtgtgtgttccggggcagacgactgccctttcacactttcaccctttcaccctttggtcactcacagtgttttggctgtctccagcggcctgcagcagcaatccgcttccttcaaagggtctgtggaccctctcagctttcctggtatgttcctgcagtgattcttggagcaaaagttcacagtgtgagtctccacacgctgctctgtctgtccaagtgggagctgcaagttaatcctgcctcttattggccattttttcctctctttttattttcttaacagttccttttgatgagcaggtgattttaattttagtagaaaagcctaaattatatttctaatatttagtactatttatgttctgtcaaaaattatggctacccaaagttcacaaagatagtctcctgttttcttctagaatttttgttgtttctgctcctatgtttaggtttgtaatatatttcaaattaatttttatatggcataaaatagagattgtgaggggttctgcatatggatgtccagttgtttcagcactatttattaaaaatacaaagcttttgctattgaattaccttgaaacttattaaaaatcaattgattgcatatgtgtctctacttacaggctttcaaaaaatgttgttgctgtttctccttacacaaatatcatattgtctactatggctttatattgtcttaatgttaggtggtaagattcatctaactgtattatttttcaaaattgtttttgctaatctaagacctttgcatttccatataagtttatgaatcatcttgtcaatttctacagaaaaccttgttgggagtttgattagacggctgagaaagacagcaaatctacagggtgagtaacatggctctggactcagggtacctggattcaaatggctactcaactgcttactatttatgtgcccttgaacatctgtaatcaggatattaattacatgccccctctgtgatcagaataattataaaacataccttctatggttgttgagaggattaaataatttgcatatacaattgcctactggaaatatctaattggatacattataaacatttcaaatttgaaatatacaaaatcaaactcctgatttttcgcctttcctaaactgctccatctactgactttctcatctcagtatactacaattccattttacctgtcctcaagataaaagccttatggtttcttgtgccagacaccttgaaatcaaccttaactcgttgctgtttctcatatcaaatatccaaaatgtcagcaaatcctgtagtttctacctttaaagatacgaatctggccgctttttacaacctcattgtaaccaccctgacacgctaacctggattattgcaataatttcctaactgatctctgagcttccacctatgtatcccaaaaatctattatcagcactgcattcattgcattactgtgaagacttaagccagatcatgacacttctctgttcaaaaccctcttcaaatagaaataccttcaaaatctgttcataatctcctcccaacccccatcattatctgaccccttcttctatgaacttatttcctaccatactatcctaatactcttgctgctgcagccacactagtctccccactacttctcaatcatacagcacagttcttcctttggatcttcgcagttgcttttccctttgcctggaagtctcttccccgagatgtttgcatggcttgcttccttacctccttcagcctttgattccgatgtcgacttctcaatcaggacttccctagccaccacattgaaaattatttgtatatattaacatatgcaatatttcctaactttcaaattctaatttcttcaagtaatttccatcactttatgtattatataacttagaaatatatttattatatgtccctcttcacccttatattaatgggtacttgacttgggtataaagtccatgaaaaaaagggatttcttatatgttgttcattcctatgttctaagtgtcaaaactgtgcctggcatgtagctgttgaataaatattgaataaatatgaatgaatacatgaatgaaatgagataatacacaaacggaatttagcacagttccaagagctcagaaaattcttaataactgtcagcaattataattttaacatttacacctgtgttcagtttcccagctttccagagcattaaagcatgttctaagtcttggaagaaggaggagaactcttttatctctttatcgttgacagtagcactacttgcgttcagttgggcagaaatgccagaatgctctggaattccacaggctgagagttagctgtacctgtccagactattgcctacccaaggacatggccaaagataaaaacttgatttactattcccctatcttgaataaaaactcacttccaaatcccatcagcacctccaaaatgctttctaatcactcatttctccaactccccttacccttatctatacggtactcccacacccatgtcacagtctggtgctttctatgagtccctttcaccaggtaagtctatttcttcaagtcagggaataaagaacccaagatatacctccaaaacaggcacttgtggaaacaatagttgagcaacagccttaaaatgtatttcagtggcagaaagtcaactaagtaaataggtagactcttcattgagccaaaaattttttgggggaaggagttgaacctaatagagtcacataccttttcgctactgatttccctttgttatttatatacttccatgaaaattgtaaataagaccaaattaaacatttttcctaatatatttccccaaatcgaaatctaagtacataaattattttcagacaattgtgttacctccagaactcagaactacagaaattcagacttattattaatgaaatcagagtataaagttctcgcagaccatatgagaggaacttcactcctacaatgcaattccagagctataaaatattatattcagagatcacctgcaccgccttccccactttacataagaggaattcagttctccaagaagtaaaagaccttgaccagggtcacagagtgagctagcagcagaacaaagactagaaatggggggtttcagcttcacgcctgcactgctccctcatgacctagcacctgttcaaaccaggtactttccttattgtgagtcctgaatattgaacactataattgcacaaggatatctgagttcatataggttacaaagacttaagcaatttaattcaatttgatgaaagagttgcaatgactttccaccctatgcaagaccagagagagagaacccatagacaaaacagcatgccctggatttggttgaaaggcctccacaaatctgaagcagcacatcacttagaacattactagctgtaacaaaggaagtgctttcttttgattatgttaagagagcaggatctaatccacttcatacctgtgatgataaagcacttattcagataaagaaagaatagtacttcatgccagattcattttatcaggatagaatacaaacaattccacagaatctgacatatagttcttgttatgttaacctgatggctcttgatacagaaatattttaagttataaaattgttattacatactacactgcttcataatggagagctatcaggtatctaatagcaattttaaagggcttagattttagtagcaagatcataatccagaatccagagacaaagaataataatttcatatgctttcccacaaaagctcttgtatgctctcctctacctgagtttttggaagcatgtcaagaatggctttcccagcagaggaaaaagtgattgctaagctataatttagggcaacaacacaactgaatttcagcagcatataccatcaggaatgagttttttcttccatttaattctgtaagcaaaggcttctgtcagtattaattccccataataattatgattacttgataagctaaaaacaatcaggaggattattcttacatgtgattgaggtaaccaagcttatgtattacaggaaaagcaagaataaatacagtgtacattttttcaggtatgggtctaaattacatctggggatcaaaaaatgaataaaacacagtcctcactcataaggaattcaagcctagttgagggacattggtgtgtaaataacaagtgctattctctactgggaaaagctcagggtctacagtcatacagatctgaaattgaatccagctttgtggcttatgatctgggagaccttaagcaagttacttagcctctactaggctttagttttctcatttaaaaaccagtgtacctccctctgaggtactgtgaggagtaaaggggataatgcctagaagggacttagtacttctccaggtattagtatgtaagattaccttattatacaagctgcaaatacataggtactatcagaaatataagcaatgtgccatgaaagcaatttattcagtctaatgattagacctctgctctgaactacacatgccctttataaaaccagcacagatcaagtgtgttttatgagttatgttttagacattttggagcaataatcataaggttattactatttcagatcaaagtgcaaaggctatgcaaggggtagccatttctctgaaattgccatctccaggactgattcaggaaaaaatacaaatctattatctgctttgctaaaagaaaattgtctaatgaaagtaaatcaccaggaaacccaatttactctacagtgaaatttggcttaaaattaatctttcttatacctaggcaaagagttttctggcaaaactacatggtttcttgaagaaatagattcacctagaagtcagcatggaccccaaagacagagttattttatacctgtgtcatcttgaactatcatgcaatgactttttaaaaataaacttttagagcagttttagatttacagaaaaattgcaaagaaagaaaattcttgaataccccccacccagttttccctaatgttaacatcttacattaggatggtgttaatcgccatcctaaagaaacaggatgaatccctgcccaaaatttgatttggatgtcaagaccaatgatgtcacacacgcacacacacacacacacacacacacacacacacacaccccaagaggttatgaaaatcttttctataatgggatgtttttgaaaagagcaagggagccttcccaaaatggttccaaatggcttaaatagccagaaaaggagacaggcttgagatttttttaactgatacataataattgtatatgtatatgaaatacatctgacatttcaattcatgtctatgatgtgtaataatcaaataagagcaattgacataatcatcacctcaaatatttatcatgtctttgtgctgagaacattcaaaatcctctcttctagctatattaaaatataaaataaattttggttaactatagtcaccctcctatgctacagaacattataacttatctaactataattttgtacccattaaccaacttcttcccatcctttccccctacccttcccagcctctggtgaccactattctactctctacttctatgggatctacttctttagctctaatatatgagtgacaacatgtgatacttatcgtctgtgctggcctatttcaattaacataatgtcctccaggctcattcatgctattgcaaatgacagaatttcattctttttatagctaaataatatttcattatgtatatgtactagatttttaaaattcatttacctgtcgatggacagttagattgtttccatatctgggctattgtgagtagttccgcagtagccacaaataaagatcctgcacaaagccttagtgctctgaaaacatccataaataaaaccaattgactctactcaaattacaccgccgttaagggcacatcaatcttcctagataagaaagaaaaagcacaagaactttggcaattcaaaaacgcagagtgtctccttaccccttatgaccacaatagctccccagcagtggtttctagccaaacaaaaatggctaaaaagacagacaagaactcaaaatctcaatgaagttcatcaagattcaggagaaagttgaaacccgatttaaggaatctagggaacccaagaaaattattcaagagctgaaagatcaaataaccattaaaaaaaactgatctgatggagctgaaaaactcactacaagaatttataatgtaactgaaaatattaacagcagaatagacaatgctgaggaaagaatttcagagctcaaagaccagttattcaaatcagctcagacaaaaatgaagaaaaaagaatagaaaagaatgaagaaaacctttaagaaatatgggattatgtaaagagaccaaacctgccacacatgtgtgtccctgaaagagacggagagagagcaagcaacttgaaaaacatatttgaggatgatgttcacgaacattttctcaatgtcactagaaagatcaaaattcagatttaggaaattcagagaacctctgcaaggtattatacaagatgaccatccccaagacagtaatcagattctccagggtccaagtcccatagaagtagagagtagaaagaaataatattaaaggcagctagaggaaagtggcaggtcatctacaaagagaacttcattgggctaacagtggacctttcagcagaaaccctacaaactagaagagaatgagggcctgtattcaggatctttaaaaaaagaaattataaccaagaattttatatccagccaaactaagcttcataagtaaaaggataaataacatttttttttcagacaagcaaatgctaaggaaatttgttacatcaaaatatcccttacaagaggtcctaaagcagtgctaaacgtggaaacagaaaacattacagccaccacaaaacacacataagtacatagatcattgacactataaagcaactacacaatcaagtctacataacaattagctaacaacataatgacaggatcaaatctgtacatataaatattaaccttgaacataaatgggctaaacatcccacttaaaagacaggtagtggcaagctggataaagaagcaagactcaactgtacaatgtcttcaagagacccatctcacatgcaataacaaccatagactcaaagtaaagggatggagaaagctctatcaaacaaatagaaaagaaaaaagggcaggggttgctattttaatttaagacaaaactgactttaaaccaatgattatcaaaaaggacaaagaatggcattacataatgataaagggttcaactcaacaggaagactttactatcctaaatatacatgcacagaacactggagcaccaaaatttataaaacaagttcttagagaagtatgaagagactttaaaaaccacaaaataataggagacttcaatggcctactgacagtattagacagactgtcgaggcagaaaactaaaaaatatttttgggacctaaacttgagacctgactaaatggacctaatagccatctacagaacactcccctagacaacatagtatacattcttttcatttgcacatggcacatactgtaaaatcaagcacatgctcagtcataaagcaattctcaataaaatttttaaaaattctagaactatgccaaccccactttcagaatgcaacacaataaaaatataattgaataccaagaagatccctcaaaaccatgcaattacatgtaaattaaataatctgctcctgaatgacttttgggtaaacaataaaattaagacaggaatcaagacattctttgaaactaatgaaaacagagatagaagatattagaatctctgggacacagctaaagcagcgttagaggaaaggttataccactaaacaccaattggaagaatatgtattctattgctgttggattaaatgttttgcaaatatcagaggcccatttggcttagagtatagtctaactctgatgtttctttgttgattttatgtctaaagtatttttccatttttgaaagtggaatgaagtcccctaatataattggattacagtctatctctccctttatatctaataatacatgctttatatacttgttccagtattggttgcatatatgtttacaattattatatgctcttgctgaatggacaattttatcattacataatgacttctttatcactttctaaagcctttgacttgaagtctattttatctgatataaatatagctattcctcctagctcttggttttcatttgcatgaaatatcttttcccttcccttcacaatttgtctatgtgtgtccttataggtgaagtgagtctcctacaggcaacatataattaggtcttgttttttaatctattctaccactttatatcctttatttggagaacttaatttatttatactcaaggttattattaataggtatagacttctgcaattttgttaattgattcctagttgtgttctgtaatcttttgttcacttcttcctcttttgcattctctgtgatttaatggttttctgtacaggtaggctttggtccttttcatttttttgtgtatctactattagtttttcctttgtgttcatcctgaggcttacataaaaaatcttataacaagttaatttaaactgattagagcttaattttgattgcatatataaactcctcttttactccatctcctcccatgttttatgttttagatgtcacactttacatcttttcataatattagcaaattattgtcactttattgcctattgatctttatactagatatatactaataattgattttcccaccaccattacagtatcagaatgctttgaatttgataatgtactttcttacttttaccatgcattttgtattttatatgatttttatgtcaccaattttcatcctcttccttcaggcttgaagaactttagcattttttgtaatccaggtctagtggtaatggatactctcagcttttatttgataatttttcttaacacttaatttttaaaaggcaggatttctgggtatagtattcttggttgacaatcttttttatttcagaattttgaatttatcatcccactcccttcgatttgcaaggtttctcgtggtaaattggttgatagcttatgaaagttcctctatatgtaacaattcacttttcccttgctgctttcaacactctctgtttttaacttttgaaaatttgactatgatctgttgtggtgttagtctctttggattcatcttcttgatatcttacgggcttaatggatctggctttctaattcctttcccagaattcctttcccagatgtgagaagtgttctgcaattatttctttgaatacgttttctgttctttactctttcttctttttcttccatgccaataatgtataagctgttccacttgatgatattccgtaggtctcttaagctatcttcactctttttaatttcttttgttcctcatgttggttcattttcagtgctactttcttctgcttcataaagtctgatgttaaacccttctattaattttttagttcagttatagcattcttcaaatatatgattttcatttggtatgtactttatgctttctatgtcttatttgaagtcatcaacgtcttgcctagttgtcttgacctctgtgaatatcttttgataccattattttgaattccctgtcaggtaaactgcatactctcctttatttgagttgatttctagagatttatcttgctcttttctttggaacatattcccttttttcttcatattccttgattctctgtgttggtttctgtgccttaaataatacacctacatctctccaagactggacttgtataagagaaaattttcacccattcatttggccagagatttcaaagtgcctctctatttgttgttgttgtttagactactatctctgtttttatagccccctggagcttaggatatgctacatcttgtcagtaccccaaaaatggtatgataggagatagtctatttaagatgtagctggaaagattgagatgttagatatgtattcccattcttcctatcattatggggagactgggtgcaagaacttatctcctttctctctgcactaagacagaagatctgtggaaaatgcctatacttatgttcaagctgcaccttctaatcttggaggaatagccactaggtgtaagtccattatatatacatctatttgttttctctagtcttgggtcactcagaatcacaacgccccctcaattttcagaggtggttaattacacagttccctaggtgggagacacgaaagttgtggcactcagtgcacagtcaaactcatcccagaaataggcctggatttatctctggggcaaacaagggggaggtctcatggaatgctgagctctggctctgggtaccaaaggtttattgtttgtttgccccgttagcttcttgaggaaggttcattagagaccaggccatcaaatagccactgggaatgtgtgttgtaagcctcttctggagattaagtgagagtttaatgttgttgacccttttctgcactgctccaagggagtgtagcccttggaagtgtttggatgcccacttaaaactatgtctttgttccagaatgaaggaagactcatatgcctagtcttttgttcccgcaactactaggtttagaatggagcctttcagggggtagcattaaaaactaggactatcgatgtgtgtcctaaactccttctggggaaaaacaggtagtggcattttttgacccctcctctgcacagctccagaagaatgaagcctctagaggagtttgcctgcctatttttaaatccctctttttccctctggtggacaatgacatgtgtacactggtccctttggtacccaaagctaggagatttcaaatactattccttaggtgaatgttgcaggatttgagacacttgatgtgagtgcaaactcttcccaaactagaggagggttaataattgactgtctctttaactcctccatggatgcaagttagttagaatccaggctgccggacagctactggaaaggtgttttgtaaacccctctcaggaggacttgggcaggggaaacagagagctgtgggttttttaaagctcctttagtgctcccaaggggataaagtccttagtagtgcttatgcacatgtataaacttccactttttttcctacagtctagaggggcatgggcatatctaatcccttgcatttctaaagtttgtgaatcaaccaccacatcttggggaaatttagggtttgggtcctttacgtgaggtccagatcttcctctctacacagagaacctgggtgttgagatttctttctcagtatcgtggtgcaatgccctgggtggggtccatgcccaagtgtgcgtcagcttttcccacccacttaatgtggacgttttctcaattgcctgttgggtagaagtctcttgactggcctttggttttgtctcgggggagtttttctgtaaatagtttatctggaacatctgcgattgtagggagagtcagaagtttcctatttcaccgtgttggtgacatcacccacccattcttagaatttttattatggttgaagtgttgggccaaggtgagcattcctttctggggacaggagcttatgtgatttgaatctcccactagtactaaagaggggaacacccaagctttattattagcttgcccagattgggggcagaaggggaagatagataagtaacgcttaaaagtcgtcatccatcaaacatcaacatatggagtcagctttttcattatacattgtccttttttaactattagtgaatcaatagtcatatattttattagctaaagtcagcattttattcatatttccttaatgtttagctaacgtcctttttctgtctgcattatgtttatttatttattttttaaatctaggactcatttttttttatgtaaatagcacaatagttgccacaggacaagaaggaatcaaatgacaaatttattttgattaattatcaagaaaatagagaatatgatattattttcactttctgatacaagacccaactcgtgagcctgagcctgtcattgccctgggacctctgctgcatactctttggtgccaattatgtatttgcttctctctctcactgacacaccttcctgtcaccttgctctcctatcaacatgtcattttgtaaaaggggcagcagaagataggaagaacatagacctcaacctgaggtaagctctatagtgtctaaatattaacagttattgtctattgtacatcaacgattgtattggaccaccctcaagattttgccatacccatatttcttctctgttatgattcacttaatacttttctccaaattcattctttttttaatagttacatttctgaaaacactttaaaattaaaacataactaatgaaaggaaaattactttgcattccacctaaaatcaactcaaatgctcctagtggtataggtctcacagcatgggaaatactgctctatactattcgtttatcaatgaataggaatactacatgatgtttctcttacccagtgagcagttaaagtatttttgtattatactttaagttctcaggtacatgtgcagaacatgcaggtttgttacataggtatacatgtgccatggtggtttgctgcacccatcaacccgtcacctacattaggtattacttctaatgctattcctccattagaccaccagcccccaacaggtcccagtgtgtgatgttcccctccctgtgtccatgtgttctcattgttcaactcgcacttatgagtgagaacatgtggtgtttggttttctgtttttgtgatagtttgctgagaatgatggtttccagcttcatccatgtccctgcaaaggacatgaactcatctttttttatggctgcatagtattccatggtgtatatgtgccacattttctttatccagtctattattgatggacatttggattggttccaagtctttgctattgtgaatagtgctgcaataaacatacatgtgcatgtgtctttattagcagaatgatttataatccttcgggtatatacctagtaatgggattgctgggtcaaatggtatttctggatctagatccttgaggaatctccatactctcttccgcaatggttgaactaatttacactcccaccaacagtgtaaaagcactccaatttctccacatcctctccagcatgttgtttcctgactttttaacgatcaccattctaactggagtgagatggtatctcattgtgattttgatttgcatttctctaatgaccagtgatgatgagctttttttcatatgtctgttggctgcataaatgtcttcttttgaaaagtgtctgttcatatcctttgcccagtatttgatggggttgtttgtttttttcttgtaaatttgtttaagttctttttagattctggatattagccctttgtcagatggatagattgcaaacattttctcccattctgtaggttgcctgttcactctgctgatagtttcttttgctgtgcagaagctatttagtttaattagatcctatttgtcaattttggcttttgttgccattgcttttggtgttttagccatgaagtctttgcccatgcctatgtcctgaatggtattgcccagattttcttctaggatttttatggtcccaggtcttagcttttagtctttgatccatcttgatttgatttttgtataaggtataaggaaggggtccagtttcagttttctgcatatggctagccagttttcccaacaccacttattaaatagggaatcttttccccattgcttgtttttgtcaggtttgtcaaagataagatcgttgtcatggcatgaaaaggatgacctttccagtctgcaatacctgcttgaccactaagaccaaacagctcaaattaaaggtaacaaattccgcagaggcaattgttcaacacaggaaaaagaaaccactttaaggattttaaactggaagagattttacataagctgttttaaacaaaaccattggatgacctggagtaacagtgtcggaaactcagctgagctggatagagaactgagctgcccgttgttggagaagttgattaaagcagcagccgaagatcgaagtaacagtcaagactgtaatcacttactgcaatagtataagcaagaggccaaaaccaaagaaactgccaactcacccaggtcttctaaattccccagaaaggtgcactagtggagggtcagtgaatcaggacagacatgggggtcagctcacgattgaggaagccccaaacaaaaatctccagtagtattatgaaccctggagcaggaggttggagtgagacaaggagagctaggagtagaagagtatggagtcggaggagggaacggtttcttaaggtctcctcccactctactcttaagaaagcttcagtagaagcacctgaagaaaactccagcaggaagccctcagataaagaaacttctgaatgaagacacctaggctaggaatgcaaatatgtttaagagcatgggccattaggggaatctgagttccagaatgcaattctctttaaagattgcaatgcactgggtatgccccaagtctggggagggcaactttcctcggaggggtttgccagataaagcctttgtcattgcctgtggttgggcctgaaatatcaaacatagatttttggccaggactcctcagcaggatctagtcagggccttcacaaagtacattcagaatgacaattgacccaccagaaagccatcatgccaccacttgatattttaaatgaaaagacccaccaacatatctgatatccatatctgatacccagtagaattggaatgctgctatcaccactgtcactattgtcactaccacacctgcctctagaaacccagcaatctggaggatggaccctggataatgttgcaggcaaacctcatttctctacaactgtgctttccaccaacagtcgattaaaggaagacgaagatcgagtgtgtgtggatgatacagcaaataaaccttcttctagttcttaaagattatggttttcagtgtttagtgagcatccgtgttcatctttaaaggatagaaaaatgcaggaggcatcttgtatccatgaagatactaaaacacggatttcctcaggaaattgatcactcaagcatccataatcttagtagactgcccttatagtcgtattgcagaatgtgtgatctgccatctactgagggctcatttttccctctcctctctcatccaagattggtgatagtttcaaatttttctcccactattatgtagaataatttccaaacttgacactcaattgaatcatggtgtccaggaaaatagataaaataaatatgacttcatataccagaagtcatattcctttgaatacaatcagggccataaatggcacttgcttctataacacaaagtgctattataattatatacatgattttttaaataattaagtaacttggaaccagtttctattgcaataattataagaaacaaagacctccaactgaatgaacccctctgaaatattttaataaactctgaggagtactatttgtcaagcaaagaaatactgaattaaggtaaatgccagcttaggatgaaaagaacagcaacagtgcctaccttcattacctcagcctctccctggctaagataatcacttaatcttttatgcctttgctaaaacctcattagtaaaaaggagacctgcctactaagcataaggttaaggctttaatggactttagaaatcatttacttttatgactcaaagcactgaagtgcaaattctttttatttgaatatttgagggcattaaatgagcatttttaatggatttcaattgtcaggataaaataaaatttctcaaggggaatctgaattttaacaaacattaaaatcaaagaagtaaaaagatgaataaatggagaaaaagtattgtagtaacatcaatttttgccaatctaattttttaacaaaaacttttaagtctatttttggccaggcatggtggctcacccctgtaatccagggctttgggaggctgaggcaggaggatcacttgaggccaggagttcgagaccagcctagccaacatggtgaaaccctgtatctactagaaatacaaaacttagccaggcatggtggtgggcaccagtaatcacagctactcgggaggctgaggcaggagaatcgtttgaacccgggaggtgcaggttgcagtaagcgccactacactccagcctgggtgacacagcaatacaccatctcaaattgagtatatttatttagttttaaaactaactttgaaaatctcttcacctagggaagttatttcctgaaactattttctactgccttttagaaacactgccttcctggttttgtttcttttttgtatgttggctttgtttggtttgggttatgtttgtttgaagaaaaaaaaaaaaacctgaagtgattcttgaagtatttttaagtgagcacattttaatttgacataacattggatttcacttggtgaaaagagagatactgaataattagtagtatctgataagatgtttagacggagaagtgtagactcaccatgtacaaagcagctatgatggtgttcgcccacctcttcccctgcctaatgcctattcatctgacatttatcatccagatttcacttcctctaggaagcttccttgatgcctccaaacaaggtcgaaagcactatctacatgcttcttagcaatctgtagctctaccatcaacattttattctgattttgcatttaccttctttcctctagtagaatatgtgccagactgtgtcttgctaaacattgttaaatagcactagtatactgctggtacagaataagacaaccaacaaatattgaatgaatgaatgagtgaacccagagttaagcatctgctcacttagtgattgggttggtttcaggtggaaagtccataggctgatatcaatttgactggtatcagtaagaagggaagtgtaagatacacaggtgtcagtttcctgagggtcttagatgaatgctatgtagactggacttatttcagttgttagctctagatatgagggacaggcagacgatcactctgaagcaggttggagcacattttagtgggcatttattggttaccttctcagtatattatctagtctctgttatcccagaaataccccaaattgcaagccacttagcaaaagaaatttaatctttacaccctgttctaatttaatctacctttttgctactaccagctttccttggccatggtgactgagtcaaggacagactcataatctaaggcaaagcaataagtcatcaggagactcaatacctgcgtgtctctcaaccattggaaaaagtgaatattctttgtatctggatgtgaatgagaaaatacacaaccccaggagctgctagaacccatcttgagtttgaagagtttgccttataataaaaccaatatcaaaaaaggagggtctaatatggggaggtacaagcttttagtgatattgtttgagtcttggataaagattcacttgaagctagaatctgccctccgcattcctttataaaccttgcgacacatgaaactgagcgtgttacctctcaaaagtattcccacaacagtagtcacaaacctgtcataacagtcaacatactacattgaaataatttgtttatatgtgcattcccctatactgtgagcctttggggcatcagacatgtcttgtcacctaggatggtatctggcacatatttagtgctctataaatctttgtagaattaacaaatgaatggatggataagagttgcaatagaggtaaattatatttccaaatttttttatttattcctgacaaattaatcatattcctgtatttttttctctatatttcaaaggtaattagatgtcaacactttttactttcctttttctgaaggttttataaggaaactatgtgcaggatatcaattttttggagaatgactcccacattggctattctagcttattcccacaggaattcctaaaaccaagcaaataatttcaaatttgttgagatcgcataatttagtttagaataaagagatcttgtcacctttcctctaaaggaagtgtctgctacaggcattccctatgggtatgtataattggaaaattaaaaagcatatttaaaggcaacattgtgctataaaaaatgttggcaatgttccaagggggactgtgtatgctattagatatttttgagaatttactctgcctgtgctaagaattttcaataattcccttcttgggtaaaattagggcatcagcagagaagtaaactctctaatataagcagcaagtttccatttttcaccataatgtgttcctaaaaactatgttgggaagtaaaatgattaaaaatagaacttttttgctttcatacaattttcgttaagtttaaaactgaagttatttgttcacataagcaagtaatatttatatactggttaggtgagatattgatcgtggctttcttctggagccaagagagaataaaacaactggacaatgtaagatggctatgtctctcagaaagtaatacagtcgaaagcctagttcaaagtaagaaacacatagtagatataacaccactgttcattccagagcctgtggaaggtggggctatttgctcatgtcattctttcctgatttatctatattaaaccttagaatctttcttaataccaaacttgaaatgtcactagcattcatttgaaattgttactagcattgacaggtttaataccgtagacttaaggtgactggcttacatgcctacaaccagggaaacattttcacctggtggcaacatcttgatttgcagtcatagacccaggagaaagaatccaacattttaagtctaattcagcaaaaccaggtctacaaatagtggcaaacataacttaagaaattatctttaaaatgatggcttttactacacttcgtgaatttctagaagtcccctgcccatgctatcatgggatattttaataataatcaaattgttatgtagatatgccaaataattctgttcaggcagacccatttaattcagcaggaatttgccgatatcctgttctatgcatagttcattagtggattattttaggagtttgaaaaaaaacacctgtgctttaaaaatttatactattttaatgtcacaaatatatatgcagagttctgcttccactaatgatagagtagcttatattggattcagtttaccgaagactagaattataaatcaggacaaaatattaaaacaaaaaaaccaactatttaaagatacaagacagtggtcaaatgcaagcaaaaaatgaaatttccttttgaaataaggagactacagtaggtgaaatttgtgtgtatgtgactttgtgcatatggacactcacaaaccaatgggatatctagaactcaattttaaagctaaagtctcactacctttaagagtcaggggataaatttcagggctgaaagtttttctgaaaagtgagggatgagaccataagggaggaagccacatccagtaattcatttatatatataaaacatacacacacacaaacacacacacacacacacacatcacactacgatcaccactgccacatcaccaaaatttcttggctagtccctgaacagcacatgtgtggaaaattccaaggagactggcagaaagcagtaggtgcaaggccagagaaactaagcatatcctagcctccacaggatgtggagtttggagtttgaggttaaccaaatagcccaatggatccaaaattaatactcctcagaagatgataaaactcagagtctctacaatgtatcactctaaatatccattatacaatcaaagattactatctatgtgaacaaataggaaaattttactcatagtcaagagcaatatcaagcaagagaaaacaacccttaaatgattcagatgttggagttagcagacaataacttaaaagcacttattataaatatattccaacatgtaaaagaaattattgtgataaaaaatgaagagacatggaaaatcaacaaaaaatttaaaacctagcaaataaccaaatcaaaagtttaggactaaaaaatacaatatctgaaataaaaatttaactggatgagctaaacaaaattggtgataaaaatatttggataaatcatggccaaggattccccacatacagaaaaaaaatgtaaacctttagatccttgaagttcagtggaacaaaatggaaataaattaaaagaaaaccacatttatgtacatccaagtcaaactggtgaaaacaaaggataaaaaggaaatttcagggaagccagagaacgcattacatagaggcaaaatacatacagacagtctatgacttacaatggttagacttataattttccaactttacaatggtatgtgaaagcaatacacattcaataaaaactttactttgaatatccatgcaaccatcctgtttttcacttttaatacagtattcaataaattgcatgaaatagtcaacattttattataaaacaggctgtgtgttagatgattttgcccaactatagactaatataactgttctgagcacatttaaggtaggctaggctaatctataatgttaggtagggaggtatattaaatgcatttctgatgtgatattttattgggtttattgggatgtaactccattgaaatttgaccatatatatatgaacactggctaatgtcccataagaaataatggaatccaaaaagcagtggaaagaaaaaatactatcagcatagaaattattattttaaaataaaggaaaaataaagacaacaaaaagtgagagaactgatttatagcagattatactaaattaaatgctacaggaagttattcagctaaaataaatcataatatatagattccttcagatctacaagaaggaataaagagcatcagaaatacaaataaatgaatacatatattatccattttttcactgaatttctttaaaagcccttgcgtatttaaagaaaacattgtaacttttattgttaggtctacaatgtatgtacatgtaatatacataatattaatagcacaaaggatggggtaggaggttaaatggatctatgctgtctggaggcttgtgcattttacaaaaaaaaatggtacaatattaacctacatcaactgtgatgagtaaaagatacatattataacacctatggcaaccaataaatgtaaatccaaagaggtataacttaaaagttaatagaagtatcagggtttaaattttgtccctctaaaagttatatatatctaagttctaatccccagtacttcaaaatgtgagtttatttggagatatggtttttacagaggtaatcaagttaaaatgaggtaatttgggtagctcctaatttaataggatttgtgtccttttaaatggtaaaatttggagacagacacacacacacagggagaaagccaggtgaataaggagatggccttctataagccaaggaagagaggctggaacaaattcctctctcatggtcctcagaaggaaccaactatgccaacaccttgattttaggcttctactcttacaagcttgtccaacctgccttattttgttgttgttgttttgttttgttttgttttgttttgttttaggcttttagcagcctaaagccatggtttttcgtttctgtctctggtgattagtggaaaagaggcatgaggaaggggttttactagcccaaccagagacagaaactaagaacccacaactgtattctctcccttggacacccctgcacactgagacaaagacatttcttttgtttaaactatgtatagtgtagtactttgttacagtagagatagcaaattaatacaagaggatttaaaataaaattttaacaaatatttgattaaaagaaaaggaagtagaaaaagaggaacaggaacaaccaaaagagaaaaaaaaacaggaaggataatggagaaaaaaataataaaaggttaaacataaacccaatcacgtcaattaaatgtaaataaatgaaataccttatgtaaaaaacagaatgtcagactgaatttaagaaagcaagatctaaatatatgctatttgcaagaaatgcacattaaacataaaaacacagcaagatagtcagtagaaggatagtgaaaggcattccatgaaaggactaagcataagaaaggtgaatcaatgtgttaataaatattactgtatatgttatattagcatcaaattatctttttaaatattcatgtaatataaattttttatgatgaggaaatttaccagaaataacaaaggacattttacaattctaaaagtctctattaggaagatgaaacaatcataaatgtgtattatctaataacagtttcaaaatacatgaagtgaaagtctaacagaactaaagggagtaaacagcagacccacaaattaggtagaaattttaatagccctctcaaaataattaaaagaataactagataaaattcatcagtagactataaaatagctaaacaacaacatcaactgctttgatccaattgacatttagggaaaaatatatactgcaaaatgcacatactttaatgcccatagatagtcatcaaggtacactatatgctgtgtcataaaacagatctgaataaattgctaaggactgaaattttacaaagcatgttcagtagggaagcatatttaatgcatttctgacttatgatattttactgggtttactggaataaatggctctactattctggggtctggaaggtgatggcactcttcccacagctccactgggcagtgccccagtggagactctttgtgggggctccaaccccatatttctccttggcacttctgcagtagaatgtctttgcagtggcaccaaacctacagcaggcttcttcctgggcacccagcctttcccatacatactctgaattctaggtggaaactgccaagcctcctttaactcttgcattctgaaggcctgaagaattaacaccacatgaaaaccaccacagcgtagggcttgtgccctccagagtagcagcctgaactgtatctgggtccctttgagtcatggctggagctcaagcagcaagggatgcagggagcagtgtgcaagcctgcacagagcaacagggtccagagcctggtccctgacaccattctttgctcctagacctctgggcctgtgatggaaagggctgcctcaaagatctctgaaatgccttcaagacctttttcccattgtcttggctattagcacttggctcccttttagtcatataaatctttctagcaagcggttgcttcctacccacttcaattcctctccttagaatgctcttgccttctctaccacatggccaagctgcaaaatttccaaacttttattctctgcttcccttttaaatataagattcaattttaagtcattcctttgctctcatatctgagtgtggacagttacaagcagctatgccacaccttgaacattttgctgctaagaaatttcttctgccagatactctaggttataattcataagctaaagcttccacaaatccctaagacatggacacaatgcagctaagttctttcctggggtgtaacgtgggtgatcttcactccaggtctcaataacttcctcatttccatctgaggcttcatcagcctggccttcactgttcatatttatatcagcgttttggtgataattacttgacaagtctctaagaagttccaaacttccccccatcttcctgtcttctgagccctccaaactcttcctacttctgcctgttgcccagttccaaagctgcttccacattatcaggcatcttcatggcaaaaccccactctcaataccaattttctgtcttcatcctgtttgcattgctataaaggaaaacctgagactgtgtaatttattatcaaaaagaggtttatgcagcttatggttccacagaatgtgcaaacatggcacccatgtctgttcagcttctgataaggtctcaggaagcttacaatcatgatggaaggtgaaaagggagcaagtatgtcacacttcataaaagagcaagagagaagggggagatcccagataattttaaacaaccagatcttgcgtgaactcatcgatgagaactctctcattaccatgaggacagcaccaagtgattcatgaggaatccacccccatgacccaaacaccttccacaaagccctacccgcaacattggtgatcacatttcaacatgagttttggaggggacaaaacgtttaaactatatcacaaccttaacaaaattttaagaaattaaaaccagctatttgtaaataattatcattataaccaaatgaaatttacctgaaactatatcattgatttaaaatctaaaatcaatcattacattcaccacattatcagaataagtaaaaaacaaaaacaaaatacaaaaaagactgtaactatcaaaaaatcaaaaatatttaaaaattgatcatttttggtgtcatttgattgaatcatttgatacgattcaatactcattgagttaagaactctcagcaacctagaaacagaagagaacttcctcattctataaaaggcatctgagaaaaatctacagaggacatcatacttaatgatgaaacatttagtgacttcttactgggatcaagaacagatgtttactattacttctgctattcaacattgcactgtgtaatctaactagtgcaatagtgcaaaacatagatcaaagaaacaaatattgaaaagataggagtgaaattatgtttattcacagataatattgttgtctatatggaaaattcttagtaatctaggaagcaactattgtaactaatatttgaatttagcaaggtttcaggacacaaaatcattaaactaaagaattgcatttctatattctaccattaaaaattgcaaataacacttaaaagactattacacttaaaataacataaaaaatattttattgttcttagaaataaattccactaaaagtgtgcaatacctctataccaaaaaccacataacattgctgaaaaacatttttaaagacctaaacaaacagaattgcagcatgttcatgaatcagaatagtcaatatttctaaggtgtcaattatttcccaaatctataaattcaatgcaatcccataatcaaaggtagtaactttctagaaattgtcaaactgacactattatttacatgaaaattcaaaggacatagaatagcccaaatattcttggaaaaaaagaacaaaactgatggactttcatcatctcacttcaagtcttggcataaagcttcaataataaagatagtgaaatattggcttaatgacagtcaaatatgtcagtggaatagagtccagaaacagaccaattcttatatggtcaattaattttccaaaaaatgaccaaagttatttaatagcgaaaagggagtctttctttaaaaatggtgctacagcaactgaatattcacatgaaaaaaataaaaataaaccatgaactcttctgttagtctgtttagtgttactataagggaatacatgagactggataatttataaagaaaataggtttatttggctcacagttctacaggctgtatgagaaataaaatgccagcatctgtttccgaggagggcctcaggctgcttcctctcatgatggaaggcaaaggggtaacaacatgtacagagatcacatggtaagagaggagcaagagagcaagtggagagacgccagactgtttttaacaaccagttcttgtgggaattaatagagtgagaaaccactcacccccttaaggaaaggcattaatctattgataagcaatctacgcttacaacccaaatgcctctcattaggccccatttccaacattggagctcaaatttcaatctgagatatggagaggacaaatatccaaactataacaactctataccataaacaaaaattgtttttgagatgagccataaacctaaatgtaaatgttgaaagtataaagtctctagaataaaacatagaacattatttttgtggcctggagttagacaaacatttcttaaatacaatacaaaaagcaataaccataaaagacaaaaatgaatacactagattcatcaaaatttaaagtatctgctcatcaaaagatcattaagaaaaagaataggtaagcttcatactggtagaaaatgtttgcaatacaatatttttgacaagggttttattttcataacatgtaaataactcctacaattcaatagccagaagacaaacaactctataaaaatgagaaaaacttgaacagaaaacaacctcccaaggaaaagcatagaaatggtcacaagcccatgaataaagcattcaatataattagctctcagaaaaatgcaagttaaaaccatcagaagatgccagtacacactcactaaaaaagcaaaaatactcacaagtcaatcactgggggacctggagcaatcagaactctcatacactacactgaaactgtaaaatagtacaaccaccttgaaaaacagtttgtttcttattaagtcaaacatacacccaccctatgatccagcattttcacacctaggtattctcccaaaaagaatgaaaacaaatgtccacaaataacttgttcaagaatgttcatagtatatctattcataatagcaaaaaacttgtaagcaacccagatgtccatcaacaggagaattaataaataagttgtggtatattcataaaaggagtcctactcagcaataaaaagaaatctattactgatacatacaacagcatggagttatgtcgagcaaaaagtcaggcattaaagagtacacatactatgtgagtctattagaaattctaaaacaaacaagactaatctatagtggaaaattcataaaagtgtggcctttgggtgaagaggtcattgactgagaaagaattttctaggttgacaaaaatgttctgtatcttgatgggtattatgatctgaatgttgctgtgccccactcccaaatttatatgttgaaatttattccccaatgcattaatattaggatggtagggctttgggaggtgactaggtcatgagagaagagcactcatcaatggattatgctcttataaaagagattaaagagggagagtcctagcctcttgggacctttcggccatgtgagaacacagcaagaggtgccatctatgaagcacagtgagctttcaccagacatcagttccactggtgccttgatcttggacttccccacctccagaactgtgagaaataaattcctattatttataagtcactcagtctaaggtattttgttatagcagcctgaatggactaagacaatagggatggtggttacactggtgtatgtatctggaaaaacattgaatggtacatttaagatttgtgtattttaatatatataaattttaaattaaactgaaaacaaaagcaatattggaaataaaagacagcttcatagagaaaaagatgtagacacatgccacagacataaaaacagaaactatcaatacaagaaggaatacaaaaaagaattctacatataatttaataaaaatccatctgaaaattaaggtaaggaattggattttgatacataagttcctaaagataagtttgaatatcatttatgacaaaagacctcataccatttttattagagatatatgggtattttcattgtatattgtattggaacaaattctaggtattcacatatgtatagtcattgcactaagatattcaataaaacgatttattccaattatatctcgctaatttgccagcaaaaatgactaatttttcaacctggtgcttcctaagagagatctaacttggctgtaaattttttaaatttattttattattctgttggctgctcctggacttcactgtgaaaggtatttgcttgcaaacatattaaagtatgaaaaatatccagagacagtaacctaatatattgtcacacatttacctattatctcaagaaatagcatctgcttcaattatgctaataaaatgattctgtggattctgtatgctattttctgcttattgaaaataaaaacatagcaaactatgttaatttcaaacaaacttgcacccaatgtctttcatttttgaaaagagcagctagctactttgttcaatgatacaggcagtatctttctcacttgctctcaccgttcttctaatgatttcagggctaaggaaaatgtttagaatactacccagaaaatagccataaggatattattacacatagtgcatcttgaattggtaaaataaccaaaagtttttctactttattaatagaattacccacttctacatgaccaaacttctgcttgaccttgttttacacagtcgtctaatatactattttcttcacttatatctcccagacatcagcaaagacatctgcaaaggcttgaagccattctcctttgccttaggaaataggtccgaaatgattcaatgtgccagcctgctctcaatgctacagttatagatgggtcttttctgtgagccatgccaagcataaatccaaaatcacaggtatcaccatagattttacattacttatactgactttctagtggccattaggaataccataaaaactaatatgcctaagtgggtttaatctctcaggaaaagcttctctgcattttcctgcaacaaggctttcaggccactttgagtttaattcaatttaattactgagtctccagctccacagagattcctggctgaccccaataaacagattttctcaggttgcctcacacccaagccctgtagtctctttgctcacagttacataaaaattgtgttgttgtataaaatcatcaatcaaccctgagcaaaacaaataaattagaggagcattcctgggactggaaaagaatagtgagccttagagagaagagaattggttgagtctattcctgcctcagatttaaactaaaatccattacatcaccagaggttcattccattttggtgcctgcctacctgtgcatattactgcacagtaatatctttataatttttttaacactaaatttcagccaagttgaacatctttggcttcttctagaatatggtgtactttcttgaatctgtgcctttgttcacactactctctcttacaaccatttctccccacatatatccacacacttaccttcccccattttgctgaaacatttcctacctacaccacatgtctcacattagttgcatttttttataatttttattttttgtagataccatacatttatgaggtacctgagatgttttgatacaggcatataatgcataataatcacatcagggtgaatggggtatccatcacttcaagcagttatcctttcttagtgttacaaacaattcaattatactcatttagttattttattttttttaatttttgtaatttaatttttaagttgatgggtgcatgcgcaggtttgttacagataaacttgtgtcataggggtttgctgtacagattatttcatcacctaggtattaagcctaatacccattaattatttttcctgatcctttccctcctcccagtcactaccctttgattgggctcagtgtctgttgttcctctctatgtgtccatgtgttctcatcatttagctcccacttataattgagaacatgtagtatttaggtttctgttcctgcatcagttggctaaggataatggcctccaactccatccatgttcctacaaaggacatgatctcattcttttttatggctgcatagtagtctatggtgtatgtgtaccacattgtctttatccagtctaccattgacaggtttttaggttgattccataactttgctattatgaatagtgctgtaattaacatatgtgtgcatgtctctatgatagaatgacttatattcctttaggtatataaccagtaatgggattgctgggtcaaatgatatttctgtttttaggtctttgaggaatcaccacactgttttccacaatggcttaactaatttacactcccaccaacagagtgtaagtgttcctttttctccacaacttcaccagcatctgttatttttttactttcaatagccattctgactggtgtaacatgatatctcattgtggttttcatttacatttctctaataatcagtgatattgagctttattttatatgtctgttggtcatatgtatgtcttcttttgaagtgtctgttcacgtcctttacccacttttgtaatgagcttgtttttttcttgtaaatttgtttaagttccttacagatgccagatattatacctttatcaaatgcatagtttgcaaaaatgtgcccccattctgtaggctgtcagtctactttgctgatagcttcttttgctgtgcagaagttctttagtttaattagatcccatttgtcaatttttgcttttgttgcaaatattttgatgtcttttatcgtgaaatctttgcccatttctgtgttcagaatagtatttcctaagttgtcttctggggtttttatacttttggatgttacatttaagtctctaatccatcttgagtcaatttttgtatatggtgtaaggaaggggtccagtttcaatctgcatatggctagccagttatctcagcaccatttattgaatagggagtcctttccccattgcttgtttttgtcagctttgtcaaagatcagatagttgtggatgtgcagcattatttctgggctctctattctgttttgttggtctatatgtctgtttttgttccagtaccatgctgttttgtttactgtagccctgtagtatagcttgaagtggggtagtgtgatgcctatagcttcgttctttttacttaagactgccttgactatttgggctcttttttggtttcacatgaattttaaaacagttttctctagttattggtacttcattaggaagagtattgaatctataaattgcttttggcagtgtggccattttaatggtactgattcttcctatccataagcctggaatgtttttgcatttgtttgtgtcttctctgatttctttgagtagtgtttttcagttctccttgtagagatatttcacctccgtggtgagctgcatttctaagtgtttcactcttttgaatggtgattgtgaatgggattgaatttctgatttggctcttggcttgactgtttttggtgtataggaatgctagtaatttttgtgtgttgattttttatcaactttgctgaagttatttatcaacctaaggagcttttgggcccagactaaaaagttttctagatatatctgcaaacagggatagtttgatttctgctcttcctatttgaatactctttatttctttctcttgcctgattgctctagccagaactttcagtactatattgaatagaaggagtaagagagggcatccttgttttgtgccaattttcaagggggaatgctttcagattttgttcattcagtatgatgttggttgtgggtttgttatagatggcgcttatcattttgaggtgtgttccttcaatgactagtttattaagagtttttaacatgaaagggtgttaaattttatcaaaagacttttctgcatctattgagataatcatgtgttttttgtctttagttctgtttatgtgatgaatcacatttgttgatttgcatatgttgaaccaatgttacatcccagggataaagcctatgtgatcgtggtggataaggtttttgatttgctgctggatttgatttgccagtattttgttgaggatttttgcattgatgttcatcaagggtataggtctgaagttttgtggggatttcttgctgtgtctctgccaagttttggtatcaggatgatgctggtctcataggaagagttatagaggagtcctcctcctcaattttttggaaagtttcagcaggaatggtaccagctcctcttcgtctatgtgatcctgagcttttttcgtttggtaggctatatatttggtaggctgattcaattttgaagctcattattactatgttcagggattcagcttcttcttggctcagccttgggacagtgtaagtgtccaggaatttattcctttcttctagattttctagtttatgtgcatatgggtattcataatattccctgatgattatttgtatttctgttgggtcagtggtaatatcccctttgtaatttccaataatgtttatttggtttttctcttttttctcattagtctatcttaacagtctattttattaattttctcaaaaacaaacttctgaaattgttgaccttttgaatggtttttcatgtctcaatctccttctcagctctaattttagttatttctttgttttctgctagctttgggatttgtttgcacttgtttctctagttcttttagttgtgatgttaggttaacttgagatttttctaattttttaacgtgggcatgtagtgctataaattaccccttaacactgccttagttgcatcccagagattctggtatgttgtatctttgttcttattagtttcagagaacttcttgattttgccttgatttcattatttacccaaactcattgggagaaggttattcaatttccatttaattgtatggttttaagtgaatttcttagttctgatttttaagactaagaaatttgattaccctgtcgtttgacagagtgcttgttataatttaagttcttttgtatttgctgagtagtattttatatgcagttatgtgattgaccttagagtatgtgctatgtgatattgagaagaatgtatattctattgttttagggtagagagttctgtaggtgtctattaggtccatttgatccagtgttgagttcaggtcctgaatatctttcttaatgtactgccttgatgatctgtctaatactgtcagttgagtgttaaagtctccaagtacttttgtatgggagtaaaagtctctttgaaagtctctaagaacttgctttataaatctgggtgctcctgtgttgagtgcatatttagttaggatacttaggtcttcttgttgaattaaactctttaccattatgaaatgccctactttgtctttttttatctttgttggcttaaagtctgtcttatctgaaattgagattgcaaactccgttttttctgttttccatttggttgatagacttttctcccgttattttgaacctataggtgtcactgcacataagatcggtctcttgaagacagtatatcaatagatcttggttctttatccagcttgccacactgcaccttataattggggcatttagcctagttgtatttgaggttagtattgatatgtgtgtatttgatcctgtaatcatgatgttagctagttattatgcagaattgttgtgtggttgctttatagcgtcactggcctccgtacttaagtgtgtttttgtagtggctggtaatgatctttcttttctatatttagtgcttccttcaagagcttttgtaaggcaggtctggttataatgaattccttcagcatttacttgtctgaaaaaggatcttacttctcctttgcctatgtttggtctggctggatatgaaattcttggttgtaatttctttctttaaagaatgttgaatattggcccccagtatcttctggcttgtagggtttctgctgagagacctgctattgttctgatgggcatccctttgtaggtgacctgccctttctctctagctgcctttaacattttttcattcatttcgaccttggagaatctgaagattatatgtattgaggataatcttctcgtgaagtatcttactggggttctctgaatttcctgaacttgaatattgacttttctagctaggttggggaaattctcatggatgatatactgaaagattttgtttcttatgaaggtgtgttttttttttttctatgtaaatagttgttaaattggtgtgcttgtggaggggataattggtggagacttctattctgtcatcttgctccaactctcctcatttacttattttaaaatttacaatcaataattgttgattgtattcaccctcttatgctaccaaatactagaggttttaagttctacctaaatatatatgcttttatccattaattatctccgttttcctctactacctttcccagcctctggtaaccatcattctactctccatctccatgagttcaattattttaattttagctcccacgaataagtaagatcatgtgaagtttgtctttctgtgcctggctcatttcacttaacacaatgacctacagttctattcatgttgtgcaaatgtcaggatctcattcatttttatggctgaatagtacaccattgtgtgtgtgtgtgtgtgtgtgtgtgtgtgtgtgtgtattatatatcacattttctttatctgtttgtctgttgatggacatttaggctgcttccaaatcttggctactgtgaatagtgctacaataaacatgggagtgtagatatctctttaatgtactgattttcttgcttttgagtatatacctagcagtgagactgctggatcatacgatagctatatttttagttttttgagaaaccaccaaattgttttccacagtggttgtactaatttacattcctaccaacagtgtatgaagatttctttttctccacatcctcaccagcatttgttatttcctgttatttggatataagccattttaactggggtgttcttggtacctttgtcaaaaataagttcactgtaggggtgtggattggtttctggtcccttattctcttccattgtactatgcatctgtttttatgccagtatcatgcttttttcgttactatacctctatagtataatttaaagtaaggtaatgggactcccccagttttattctttttgctcaagaaagctttggctattctaaatcttttgtggtttcatataaatcttaagattgcgttttttcatctcagtataaaaatgtcattggcatttcgatagggactacattgactctgtaggttgtttcaggcagtatggacattttaacaatattgattcttccaatccgtgaacattaaatatctttccttttggtgcatttgcttccatttctttaatcaatgttttacagtttttgttggaaagatctttcacttcttcagtgaagtttagttctagccattttattttatttgtacctattgtaaacaggattacttccttggtttcttttccagattgttcacttttgccatatgaaaatgttgataattttctatgttgattttgtatcctgcaactttactgaatttatcagttctaatagtttttttgagtctttatgtttttccaattataagattatatcatctgcaaacaagaatattttgacttctttatttccaatatagttgcccttttttttttcctttgtctgattgctccagctaggacttcaaatactatactgaagagcaatggtgaaagtggacatctttgtgttccagatcttagagaaaaagatttcagtctttccctattcagtaatactaactgtgggtctgccaaatatggtttttatttagttgagatacagtccttttatatcaagtttttttagggtttttatcatgtaggaatattgaactttatcaaatgctttttcagcctcaattgaaatgattatatggtgtttatccttcattctgttgatgtgatatatcacattgattgatttgagcatgttgaaacatcattgcattccagggataaatcccacttggttataatgaatgatctttttttttctttttgagacagggtcttactctgttacccagactggagtgccacacacaattacagctcactgaagcttcaaccttttgagctcaagtgatcctccttcctcagcctcctacgtagctagtagcaaaggcacatatcaccatgcccagctattttttgtttgtttgtttgtttagtagaagcagggtctcagtttgttgctcaggctggtcttgaactcctgcactcaagcaatcttctaaccttggactctgaaaatgctaggactacagtcatgagccaccatgcctggccaaatgatttttctaatgggttgttgaattcagtttgctaacattttcttgagaacttttgcatcaatgttcatcaggaaaatttgcctgtagttttgttttgttttgttggttttttttttttttgagacagagtctcactctgtcacccaggctggagtgcagtggcacaatcttggctcactgcaagctccgcctcccggattcatgccgttctcctgcctcagcctcccgagcagctgggactacaggcgcccgccaccacgcctggctaattttttctattttttagtagagactgtgtttcaccgtgttagccaggatggtcttgatctcctgacctcgtgatccaccctcctcagcctcccaaagtgctgggattacaaagtgtgagccacctgcctggcctgttttgttttattttgtttgtttgttttttgatgtgtctttggttctggtatcagggtaatactggcctcatagaattagtttggaagtattccctcttcctctatttatcagaagtttgagtaagactgctgttagttcttctttaaatatttagtaaaattcagcagtgaagccattaggtctgagcttttctttgctgagaggctttttgttatggctttaatctaattacttcttatttgttcacattttggacatttttgtggtaaaatcctgataggctttatataggaatttatccattttttctaggttttccaatttattggcatatagttcttcatagtagcctctaataaaatttctgtagtaacagttttagtgtctcttttttatccctgattttatttgggtcttttcttgtttttttcttagtatactaaaggtttgtcagttttaattatctttccaaaaatccagcttttgttttattgatcatttgtattggtttctctatttcaatttgagttattttctgctctgatctcgtgttattttttttcttttacaaattttgggtttagtttgctcttgattttctagttctttaagatccaacattaagttttttatttgacatttttctacttttttgatgtaggtgctttagctataaacttccctcttagtgctgctttcattgtatccattggttttggtatgttatgtttcactgtcatttgtttcaagagcatattgtttaatttcagtgtgtttatgtaatttcccaaatttctcttgttattaatttgtagttttattccattgtgttcagagaatatacttgaaatagttttaatgtttttaaaattttaagacttattttgtggcccaacatatggtatctccttgagaatgacccatgcaacgaagagaagaatatatattcttcagccattggatgaaatgttttataaaaacctattaggtccatttggtctatagtgctcataaactctagtgtttctttgttgattttctatctcaatggtgtggccagtgctgaaagtggccagctattattgtattggggtgtatctgtctcttagctctaacagtaattgctttatatatcttggcactccattgttgagcacatatatatttataattataaaatccccttggtgaattgactcttttgtctttatataatgactttattttttgctttgatgggttttttcttgaaatctattttgtctgatataaatatcactactcctgctctttttcattttccatttgcatggaatgtctttttccattcctttatttttagtctttgtatgtctttgtaggggaaatgtgtttcttgtatggaacagatcattgcgctcggtttttttttttttttttaattttatccattcagccactctgtgtcttttgattggagagtttagtccatttatattcaatgttattattgataaataaggactcactcctgtcattttgctatgcatttcctggttattttgtggtcttatcttgtttccttccttcctatctttgttttagtgaaggtgattttctctggcggtgtgttttaatttcttgctttttttgtagctgttgtatgtttttagatttgaggttaccataaggcttgcaatactatcttataacccattattttaaactgatgatgacttaaaactgattacataaacaaacatgcaaaatgaaaactaataaatactctacactttaaccttatcctctcactttttaactttttattgtttctgtttatgtctggtcctgtctatatcttgaaaagttgtagttattatcttcattggttcatcttttagtctttctactcaaaatatgagtagtttacacaccacaattataatgtatactattctgtgtttttctgtttactattaccagtgagtttttacttcagatgattttttattgctcattaacatccttttctttcagactgaagaacttcctttagcttatcttggaggatacgtctgatgttgataagatccctccatttttgtttgtctgggaaagtctttatttatccttcatgttagaaggatatttttactgaatatgctattctagggtgaacattcttcaccttcagcacttgaaatatgtcatgccattctctcttgccctgtaaggtttccactgaaaagtctgctgctagacatattggcgctcattgtatgttatttgtttatcttgctgcttttgggatactttctttatccttaaactttgggagtttgattattacatgtcacaaagtagttttatttgggttaaagctgcctggtgtttcacaaccctcttgtacttgaataccaataccattttctaggtttgagaagttatcttattattcctttgaatacagtttccacacctatctctttctcttacctccactctaagatcagtaactcttagatttgcccttttgaggctatttttttagatcttgttcatgtgcttcattgttttttttttcttttgtctcctctgtgtattttcaaataggctgtcttcaagctcactgtttctttcttctgcttgatcaattttgctattaaaggactctgatgcactattcagtattgaaattgcatttttccactccagaatttcacttggttcttccaaattattataatctctttgttaaatttagctaatatgattacaaattccttctctgtgttatcttgaattttgttgtgtttccttaatatagttattttgaattctctgtctgaaacatcacctgtctctgtctctccagagctggatcccctaaataaggtaccagaactggtaccttatttagtttatttgatgagttcatgttttcctgggtggtcttgatgcttgtggatgtttgccagtgtctaggcattgaagagttaagtatttattgtagtcttcagagttaggcctttttgtacctgttcttcttggaatatttggaaaaaaagattttccaaatattcagaggaacttgggtgttttaatctaagttttggtatctgcagtcatatctgtattatagggtacaccaagctcagtaatgctgtggctcttgcagacttgtagagttaccaccttggtggtcttaaataacttccagaataattctctgaattactagacagagaatcttgttatcttccattacttgtctccaaacaaattgagtcagtctctctctctccctctctctctctctctctctctctctctctgtgctgagctgtctggagctgggtaagggatgacacaagcaccccggtgattactgtggctgggactgggtctgacttgaagctagcacagtactggttgtcaccactgcctggctactgcctatgttcattcaaggtcctagggttctacaattagcatgtgacaaagccagccaggcttatgtccttcccttcagggcagtgagttctcctgatctcagatggatccagaaatgccatccaggagccagggcctggaatcagaaaccttaggaatctatctagtgctctattctactgcatcccagctggcacccaagccactggacaaaggccttccaactattccctccacttcaaggaggagaggagtctctgccaatagccatcactgccccagggccatggcaaatattgcctggctagccaatgttcacgcaatgtccaagggttctttagtcagcttatggtgaatgctgccagacctggggctctctcttcatggaagtaggctctctttggcccaaggcagatccagaaatgccatccaagactcaagtcctggaacaggggaccccaagagactgcttggtgctctaccccactgtggccaacctggtacctaagctgcaaaacaaattccccttcactcttccctctcctttcctcaagcagaagaagtctcctctatgtagccaccactacagggaacacgctgggtcacacctgaagctagcacatctctgagtctcacctaaggcccatggtgagtactgcctgggtatcactgctggttatttggtgctcaaggaactctttagtcagcaggtgatggattcttccatgtctgggtccttcccttcaaggcaggaggttcccttctggcccagggtatgtctagaaatgtcatccaggagctgggtcctgaagtggaggcttcatgactcttccagtaccctatcctattgtggctgagctggtatgtaagttgcaaggcaaagtcctctttagtcttccctctcatctcttcaagtggagaggtatctgtaccagagctgtgagctgtgctacctggggctatgggagggctggagcaaacactcccttggccactccagatggtgtctcactaggtcatgtgtccctcaagtccactggctcagagcccagcacaacatcagaacttgcccaaaacttttagtccttctggcctagattgccttacaagtttacttaggaccccagagcccttaagcctacagtagtggggcttgccagaactcagattccagccactgggataggcaattcccctctggctagagctgttctaaatgctccctcagtgggtgccagctgaattctgccaaatgttgctttctgctgtgacaagacagcactgactttcaatgcatagtcccacaaatcctgtactctccctccctgaagcacacagatcctttctccgcactatgtggctgctgctgggagctgagggggtggggggtggtattagcaatttaagactgtctttcctgccctcttcagtacctctttccgtgatatgaagttaaaaccaggtactatgatcactcatctgatttttggttcttatgaaggtgctttcttacgtggatagttgttcagtttggtgttccagcaggaaggataattagtgaaagcttctcgtcaaccattttactcctccttctctctagttgcaatttttcaaataattattcccgaatgcccccagattctccttaagtgacatttctaggggtttccatagtccctctactcctccaagaattaataaataaatgaagccccaggaggaaaaaaaagagaaaatacaaaatattatatatatatatacagtaaacatgaaatagaactattataatctaaggtcagcttataatattatagaaacaggatgaatccatgctaacaaagttaggtctgttctacagagtttaaaaattgagagatatcaaataaaaatactgatttctggcttctctttaaaaagatttctggaaatactatacctatgttttaacatgccaaaaattgtctggggctggggagcagttaatccctttgagagagtctgtgggctccagttcaccactcctggtcactgcctgcaacacttatatgtgttgcctactggacctctgtcagcgtgttgaacttacagccttgtatagaccaaggttgaaactttaaactctatgtttatgttgacaacatgaggccaaagatgaaacaaaaaggaagaaggatttgtgttctgagatttttaaaagcagaagaaaaataagaatatgacaaagagtatatatccagtttttctgtttcagtagctttagttaagtctagtttgcaaatggttttgtcatgatccgataggaaaggaatgtgaaatggttaataatatgcattaaattaaaactctctgtttatctaggtagcctggtacctgaatacagatggtaactgaataacaatgtcatagagttaaattttcaatgcgaagccatcattcaaatatgtgcttcaggtgctacagtttgatgccctacactgccctgtcaacaaaatgggtggttcctttatgctcaggcaaataggaacacatgagccctgtgtggaaatccaaaaggaatggtccataagaaagcaattcctgtattttatcatagactgttgtccctttcaaagccagggtattatttagtgtatgatctcatctctggagactagtaaaaatatattatttctagtaaatgcaaatttttactttagtattatgagaaaatggggacactttagaccataaaaagggacactttagaccattttatgctttggggaaaaagacttttaaacatgacatgtcatccaaaaaataaatagcttcataaaactgccccagggaagatgaaaaagttgtaagaataaaaatcttctgagacattaaatgacccacaaaatgcaattattgacaataaaattttgttcttcataatacttacagaacctctaaaatatcccttttaatataggtgaacaaagctactaccacatcatattagtttcctattgccactgttaacaaattaccagaaagttcatggcttaaaacaacacacatttattatcttacaaactctggaggtcagaagtcctaaaattgaggtgttttcagggctgtgttccttctggatgctccagaggaaaatccattatcttcttccacccagctgctaggggccatttacatgccttagctcatggcctcttcttccatcttcaaagccagcactgtagcatcttcaaatctctctatgactctgaccctcccccatccctcttatagtggcttgtagttacattgggcacctcctaagataatcccagataacatctcatctcaaagttctcaatttaatttcatctgaaaagtcccttttgtcattgaaggtaacatattcacaggttctgggggttaggaaattgacatctttagacagccattactctgcttacaagacacattggtcttgatttgacttggaacatacaccatgacagcaaggaaggtaatgagagtaaacaaagtgcatttaggtaactctcaaagttgtttcggacaaaactgaatcacataaaaacagaacattctattttgctgcaattttttacctttaatctactaatttatatttgaaataactgtttttagaaatatctttctttgaatgttgcagatgtgaatgagatataatgaaaagaatgaatgcacacttattgatcattgtactaaggtcattgaacaacaaaatctcatcaaatagttaagtattttaaataatataaaacacatggaagctttacccaaggagagacagtgatcttatttaatattctgtgtggctaaatgaaaccttgatgagaaaagggggccttcagatatagtaaaggttgcactgtgtgtgtgtgtgtgtgtgggtgtggtgtgtacgcatgcgtagtaacataacattcagtaagcatgcaccatgttccaggaacttttcttagcactctgtaggtattacttgtttaaccctcaccataacccagtagagcaattcctacaattatccttttacaggtaattacattgaggcacaaagaaatgacctaccccaaatttcaaacctagtaagcaataaagcttggatttaaacccaggtgttctgccttcagaaccaaaaattagaaaagcctaaaagtttcttttatctgttttaaggaaagaactttccagaaggaaagaactagaggaaaggtagaacacattgtggaagttctctatgcagatcaacaaggtatacagacttttactaattttcttcatatgaacccacaaacccagaagcaagcattattatctagatttggagctcttctactttgaaattgatagagttggacatgcacagattaataataataatattttctacatttgctgttgaaacacagataaatgaggaatgatcctagaaaaaactttacagatgcacacacatgcacacacacacacacacacacacagacacagcacagggaccccaaggtcactgtcttattgaactacatagcatgttaaacacaattactaccttttcttgggcaaagtctccatttttccatattatttaaaatgcttatgtatatgatgagattatgttggtcaaacagcataggacaatgttcagtaagtgtttgttcatttttaaaattttatctcattcacgtatggaaggttcaaagaaagatgtttctgagaggagttattaaacatttaaaaagtaaaagtaaaacgaaacaatttatgtttgagaaaaaaatgttgtctatgaaatgcttcccactaaaaccatttgtttcctgttttccctcttatctcaaggatcccatgaccgagacacctcatgccttccagaagctgaaggtgaaagctcactaagattaaacaactgggaaatgttaaatgaaaaagtatcacagctgagacaaagctcctcagcctcagcatgtttgtcagtgtgcccaactgatgtagtttggctctgtgcccccatccaattctcatcttgaattgtaatccttataatctccacatgtcaagggagggacgtggtgggaggtgattggatcatgggggacatttccctcatgctgttctcatgatagtgagtgagttgtcatgagttttgatggtttcatgtgtttgacagttcctccttcacacactctctctcttctgccaccttatgaagaaggtgcctgcttccccttcacattccatcatgattctaagtttcctgagctcccccccagccatgtggaactgtgagccaactgaacttctttcctttataaattacccagtctcaggcatttataatagtgtgtaggctgggcatgggggctcacgcctgtaatcccagcactttgggaggccaaggcgggttgatcacaaggtcaggagattgagaccatcctggctaatatggtaaaaccccgtctctactaagaatacaaaaaaattagccgggcgtggtggcgggcgcctgtagtcccagctactgggaagactgagggaggaaaatggcgtgaacccgggaggcagagcttgcaatgagctgagatcgggccactgcactccagcctgggtgacagagcgagactccacttaaaaaaaaaaatagtgtgtaaacggacgaataaaccatctatcacttttcacacaaactttcctacctgtactttgtatccaaacctttgcctttttaatctcctgaaagaataaggaattgttgtttccaatagagtggcttcttcatacaatttttatgattaaaactgatattctacagttggttattgatagccccatacctttctgtctaaggcaaaggatgaacacatggatgcatatccatatgtaagtgcccaatgagttcaccttgcccattgcctagacagagcccatttatcaagacaggggaattgcaatggagaaagagtaattcacacagagcaggctgtgtgggagatggggagttttatcgttactcaaatcagtctccctgagcatgcacggatcagagtttttaaagataatttggcaggtaggggcttgggaagtggagagtgctgattggtcaggttggagatggaatcacagggggtcgaagttaggttttcttaatgttttctgttcctgggtgcaatagcagaactccttgggccaaattaccggtctaggtggtgtcagctgatccatcaagtgtaaggtctgcaaaatatctcaagcactgatcttaggttttacaatagtgatgttatccccaggagaaatttggggatgttcagactgttggagccagaggctgcaagacccctaaattgtaatttctactcttgtagctaatttgttagtcctgcaaaggcagactggaccccaggcaagaagggggtcttttcgggaaagggctgttatcagttttgttcagaatcaaaccatgaactgaattccttcccaaagttaattcagcctacactcaggaatgaacaaggacagtttaaggattacaagcaagatggagtcggttaggtgtgatctctctcactgtcataatttcctcagttataattttgcaatggcggcttcacatacacaaacatacacacaatgtcaagaaaaaacaatacagaaagaaaagctcacctcaacaggcccaaatttcagtaacataaaactcatattatctaacagaataaatataaaaattcatgtaacatttcttacattatagggcaacatttgaaactggaagatgttttagagactatcttgaccaccccttgaattttcttgttgaggaacttgaagtttagaggggaaaaatgttttcaaaagagtcgggataatgttagcctgtgtcagcactaacatctgactaacaagtcagattgctgacactggcccatgctcacaccttaataataatgacaatttaatgacaatgggactaattactaataaatttgagtattttctatgtgctaggcacttcacatgcattagctcatttatattttccaaatctcttgtgagttagattttattagcatacctactttaaaggtgaaggaactgcagctcagaaagttaaacttcactaaggctgcatgtttagttgatggcaaagctgagtttagaagccaaactgaccgtaaaatctgggttcttaacgactatgcagtatataaacacccttttcatgtataaacatgaaaagatgctaatgcctacacaacacaaccacaaacacatacacacacttacagaaatcactaaaaataggagattcttggctactttttttctaatttttagtaaagtgttattttaatttagttcccttaggacatttttatgaccttttaattcttgtctccttaagcttttaccgacatctaagaaagaataccatttcactggctggaaccactatctttttaattagtacaggtggcaaaccagattacgatgctagttagcaacaacagctacattatctttacattagtgcactttcattgcagtttagctcttttaaaatctcagaattgctgtctcagttaatattttttatctaagcagtcacgacagttatcaaatccatctcactagattaaaactttgcaagttttataattgatacattactataaataggaaaatcaaatgctttaggggtagatcctgaaagacaaaaaaattttctagaaagcacaatttctgatcctgaagaaaaatgtatatcttactgtttttctatatttatgtcttctaagccatgtttgttggaatagaaaggaaactactatgagacagaggctttgtataatcatttcttttcattcttccaacagtgttaccaggtaagtattattacccacatttgccaggtagtttgtgggaaatagaggctcagagagaataagtaagttgccaacttagtaaatggtgaatctagatttgaatccagattttctctgacctaaatgctcatttcactctaacacactacagccaggagagaacccacttcagtatgagtgttacagttcatgtctgttcagagtgcatattagtggctgtagctttcattgaatctgtataaatcccattccccaatatcagtctccaaagaaatatctgaactccagaaatcctaacaagtggtagaggtggggaggaggtgcaggaggtcatgagtagaatgccaaaaagcctttaatctaaggcaatttcacatataagcttcagacaaagctaaaagcatctctaatcttaaaggcacttacaaaaggtcattttaaagttgtcagtttcctgtttgtgaggtcctcagaaataagaattcatcagtggtgaccatgacaacaaaccttcttcccatcaaagcctccccacacctctgctcagcgattagccgagtagaaaggagatacggacttaccatatttctaaagatcagtctttcagactagctttggtttgaaattttaaggactatatgaatttctaattatagactttttaagtaaatcattgttaaggcttaacaggcacaaattactcacatctttatgacaaaggaattccaagtaacaaatcatttttaagtcatcataaagctaagtgtattcaaaattacatttgcttaaggaaaacaatttaattcaagcgaggtattttgacatggagatttttgtcctttggatatgtacatctgtaattacaaatatttaaataagctttcatgaccattatgtccatctcctaaaaccatgaaaaggacactcatgaagggaaacatgtcttgctcacagtagaaagtacaggagaaactgcttgttcctccttgattccagttatttgcctgagccttcttagctatctatatctatgtcctcagcctccacccaccagctcaatttggaatgagatcactgaaaggttcatcttcactttgaagtggagcccataccaactgccatatgagtccccaggcccacgtgtccacatttctcctaagcaccatctttcaactctgggctctttttaatctcttgaagagcaatttaaaaaatacatattagctgttgaaatatatatttgtcataacaattctattttatagatttctcctaagaaaatattcggtgatgactatattcaaagatgtaattacaaggatgctcctctgtgggttatttttaatttccaacaataagtgatggtttaatcattcaaaatgagtttgtttaatcattcaaaatgaggttgtagatgtccatggcataatgtcattgaaaaccacagtttaaaagagtatacttgatcccatctttgtgaacgtacacagctatacacgagcacacacaggcacacacacaacatatcaacaatgtacatcatgggaatatagatgtattccatatttttctttttttcatatgtagtttttattgttttctatgataaattttgtaataaacaatgattcatttttaatgtttttagttctgtataaaagatgaaagaaagagcatagaaacaagaataaaaatgagatgaatgaaacatttcacctcctccaggccattctcaaatgccacctaactgatgccgtctgtttaaaattacaacctccacccttgacaagtctactccttactttatttatctccatagcactttctgccatctattatatcatatattttaattgtttactttggttttgtctgttctcatacaatgtcagctccttgagggcaagaactttgttccagagaagtgactatccctacacatttgatgcgaaagagagagagagagagagaagagagaaagaaggaagaaagaaagaaagaaagaaagaaagaaagaaagaaagaaagaaagaaagaaagaaagaaaaagagagagaaggaaggaaggaaggaaggaaggatctgttgactatgactataaaggaatagctcaggccagtaccaaatatcaagaatgttagactcactaatgatcaaggcttataaaaatgtttagaacaacataaaagaagtaacaaggagagttaaactatattctgagcaagaagatgaaaatgtgatagaccactgattaaaacaatacagggttagatacaaaaaaaataatagttctcccccttactactttgcttttctctactttaaagcatgacagtctgtgaaaaaaggctgaactagtgctgccgtaaggacactgaagtgagaaggatataaaagacctcttagttgctttacgtgagatacagcctaggtgaccctatcaccgcttctaggaggactttcatctgctgtagacacctacaacacgctatgctgtcttggtgtaaaatcacaatttattgtaattaattaccactcagaaggtaaaacctttgagcataagcattatattctattcattgttgatgtctcagtgcctatcctagcacaaagtcctcagtaaatacatgttttattaattacttaactacaaatcagggtactgagaaaacttgtaaattaaattattgatccatgctaacttttttttttttttttttttgagacacagtctcactctgtcgcccaggctggagtgcagtggcacgatctcggctcactgcaagttccacctcccaggttcactccattctcctgcctcagcctccagagcagctgggactacaggagcctgccaccacgcccggctaatttttttgtattttttagtagagacggagtttcaccgtgttagccaggatggtctcaatctcctgaccttgtgatccacccgcctcggcctcccaaagtgctgggattacaggcgtgagccaccgcacccagctatgctaacaaaactttaaaactcacatagaattagacaagtaacaaaagatagagagtagacaattatccgattttacaaaagtagaacaaatatttagcaaatcattcactgatattttattgttgatctcaggccaaattctatactgaataattaaacagagactttgtaagtccttcagaaaataagctgtgatcaataggtactgtcacaggttcactcaggaatatttttgccccatcagccagattttcttcttgactagggttagtagatattttacagaaccatcagaaacttttgatttctgcaaaagcattgaacaacagctcacataatatctatgtttacagtgtcttgtacataacagatgcttgataaaagtagattgggcaagtgcttataaagattattagtggaatcatttccactcaacatttttcatgatgttttttctttcttttattgatccatgcttttcctctactctggggtatttactttttctcaccttccagatctgccaatcttttcttgaaaaagttatcccaggtgtctcatataactctatttaattacaggatttaagaatttatttatataaacgactggaaaacatggaagcttgatttcacctatcaattttgctttgggaagacagacgggtcaagggaaagtgatgaaacaggtgctagaggtcactgatggatctgaattttcttgtattttctctgacgttccttcaggctcaaactttacttgctttcccattgcccttttgctatcctggtatatgcataaaaagaatatcaatgtgatagatgtgttactctaagatgttgagggttgaatgctctatcactatgacatcattctattaaaggagaaggtagtggataattttttatttatatgtggtaactgccatataaaggcattagacaccaaggtgcagtcacacaaacttgaatttacttcctccaactctctgatacatatggatgctctgagtacaggtatgcatgcacacacatacacacatacagctttcacacttacaaaatgatgcagaaaaccctgcatgaattttctttcccttggatatgcatgctcatgtagaaaagcacttgactgggagttaagaggcctgaattcttatcttgtctctaccattagcaaattatataattgtgagtgagtcattttcctccctgaactttagttttctcataaaataaatgaggtttggtagaggaaattaagtgtttacaaagttgttggaagggctgaaggaaaagactcctggccagtgtctcgcaatgtctctaaaacaacacagaactggccccctaaggaaagttctacccctgaggccaccatggctggcctaggtctggagctatccattcaccgagaagcagcctatgaacactgccaagctggcaaatggacacccgaatcagcaatccagagattagcatcaggttaagaaatggccactacacccactaattattggcatctagaagactgaaaaatgaacactaaaatctgctgttcactaaaatcacatccttgctggctagcactgacaatcaggacaacaggcaagaggcttcttcctctatttttcctttaaatcccatgcaagtgcatctcatcagtaaaatttgtgtcacattcagatccttcgttgcatggaaatcttgataatatagtttttagcactttctagcctctgtgatacagatgagaatatagaacagattaagactggatgctaaatgctgaaaaataatgtttagaagtaatatgttctgaaaatagaaaaagctgcttcaggatctagagagttcccatcaatggagatggacaaagcagaaaccagataatctattttcagaaatgttgtaaatgagactgattttgaatagtaatttgcagttcttgttgcatatttcagtcctctgatgctattcccaaagattctttttcagtgggcctgtggtaggtcccaggaatctgtaatgttacaattcccccaagtgattgtgagatatagctgtacttaaagaaccacttgactataatgtcaaacatcatctccagccctgtttatttatgactcctcaattctagatctttaggaccatgcaactgtatgtgccacacacattcctagtacaaggagccaaatgttgtcttcagtcgaacacagattttttaagaaactctagggtataaactggtctattattctgtttattatattatttttaaaaggaatctgtttaccaactattctgcagtaacaaaaaatagctccaaggagattctaactgaaggcatgctttcacatgaagaatttatgactacagtgtcctgaggtaatttattttttcctgtggaggatttccaggccgatacaataagacaagaatgctgaacacctgctatataaaagacattttaaggttttgtttatgaacttagttcatgttgaagatgtctgcagatttatctcctgcacgagtatcaaatccaatgctcttgtatgcttgcccttgaagggttggtaaatgtttggccgaatagaacatcatttataaacaggttttattactggacttacagttggtcagttaccccaaatgattattctatacaatttacatctaaagtccagatttgttacactaggaggaatgtcaggatttatgttgggattgcaggtcttggtacagaagacgtagcttgaaggtccctgttatgtaacagagagatttccattttagcaggaaaacatgcagttgatctgctattaggaactgaggatcttaagggaacccacaaatagaaaatctggctttggtcaatagcatgcttatactttgggaggggtattgagagagataggcctataactgcctttttgcaactatatttactttaattttcttcatcatatatccacccaaggccagttttatattctgagggtaaaatacatttcagattttttaaaaagccatggttcattagtgcttggtgcttgacagtataaggttgtatactctatacacataaaataaaattataagaattaactatacaaatgtatggcagaaaccacatctaactctgcatccggctactgacagttttcttttttgttccagtttctttaggctacagtcatatcctaatgatgactgtcttattgccctatttttttttagaatttttcaaaatatatgaaccaaatgtaatactatgtcatatcaaattttagatcaaaattattaggatgccaagtaaataaaagaggaggaaaagagtttatccaatatggtgagcagagtaatagccctgaaatatgcccataccctaattccaggaacatgtgaatgagtatatctcacatggcaaatgaaatgtgaagatgtgattaagggtatggatgtgcaatggggaattaccctaaattatacagtggtcccaatctcttcacatgagtccttaaaatccataacctttcccagctgccttggttagaaatatactatattggaagtgctcaatctgccattgctagctttgaagataaaggaaaggagccacaatccaagaaacgcaggcctttccctagaaaatgtaaaaggcaaggaaatggattattctttagaaactccaaaaaggacgtcctgccaacatcttgattttagctgacagaggcgtgtgttggatttctgccctacagaactgcatagtaatgcatttgtattgttaagccactaagtttgtagtaacttgtttcaacagccataaaaaactaatagattcaaaaccttttatctccatgattgttcctggtctcatcagagcagcagaggctaataacttcccaataatagtcaataaagtaatttcacattttaaaggaagtttagctatagaggaaggacatagagtttgaagttgaagacaagactcaatgaacaagtagcaatgtgaccttgagaaaaacctcaagttttctgaggcttaatttcatctaagccttgcttaccttgcagaatagttgaacatgtcatatttataaggggatataaaatcctttgtatattataggttaagtatccctaatccaaacatacaaaatctaaaatgttccaaaatccagaacatgttcagcgctgacatgatgtcacaagcagaagattccacacctgacctcatgtgatgaattgccatcagaatgtagccaaaactttgtttcatgcacaaagttacttaaaacactgtataaaattctcttcaggctatgtgtataaggtgtatatgaaatatgaatgaactttgtggttaggcttgggttccattcccaagatatctcattacatatatgtaactattccaaaatctagaagaatctgaaatctaaaatgcttctggttccaatcatttcagacaagggatactcaacctctattctctataaacaatcatattgcccattaattttttctccaacaaaatatgtatttaagttaaagactggccaaatttttaatttaggatcttcaaggtggaaaatatccctccagtgattaggaaagacacaagaagacaataaagattttatcactcacacatcttgggtggggagtgtggtacacagcacacctgaagactacacatacacaggttaagcagaacaggcagggagaaataggaactgtgggccaaagcctttgttgaggctaggccattatccaaacaggggagttttaattggtgggtttaaagcaagtaggcatgagttccaagaggtcacgctgggacagagaggtagtcactatggcataactgcacagctttagggatgtggaagtcagaaggttactcaagtaggtttatctagctgtcccagaaagaagtagtcatcagaaagtgataaggcagatatctggattggccacatagaggaaatgggaagaggtgtagaactgaaaactgtgtgtcaatggtgactgaaccctgcttttggtatggagaagttcaacttatatttaaaatggatgccaggacaacataaaattataaaaacgtattacacaaactgatggcagacattattcattgtctcccaaatgttctttcttcttttctgctcttatagaaaaatcacccaagttttatcttaaaacatggcaatccagccacagactccatcttccagggtcatttgcagccagggattattaagttctaaccaatgggacatgagtggcaactgaagtgtgcaaatcccagatgatggcttcaagaagatgttactttctacttcttcttgtcctgttcccacaggctagagtggctgtagtggcagagtcagccctctctaagggagatcactgggctggggcagggctagcaatgacacctattcatttacttattgtctatagcaaaatcagcattgagttattgggacaaaaatcatatgacctgccaagactaagatatttactcttagccctttacaaataaagtttatttgtacctcccttaggcaactggagatcaagaaaagaaataaaatctgggtctctggacaacctcctggagcagagatattcttccctgctaactacctaccagcttggactttcaagtgagctagagataaactttatacattgtttattcatctattacattgggcattataaaatagaaacattaatagaaacaatgatgatgataacagctagcgcttttatggtgcttattatgttatagggctctcctatgggtatgtaagatttgtacacacacaaatttaattccctgataactctatgaggtaagtactattttttattcccacttggcagatgacaaaactgaggccaagcaattaagtaacttttccaaaggcataccaaataggagatagagccagggtttggaccctagccatttggcacctacatctctgcccttaaccatatattatattgcctcttagtagactacatgttttattttgactctgaacaaattagtcaacactcctcaaattcattttaccaggagacctattagaaacaatagcttaaccccaaaatattgacagatggtgggttcgagttagaaaaataaatagcaatttattttaatatcctttttagtttatatctcatcttcagactttttatcttcagactccaattgcctaaattcaatattttaattaagcatagcaatagtcctagttaaattagggcaatagagaacctatttggaaatgaaaacaaagggaaaataagataaatgttcaaagaaatgaaatgaagcccgagatttcatgagaaaaggcagggtgtgggaaggggagctaatgaatgtataacctaaaatcaagtacttaatatgctatagaaactaggcagaatgcttcacctccatagctacctgcaagacattcttaaagttagaatccaaagttcaggaaaattgagctagttgctcagggtcacagaactagtcaatgaaactcaagtctttgttacctcaagacaagctcctttacactagaatacctcaaagagaacaaacaaaaaccaattacacccctgccccccgccaaaaataagaaccttagtgatttcaggcaagaaaaggtttaagaatgaggtgaattacttacagcttctgtagatgatctggcaggtattgcagaaggctgtgatgcacaggactgcctaaggctaatcaagtgtctatgagagagagaaaaaaaaaattcataaatggtgatgcaagcaaaatcggttaaagttcatagccccataataggtaccaaccagatcacgaaaaagagaagttatatctgtgaagaaattgttaagcattcaagaaattctctccccagttggcataactattttcactcccgaggagaagattagtttctaataagctcttcattattgattcctctgagccttgaagttgccctaaagacggagaatactgataggttgagccctattacagttgggaggttaaatgcaagcactgtggttttctcagtcaactcattaaaaagaaatgacctgtagaattaattcacagtaaaatgttatcccctagttccatattttccagaattagtcagtaaggagagataaacattattatccctcaaaaatgaattggtatcatggactcaaagttggaaaggccttttggaaatcatttattcattttatagatgagaaaccaaattattcaaagacatgggtggcattatgctttccttgttcttaaagtatgacatgagtctctgttgccaagcatatttcaaagcttatcacatgattatataccctctggagttgatcttgtttgagccatggatcattattcagaaatattcagaaggaaagacacgtgtataatacacacaaaagtcatcttctccagaagtgaacagaatggatattcttggtatctgcttggtgtggttaaataacagaaagtggtatagagcaatatggggcaataagtggcaagatataactgtataataaagtataacctcattatgtgtggctttgtagacaataaactagaggttggctttttaatgcagttcaggtcaccagaggagtttggcaggggtatgacatggctgattttaatcatttatcctttcattcattttatatcgtatattagtctgttttcatgctgccgataaagacatacctgagactgggcaatttacaaaagaaagaggcttattgggctcacaactccatatggctggggaggcctcacaatcatggtagaaggcaaggaggaacaagtcacgtcttacatggatggcagcaggcaaagagagagagagagcttgtacaggaaaactcttctttttaaaaccatcagatctcatgagattcatttgctctcacgagaacagtgcaggaaagacccacccccataattaaatcacctcccaccgggttcctcccatgacacatgggaattgtgggagttacaattcaagatgagatttgggtggggacacagccaaagcatgtcatcaagtatagttctaggccctaagaaaacaatagactacctttccagcccacaagaacaacatagtctatttgaggagacagaactataaaatgtaattgcaatacaaagtaacaagagaagagtaagaaagtaacaataaggcctggataggcagaagaaagtcttcagggaaggaatagttaaatatgttattctgcaggcaaagaagactacagtttcaaaatgatttcacatatgaactcacattttattgtcatatgtaaaatgggatatataggtcaacccacaccacttaggaaactggtactcagggaagctgagtgactgtgtgagaccacacctcaacaatggtacaatgttttaatcctgagcacagactgatttatagcagctgcttccagttgtactgagaataattgtaaacatcaccaaaattaagtagtaaataattttgtgatttattaagatatctagtatgatctgaaacagaatgatggctttttttttatatcaaagttatcctgcaggaggctgggtgtggtggctcacacctgtaatccttgcagtttgggaagctgaagcaggcagatcatttgagcccaggaggtggagaccagcctggacaacatggcgaaatgccatctctacaaaaaataaaaaaattagtcaggcgtggtggttcatgcctatagtaccagctacatgggaggatgaggtgggaggatcacctgagcctgggagacagacgttgcagtgagcaaaatttgcaccactgcactccagcctgggcaatagagtgagacttgtcttcaaaaaaaaaaattatcttgggggagaaaattcatgaacaactgtgatggttaatactgagtgtcaacatgattggattgaagaatactaagtattcttctatgaaggtgttgccaaaggagattaacatctgagtcagtgggctggggagagggctgacccacccttaatctgggtgggccccacctaatcagctgccagtgaatatgaagcaggcagaaaaacatgaaaaggttagactggcttagtctcccagcctacatttttctcccatgctggatgcttcctgccttcaaacactggagtcccaagttcttcagctttgggactcagacaggattctttgctcctcagcttgcagacagcctattgtgggaccttgtgaccatatgaggtaacactacttaataaattcccctttatatatatatatttatctatctatcctattagctctgtccctccagagaatcctgactaatacagattttggtaccagaagtggttctagagaaacagaatattaaggatggaattttttagttggttttggggtttctggagctggttgcttagtacaattagacccaaaaatgctaagcactctatttataatagtatggagaacactgatagtccttagtatgaactgtttagagagttagacaaaataaatgcatttgacactcctgatccaccacttgtgagaggcaaggagtttcaagactctatacataatacctttggccatctgtggagaacaaggaacataatgaaactggttggttgctcctaagttcactgggcaaagtgatgaaagaaaacaataaactcagggattctgtctcccagcttcagaagcagatactgagcttcaaatcgtctaagattgccctgagtcaaagtcttatctactggagagaaagagctgaaattgtggagaagcagacacaagctcttatcatgtgagtggctgacttgcaacaaaaagtgcatgcacagccttgccaggtgtctatcattaaagtgaaggcattgcttggattagaatgggaccttggaacttggaatggggttgtgtgaaaggaccctgataaagctggagatactgggcgtgtaaagtctgaatgaaactttcttgccagaagaaagagcttccccatccccagaagtggcagcataccctctcggacccatgctgctatcagcccttccacttttgcctgaggaggtaaaccctgtgctgcctgaggcaacagtgatggcctccactgaggcagttgccaggcaagataatgttgattctcctcaggagccaccccctgtttgcttctagacctataactagactaaagtcccaaggaacccctagaggtgaggttgagagtgtgacccacaaggagatgtgccacactgaaaaagaactgcttgagttttctaatttatatgaacagaaatctggagaacaggcatgggaatggatattaagggtgtgggataatggtggaaggaacatagagttggaccaagctgaatttattgatttgaacctactaagcagggattctgcatttaaagttgcagcccagggagttaaaaaacattctaataatttatttgcttggttagctgaaatatagattaaaacacgacccattgtgagtgcctggaaatgcctgatttcctttggcttaatatagaggaaggaattcaaagccttagagagattgggatgatggagtgtattagtcactttatacctactcatcccagctgcgagagcccagaagatatacccttgatgaatgctttacaaagtagatttatgaggacagcacctgcatttttgaggagctttataattgctcttctctgtatgtcagatctaacagtgggaaccacggtcactcaactacaaaatttaaatacaatgggaataatttgatctcaaggtggcaggggccaagtgacagaacccaaccgtcaaaggcaaggtgggcatagctaccataatggacagcagaggcaaagcagcaatcagaatagtctgacacgtgaagagctctggaattggctaattaatcacagtgttcctagaagtgaaatttattggaagcctactgcatttctacttaatttatataaggaggaaatgtccaggtcaaatggacaaaagaagaatttaaattataaaaacagagaatcacggcccctcaatcaatttccagacaagccagtttacagacccagaaccccttgaatgaaagggaggctgggtcctcttgaggaaggaccccactacactactgacaatttgtgcagtgaatctttctcccatccttccccaagtacacctctggccttccaccagggtagctgtgcattggagaaagggaaatgatcagacatttcagagactactggacactggctctgagctgacgttgattccaggagacccaaaacatcattgtggtcctccagttaaagtaggggttatggaggtcaggtaatttgtagagttttagctcaggtctgacttacagtgagttcagtttgcccttggactcatcctgtggtcatttccccagtgccagaatgcataattggcataaacatatttagcagctgacagaacccccacatgggctccctgactggtagggtgaagggtattatgatgggaaaggccaaatggaagccattagaccttcctctacctagaaaaattgtaaatcaaaaaggcaatattgcattcctggagggattgcagagattagtgccaccataaaggacttgaaagatgcaggagtggtgatgcccaccacatccccattcaaccctcctatttggcctgtgcagaggacaggtggatcttggagaatgacagtggattatcataagctttaccaagtggtgactcaaagtgcagccactgtaccagctgtagtttcactgcttgagcaaattaacacatctcctggtacctggtatgcagctattgacttggcaaatgcctttttctacattcctgtataaaaggcacaccagaagcaatttgccatcagcagtaaagactagtaacatacctttactttcctacctcaggagtatatcaattcaccacaagatatcacactggtccattatattgatgacattatgctgattggatccagtgagcaagaagtagcaaacacactggacttactggtgagaaatttgcatgccagaggatggtaaataaatccgactaaaattctgggaacttctacctcagtaaaatttctagggctagagtggcatggggcatgtcaagatattccttctaaagtgaaggataagttgctgtgtttggcccctcctacaaccaagaaagaggcacaatgcctagtgggcctatttggatttgggaggcaacacattcctcatttgggtgtgttactccagcctatttattgagtgacccaaaaggctgccagttttgagtggagtccagaatagaaggcggctctgcaacagatccaggctgctgtgcaagctgccctgccacttggaccatatgacccagcagatccaatagtgtttgaggtgttagttgcagatagggatgctgtttggagcctttggcaggcccccataggtgaatcacacaggaggcctccaggattttggagcaaggcccttccatcttctgcagataactactctcattttgagagacagctcttggcctgttcctgggctttggtggaaactgaacatttgaccatgggttatcaagtcacaatgcaacctgaactgcctgtcatgaactggtgctttcagacccaagtagccataaagtgggttgtgcacagcagcattccatcatcaaatggaagtagtgtatacatgatcaggctcgagcaggtctggaaggcacacgtaagttacatgaggaagtggctcaaatgcccatggtctccactcctgccaccctgccttctctcccccagcctgcaccaacagtctcatgggggagttccctatcatcagttgacagagcaagagaagagtagggcctggttcacagatggttctgtatgatatgcaggcaccacctgaaagtagagagctgcagcactacagccactttctaggacatccctgaaggagagcaatgaagggaaatcttcccaatgggaacaacttccagcagtgcactttgttgtgcactttgcatggaaggagaaatggccagatgtgagattatacactgattcatgggctgtagccaatgggttggctggatgatcagggacttgaaagaagcatgactggaaaattggtgacaaataaatttggggacgaggtatgtggacggaactctctgagtggtcaaaaaatgtgaaaatcttcatatccaatgtgagtgctcaccaacgggtaacctcagcagaggaggattttaataatcaagtggatagaatgacccatcctgtggacaccactctgcctctttccccagccacccctgtcatcacccaatgggcccatgaacaaagtggccattgtggcggggatggaggttatccatgggctcagcaacatggacttccacttaccaaagctggtctggctatggccactgctaagtgcccatttgccagcagcagagaccaacactgagctcttgatatggcaccattcttcagggtgatcaatcagctacctggtggcgggttaattatattgaacctcttccatcacgaaaagggcagaggtttgtcctcactggaatagacacttactccggatagtggtttgcctatcctgcacgcaatgcttctgcaaagactaccatttgtggactcacagaataccttatgcactgtgatgttattccatacagcattgcctctgaccaaggcactcgctttatggctaaagaagtgcagcagtgggctcgtgctcatggagttcctggtcttatcatgttcctgtcatcctgaagcagctggatcaatagaacagtagaatggccttttgaagtcataattacaaagccaactaggtgacaatactttgcagggctggggcaaagttctccagaaggccacatatgctctgaatcagcatccagtatatctcccatagccaggattcatggatccatgaatcaaggggtagaagtggaagtggcaccagtcaccatcacctctagtgatccgctagcaaaatttttgtttcctgtttccaggacattatgttctgctggcctagaagtcttagttccagagggtggaatgctgccatcaggagacacagcaataattccattaaaatggaagattggcacctggacactctgggctcctcctacctttaagtcaacaggctaagaagggacttacagtgttggctggggtgattgacccagattatcaagatgaaatcagtctactactccacaacggaggtaaggaagagtatgcatggaatacaagagatccattagggcatctcatgtcctgtgattaaggttaatgggaaactgcaacagcccaatccaggcaggactacaaatggcccagacccttcaggaatgaaggtttgtgttactccaccaggaaaaaaaaaccatgacctgctgaggtgcttgctgaaggcaaagggaacacagaatgggaagtagaagaaggtagtcatcaataccagctacgaccatgtgaccagttgcagaaatgaggactgtaattgtaatgagtattttctccttcttttgctaaaaacatgtttgtgcatgtataaccttgcactaaaacaaaatcttcattttatttcctttctcctgtatcatgtgacataagatttatttagttcatatcagcatttaagcattgttaactttatgtattagcatttgggttgtggattggtgtgtttttggttgcaggaagcatagttgtattatgttaggtataattatggccttataattgtctttatttgaagattatgtatgatctcaggagatgtgtatgggttcaaattgacaaggggtagacttgtgatggttaatactgagtgtcaacttgattggattgaaggatactaggtattcttcagtgagggtgttgccaaagaagattaacatttgaatcagtgagctggggaaggcagactcacccttaatctgagtgggcacaatctaatcagctgccagcaaatataaagcaggcagaaaaacatgaaaaggttagactggcttaggctcccagcctatatctttctctcatgctggatgcttcctgccctcaaacattggactccaagttcttcaactttggtactcggactggctcccttgctcctcagcttgcagatggtctattataggaccctgtgatcatgtgaggtaatgctacttaataagctcccatatatatatcctattaattctgtccctctaaagaaccctgactaatacaacaattaactaaatgataaaattatttttctcatagagttgtaaggattaaacaagaaaatagtcttcctatattatgcaacaattctgagaattatggagacctgaagagtcccagccaccctcctaagacaactctaatgtattgcttcttctgtggctggagctggaagttgggtattccttgaagggagtaaacaaggtccaggatccacacataaagagacagcttaactttttcacttctgtgatgcatgacagcctacgccctagtggaagagagccctaagtgtcttagagagaatttgtcctgcaagatctaagggttctggagaagaagtgcagacctagccaacatgaacatccctggaggaatcctgatttttgtggccttcagaggaactggagagataaacagatcgaccaaatcctctatacccataaagctggcagaatgtaagattttacagccactgagaatggaagtagaaagcctattttatgtccttgagtggagactagcagaatacctacaagtagagtccagtatgcagccagcacagagttgcagagattcctgtgcttaggaagcatcatttatatgtttgacagaactgtgttaacctgagcctcagtgagtaacacaaaggaaaataacccagccagagaggagtatagaaataatccagaacaagaaactcctaggaaaacataactgctggaatatggaggtgggatcttgttaaaaaataaaattattaataaatgaaatttaatcacagcacaaataacactttctgaacctacaaaccttgatttttgtcataaaaagtttggtaggtgaactgaacaaataggttcatgacactttcagataataatgacaaatctacatttatcatcccatttatataaaatcttgtgtgtgtgtgtgacagagagagagagagagagatgaacagaaagatactcatcaaaatgttgatggtgctcatctcagaataccctaaaaagggattcatgcttccttcaaatttttgtataccatataaattattctactaacacatataatcagaactgtctatgcaatcattaattctatcttcaatcaaaaaatactccaatgttattgaaattaccagtctatttgtaccccacaggatagaagacatgaaagaataaaaaccgtaagaaagcttggctgctagtgactttatataagaggaaacaactataaaataaatctttttagcagaacaattggatcttataacatgcatggatgggcagctgagcatagaggctgaggtagtgcattgatggaatttccatatcatcctagaccacttgtatcaattctaaaccacagaatactgaacatgaccatgtttccactgattcactcaagtgttgttcacatattttttagccttctcaaaagagaaaccactgtgttttggttcctaactttgctagatataaaaaatatgaatcattgtataaatcattaaaggaattaaactttctttcattttaggaaaggttattaaaatttacaacttctgaatgtgtatcacttattaaatgatggaccataaatgaatgtatccaatcagaaattgacaatgtcctcattaggtactgttcacacagcgatacttgtttatgtcatatctcagaactgagaaactaaactgtagtggtacttaatgaagcactttataagcaatagaaatcaactgaaaaagtggatttccagtaattaccatgactaatactaatgaaaaatgtctctaaatggagacacgacaagggcataaaatttgaatcagattatgcaaaaagtcatactcaggaaacaaacgtggaaagattgcgacttgcgtcaggtcagttgttagcaaagagcccattagtcctcaagctgtatctgccttaaatcaatccccagaaaatacttgaaataaagaagcacacagcaaactgaaacacccacaactggaaagagagatgtcattcatagtaattataagcagatatttctgcaaagtacattcgtgtagaaatgcccttattaacttctatgcagtcaacacatatttatagatctaacacagtattgagacaaagtggattactattcttagtaattaataagactaagtgattattattaataagaatatgggacagagagatttatgtaggttatttttgctattacttatttttgatctagcatgactttgtactttctttttataaaagatccccacatggctgtgagaaacacttttcttgttttttggatggaattgacgttgcttcccacattgatggtcattagccttgggctggccaataaaagcacttcttacagctgaccatagtgattacataactgaaacccagtcagatcatctctatggcttgacacgtggataaagagaaagcatcactcttgttatggagttaaaagctataaatatcatctcaatcttgagtttctggtcactatcattcctgccacagagttaaaaaaggccaagaaaatgaagttgatactgaggaaaagagagtcaatatatgaaagagggagtggaaaagaaagggtagagacgagaggaagcggaggggagtgctgggcaacacttgaaacccagatccagcaatgactttccagctacattagctaaaacagcaaacagcttctttatgaaactgatatagtctgaggttcatttattttatttcaaaatcaaatgatatagtgtgaggtgcaaatagtagcccagaattacatagcagagtttgaacaacagggaaaaaataccaaccacatcagaaaagaagaattcatttgcccacacagaaattatttataggaggcacttgaagtaaatctcattgtactatataaaatatataaatacactgtattttatttatagtagttagatcttattgtttatgtagttatatactatatattatatacataatgtaactgtatagaatgctggataaagctctgtagctcttctcatagattaaatattactataagattagattaaatcaccaattcatttagctaataatgcaaaaacatgtcaaatataggtggcaacacagggaggggacatatgcaggatttataattatgcgtggcctaagccctcctaaggcatccagttgctatctgcattgtcattacaactaggattttccaaaagataagaaattccatttttgctatcccaattccatcttatactctgggcttacctcacttttctgaacggactaacaccaaatgtctacgccttttggtttcagagaattatagcaggctatccttcttcttaaaatctagcatcatcaagccatgcccccctctgaacacagaaattagagtcattctccaaatgtcattgattaatgtctctcctttagatttccagtgttctagaaagcccattttcccccagtccacaccatgactctgatttaatgcccttttcatacagagtttggtccgaaggtgaagatcacaaatcaattcccacaaaaatttaatttaaaatgcaatttccatcattctaagtcaatcttttgtttttgtgttcttaaagtctcaaattaaggaaaaaattacttcagatattcttaatgatggagatctcaaacacacatctaagataatagtttcaattaaatttgtagttcccaaagaagccagattaattttaaaacattccatacaaaatatggtctttaatgcaattcttttcagagtgtgtcatatatcaccactaagtagagctacatacttatacattggtatggaagcaaagaacagaatattaatttaggcatgttggagaaaccgtaagttacctcaatcgtcatcagaatcatcatctttatcatcgttgcaatgtttattgaatgtttacaatcctattttttggtgctattattatgttcacactacagattttaaaataaattgcattctaagcaattatattagaatcagactcttttctgctaccactattgagaaatactggataagacacaactaaaaacaggagagataagattgccaggctgctagaagcactggctgacatgaaaacaactatttaactttaacagcagcacaagaatgggagacaaaaacttggatccccagaaggtcaggagtttaactgaaacttctgcaggtacccaagaccatagaaggagaaatggcaaaaagttgtgtctatcccaggcctctgcttagtttgaaaataaaaaagaggaatctcccaaaaaatttgtaatcacaggctaactgtatcagttaattactatcataataattgcctcaaaatatgtggcttaaaacaacactaattgattctcagagttctggaagtcagaagtccacaatgagtcttatgaggctgaaaccaaagctaagattaggactacattccttccagagtctccaggagataatccgtatcttgcctgtttcagctttcagacaccactcatgacccctttctccatcttcagtcagctgtgaggcatcttctcttctgtcctctcggctttcttatttatttatttttttcttttgtgagatggagtcttgctcttgtcacccaggctggagtgcaatggcgtgatcttggctcactgcaacctctgcctcccaagttcaagcaattctccggcctcagccttccgagtagctgggattacaggcgctggccactatgcccagctaatttttgtatttttagtagaggcagggtttcaccatgttggccaggctggtctcgaactcctgacctcaggagatccacccatctcggcctctcaaattgctggggttacaggcgtgagccaccatgcccagcccctcttggcttttttatacagctttattgaggtataattgatatagagaaaagcacacatatttaatatatacaatttaatgaagttggacatatatgtatagctgtgaaaccatcatcataatcaaggtaataaatatattcagcacctccaaaaatttcctcatgcctctttctggctttatttattgtttgatttttgtggtaacaacacttaacataagacgtacttccctaacaaaaattttaaatgaacaatacagcattgttagctataagcagtatgccatacagtagatctctagaacttatttattgtgcatagttgaagctttatattcactgaacagcaatttctcatttccctctcccctagcccttgaaaattattgttctactctctgtttctatgaatttgacctattttggataccttatataaatgtaattatgcagtatttgttcttactgtgactggattatttaacacagcataatatctttcagattcatccatgttgtggcatatgtcaggatttccttctttttaaaggcagactaatattccattctatgtatgtactacaattttttgctgagcttggtgaaacagaaactagatcaacctacagataaaagaagctctgaaaatccaagcaaaataaatatgaagaatcaccacacctaggtacatcctagtaaaactgctaaaaaccaaatacatacgattgtaaaagaaacctgaataaaaatgacacactatgcttataggagttgcaataagacttacagcaaaatattcaacagaaacaataggagttagaaaataatgaagtggcatctttaaatttctgaaagaaaataattactaatcagaaattctatattgaacaaaatatccttcaaatatttacgttcagaaaaccaaatctgaagtaattcatctttagcagaatcactctaaaacaaataccaaagagagttgttcagggagacagaaaataccccagagggaaacatgaaaatatagaaaactgtaaaaatcaattgaaataataaatttgttcataaacaaatgaatatggcctctacataatgtcttgtgtggtttaaaatagaagtaaaatataaaattaaaatgcatgaaaacaataattcaaaaaaccaaggagataattatgttgtctaataaagtattaaaatatatgaagcaaaatttataaaaccacagagagttacagaaaaatgcaaataaagttataaatttcaacactattctctcaatagttaatatgaagggtagagagaaagccagtaaggacatagaaggtttgagcaacatcatcaaacaacttgactcaattgacatttatagaacactccaccttaaaacagcagaatacatattcttttcaggtatatacagcacatggcacatctaccaagatagatcattggaaagtctgaacaaattttagaagattcaaatcaagtattattatattattattataactcatgggtcaaaaaataaaccaaaaagagactcaggaaatattttgacctgaatgaaaatgaaaatacaaaacatcagtatctgtgagatgcagctaaagtagtgcattgaggaaaatttataacactaaatacccatgattagaaaagaagaatggtctcaaagcattaatctcatattcacctaaataagtgagaaaaaggagagcaagttaaatccaaagaaataaaaattcaagaataataaaaatcagagcagaaatcagtcaaatagaaaacagaaaaataatagaaaaaagtcagtgaaaccaaatgctactccattgcacagatcaacaaagttgataaacctctaggcaaactaatgaaaagagaagacataaaataaaaatgtcagctttgggtgaggtgtcatcactataaataataaggggccattagggaatgttgtgaaataaagtcaataaattacagtttatatgaaattgatacattttttgaaggacataatcaaaaactacaattctttgtaattaggttctttttttcttcctctggtagcagtttctgtatgagaaatgtgggctgttttcttaaaagccgttgctgatctaggaagcggggagatgggaccaggataaggtaaaacaccacaagctatctgttcttaagaagattcaccagtttctcttcattgagtgtttccctggttgctgcaaacttttagttagtttccagagttccaacaaaagttgtttctaacattttttgtcagtttttttccccagtgtttttatggaggaatatacttttgagtcattacttcactatctccgttgatgaaaatttaatttataacaaatctagcaccaccactgatcaaaaacaagacaaggatgcccatctttacctccttttctcagtatcacactagagatctccatcaccaagataagacaagaaaaataaataaaaatacaaggattgaataacaagaaagaaaacttttatttttcactagggcctccaagagaatatacagtcattttatatttattataaattgagttcagcaaagattttgcatatatgaccaatttacaaaatcacttgcatttctgtctacaggaacaaatcactaagaaaaataaataatgtattctagaataataggaattaaattaggtaacttcatcactataattcacagaaatcaatttgtgattaaagacataatgtgtaaacttaaaaattgataaagacatgtaaaggagaacatttttatgtccttgagttagaaagggacttataaatcaagattttttcaaaactgcaaagagaaatattgataaatctatgcagcagattatattttccaaagatggccacaacaatattctttattccacatactctttttgtaatgcaatctcatcactcctcccattaagagatcaaggctatgttctctcttttggcaaatgggttggcttctgtgacttctgactaaagaaacagcagaacgaacattttaaaattttaaggctgggtgaaagataatacagcttccaccttacttgtgaaatactcacactacagcttttacttgccaggtaatcagcacacctcagcactgtcatgctgtgaggaaactcaagcaagccactgcagagacatagtagagaaaaattctgagactaagtaaaaagagagaaatatccagccagcttcccactgttccggtcccagctaccatcccactgcaaccacataaaagaccctgtaccagaaacactcagcagagcccttccctaattcctaacccacagaaaccatgggagataaagtaactgttactgttttaagccacggagttatagggtgctccttacacagccctagaaaccagaacaacttggttctgtgaaaattgaaaaacttccatttctcaaaaataccacaaagaatagaaacatatcccacagattacatgatgatacttgcagccagaccatatgcagttcatgcaaacaacttctccaatcaacagaaaggcaaataaacaaatagaaaataggcaaatgatatgagcagctaattcaggtgaccaataccacaggaatgacagataccacattaaaagttgcctaatttcacaggaaacaggaaaatataaatgaacatataaataaaatacagcatatagggaaatgtaaacgaaaataaaaatgataccattttacctcatcatatcacaaaattttaaagtgcaagaataacaaacattggcagaatgtggagactggggaactttcctgttctgctggtgggtgggtaaattgctgtgatcagtttagagcattaaagttgcagacacatattctatgactcaaaaatttaactcctacatataaatcctagagaatttcacccacctgtactgcaggaaatatgtatgacactattcatagcaatatttttttgcaacaactagaaaaaaaaccccaataatcttaatgttcaacacaagataatcagtaataaatcagagcatatgcataaaaataattgatatataacaaagaaaatgaataaacaataactgtgtatcaacactggtgaatctcacaaatatgttgaacaaaagatatgagctatagaatatacataaagctctttatataaaatttaaaaccatccaaagctgtacaatacattgctctgtgatacatatacatatgtataaagtataaataaatatatgaaagaagcaccaaattcaggataatggttacctctgggtagaagagaggcaaggtgatcaggaacaaatacagaagagaaatctgggttgccgattatttatttttttaaactgagaagtaggtatgtgaatatttgccacatttttctttagacttttgtatgtcttaaaaattaaataagtttgagagcttgaatgacataagcaacacttgacacagaggaagaaaggttagcactaaaaatgacactccaggaacagaagcgcacatacctaggggcttataggcattcacagagacgcagacatagaaggctaccaagacactcacaggtggaggggagactgaaagtcaagagatgaagtgaaggaaatggctgcttgcttggattcttactatggattccctcctaggcggacgtcttctggcaacacttgtaacaaagccagttctctgagtctttggagagtaaactcatgccaaatttcagccccttcctggctcccataatcactaagtgaaagtctcacccagaagattccagaaaaatgaacaactttttctgtgattcctatatagataattcaaaaaagccacaaaccacagaaatactttttatataatctctcacttttctctcatgaaaaacggaaaaaaatgccctgatatctggaaaatggcctgacacttgcaactaggcctcagtgatgtttgaagctggcctgtaactcacagctaaaccattgtattctcctgttgtacataatctcacggaatgccaatatcagatatgctcactctgagtccatgataaactgaagcaaaatttcatagctttgtctaagcacagataagcacaaagttaccaggcatcccacaatatactaaatattacccctcctggctaatacaagcgactgatgcttctttactaaatacagctttatccttgtttaagtctgacagataagattaagatgttcaatcatagaattgttctgcttttttataagattgagatacccaatgtttctactttttgacagcacccaacatagagcaaacttctacttccttagcttttcctacaatcacccaaccaaagcccaaatctcatatcagtttttttctaacagtctcttactgagaaacaacccatggtttcttatgatgtatgctctccctctctatgaataaagcataagtgagtaagaaaccccacttactaaacgacaagtatgttcttggtggtgtttggctggaggatattgacactcgctatgcctatctacaaaggaagccaattacagcagacctgttagtggaattgcacttctcaagtccttcaaatagttgtatggctaccactttgtgatatggaaaagtttatatgaacctgaaatatagaatgctggcccacattataactgtaagtaaaaatttccaatttcactaaattttcttctctttgatcatgaccgtaaatatattactatttcatttgcttttatttttcatctgagcagaatacaaaaacaagttttgggtgagatggggagaatgatgtaacctgtacaacaaactcactcagctgggaagtagcatgcaaactggcattcagacccaacactgtctaaaccatccacacttcatcactatgacattttaaggtaattgtgatgcagaagaagagagaaaggacagtccagatagaaaacagtatgtgtaaaaccacagagaagagacattatctttaggtttacagcatggcaagtgttggagtacagcctaaaagtaagattggtggaggcagatattgagagtaacagtatatgcaagaatagtataggaaggtttggctgggtcacatgtgttaggtgataatgaattcaaaccatattttgtaaccaacagagattttaagctatgggtagaggcaagagtatatgataatcaaaactatgttttcattctattttttaaattgacacatgataattgtaaatattcacagagtacatagtgatattttggtacatataatgtgtaatggtcaaaccagagtaattagcatattcatcacctcaaacatttatcatttctgtgtgttaagaacattcaaaatactcttttctgccttttgaaagtatataataaattattaactatagtcatcctatagtgctgtagaaaactagagctcattcctcttctcctatctggctgtaattttgtatccttcaaccaatctctttctataccctctctccactactttccctgcctcttgcaaccactattcaattcactacttctatttgatcaactttgtttttacttccacatacgagtgaaaatatgtggtgtttgtctgttctgtcttgtttaaattaaaataatgttctccaggctcatcaatgttgccacaaatgacagggtttcatttttatagctgaatagtattccattatgtatatataccactttttatttatccattcatttgctgatggacactttgattggtttcatattttggctattgtgaatggtgctgctacagacataggggtgcagatgtctcaacaatatactgatttcctttcctttggatatatatccagcagtaggactgctgtatcatatggttctacttgtagttttttgaggaacttccatactcttttccataataactatattaatttacattccaaccaacagtgtataggaatttccttgtctctgcatccttaccagcatttattaatttttgtctttttgaaaatagccattttgagtagagataataattcattgtggttttgatttgcatttccctgataattgtaatcttgagcattttgtcatatatttcttggccatttctatgtcttcttttgagatatgtctacacagatcgtttgcccattttttaatcagattttttgttttattttgctattgacttgagttctctgaatgttctggatattaatcccttttcaggtaattttcaaataatttctcccattgcatagattgtcttttcactcttttaattgtttcctttgctgtgcagaagctttttagtttgaaataattccatttgtctatttttgcttgttttccctttactattgaagtcttagccataaaatcctttcccagaccagtgttctgaagcttttttcctatgttttttgtagtagttttattattttggatcttacagataagtgtttaatctattttcagttaatttttttataagatgagagataggggcctagtttcaatcttctgaatatacagtttttcccagcaccacttactgaagagactgtcctttaccaaataaatattcttggaaactttgtcaaaaatcacttggttataaatatgtgcatttatttctaagctctctattctgttccaatggcatatgtgtctatttttctgccaataccacactgttccagtaacgatagctttgcagtattttgtgaagtcaggtagtgtgatgcctccggctttgttttttgctgaggatttctgtggctatttggcttttttgtggttctatacacattttaggattgttttttctatttctgtgaggaatatcattggtattttgacaaggattgcattaactctgtagatctcttccactaatatggtcatttaaaaaatataacttctttcagttcttgaacaggggatatctatctgtttgtcctttttaatttctttcatcagtgttttacactttttcttgtagagatttgtcatctccttggttaaagttatctgtacatattttatttttcatacctattgtaaataaaattgctttcctgattttttccagttacttcattgttggtgtatagaattgctgctaatgtatgtgttttgattttgtatcctacaactttattgcattttttaaatcagttttaggacttttttggtggattctttagttttttatgtataagatcatgtcatctacacatacggacaatttaaccttctccatttcaatttggatgcactttatttcttttcttgcctaactgctctgggctagatctttcagttctacatcaaacagaagtgttgagagcaggcatccttgttgtgtttcagatcatgaaggaaaagtttccagctttgccccagtccataaaatgttagctgtgggttttttatatatggccttcactgtattaaggtatattcctgctatacctaatttgacaagaatttttaacacaaagtgtagttgaattttatcagatgctttttctgcatctacgagaggattatatgggttttgtccttcattctgatgatgtgatgtatcatgtttattgatttatgtatgttaaaccatccttgcaactccaggataaattacacttgactataatgtataatatttttgatgtgctgttggattcaatttgctagaattttgttgaggatattttaatctatgttcattggatattgggctgaagttttcttttttgttgtgtattatctggttttggtatcaggattatgcaggccctgtaaaatgagtttagaataaatctttttctctcaatattttggaatattttgagaattaggtcttccttaaaagattgacagaattcaacagtaaagccatctagtcctggaattttctttgttcagagactttttattactgattcaagcttgttactcattactgattatggttttctatttttatttggctcaattatggtaggctatgtattcagggacgtatccattttagttaggccttcaaatttgttggaaaatagttgttcatagtagtctctaatgatcctttgtatttctgcggtaccaattatgatgtctctttttccttctcattttatttatttgagtcttctctcttttttcattaatagtctagctaatgatttgtcaattttgtttatcttttcaaaaaaccaacttttttgtttcattaatcttttatattgtcttttagactaattttatttctgttctgatctttcttatttcttttcttctactaatattgagtctgatgtgttcctttgtagttccttaagctaaattgttagattatttgaaatctttttacttttttgatgtaggcatttattgccataaacttgtgtcttgatactgtttttgatgtattccgtaggttttgatatgttgtgcttctattttcatttccttcaagacttttaaattttcattttaaatttttcattgacccattgataattcgggagcacgttgtttaatatccatgtatggttttaactcttcttgttgatttctggttttattccattgtggtcagaaaagatacttgatataatttcaatttttaaaaaattctgaaacttattttgtatcctaccatatggtcaatcttggagaatgttccatgtgatgatgaaaagaatgtgcattctgcagctgttgagtgagatgttccttaaatgtctgttaggtccatttggtctatggggcagttttgagccaatttttttttattttattttctgtctagatgagctgtccaatggtaagagtggggtgatgccctcacttattattgtgttggaggttgtctctccctttatatcttacaacatttgtcttacatgcctgagtgttctggcattgggtacatatatgaatctagttctaatatcctcttgctgatttgacccatttattactatataatgtcgttctttgtttctttttggagttttttttaaacttaaagtctattttagctaagtatagctactcctacctgtttgtggtatctatttgcacggaatagctttgtccttcccttcactttcagtctatgaaaactgtttctttacaaataaagtgagtttcttgtaagcaccatatagttgggtcttgtttgtgttgctgtttttttgctttttaatccattccatcagtctgtgctttttacagaaaatttaattgatttacattaatatttactattggtaggtgaggacttactcctgccattttattaatgttttagctgttttgtgtattctttgttcctttcttcctctcttgtttatcactgtggtttagtggtcttctgtagtaataacattttattcatatttctttctcctttgtgtaactgttgtaccaatgaattttatatgtttgtgtgtttcatgttagtagttaccaccttttctctttcagatgtagtacttccttaaccatttcttttaaggttcatctagtgactgatgaaccccttattttttgctaatctgagaaagactttatttctgcttaatttctcaaggacagttttgtgagtaaaaagctggcattctttttttctttcagcatttgaatgtgacgtcctattctctcaggaactgttacatttgttctgagaaatcacttttagtctagagggactatcttatatgtgagttgacacttttctctttttttcaactttcattttagattcaagtggtgcatgtgcaggtttgtcacaagggtatattgtaacttgctgaggtttagggtatgattgaacctgtaacacaggtactgaatacagtacccaagaggtagtttttcaaccttttccgctttccttcccagtcttgtagtccccagtatctattgtttctttctttgcgtccctgtttgcccagtgtttagctcccacttataagtgagaacatacaaatattcagttttctatttctgcattaatttgcttaggataatggcctccagctgcatccatgttgctgcaaaggaattgattttattcatttttatagctgtgtagtattccattgtatatatgtatcatatttttttccaatacaccttaatgggcatccaggttgattatatgtttttgctatgtgaataatgctgtgacaaaaatatgagtgcatgtctttttggtggaacaatttattttcctttggatatgtacccaggaatgggactgctgggtcaaatggtagttctgtttttagttctttgagaaatctccatactgctttccacagtggctgaattaatttacattcccatccacagtatataaacactcctttctcttcacagcttcaccagcatctatagttttttttttactttctaataatagccatgctgactggcatgcgatggtatctcattgttgtgttgaattgcatttctctgatgattgatgatgtggagtaatttttatatgtttcttggccacttacatgttttcctttgagaagtgtctgttgatgtcttttgcctattttaatgggggttttgtatttttcttgttggatattagactattgttagatgcatagtttctgaatactttctctcatccactaggttgcctatatattctgttgatagtttcttttgctgtgcagaagctccttagtttaattacatcccacatgccaacttttgtttcatcgcaattacttttgaggacttagtcataaattgtttcccaagactggtgtccagaatggtttttcttacattttcttttagaattattatagtttaggtgttatatttaaatatttatccatgctgagttaatttttgtatatagtgaaaggtaggggtcctgtttcattcttctgcctatggctagccagctatcccaccaccatttattgaatagggagtcccttcctcattgtttatttttgttgactttgttgagtatcacatggctgcaggtgtgaagctttatttctaaattctctattctgtttcattggtctatgtgtctgtttttgtaccagtaccatgctctttttgttactgtagctttgtaatagtttgaagttgggtaatgtgatgacccagctttgttctttttgcttaggcttgtttcagccattgggctcttttttagttccatatatatttttagaatagatttttttctaaatctgtataatgttcgtagtttgataggaatagcattgaatctgtaaattgctttcagcagtatggtgatttaaatgatattgattcttccagtacatgaatatggaatattttttcatttgtttgtgtcatttatgatttcttttagcagttctgtagttcttcttctagagatctttcacctccttagttagaagtattcctagatattttattttttcatgactatcgttaatgggattgcattcttgattttgctctcagcttgaatgttatttgtatatagaacagttactggtttttgtatgttgatttgatatcataaaattttactcatcttgtttttcagttcttggagcggcattttggtagagtctttagtgttttctaggtgtagaatcatatcatcagctaagagaaataatttgacctcctcttttcctattaggatgcctttaactttttctcttgcctggttgctctggctagcacttccagtactatgatgaataggaatggtgagagtggtcatccttgtcttcttccagttcttaaaaggaaagattccaggttttgcttattcagtgtgacattgactgtgagtttgtgataggtggtttttattatttggaagtatgttccttcaatatctagtttgttgaaggtttttatcatgaagagatactggattttactaaattttttttctgtgtctgttgaaataatcgtttcattttgtttttaattctgtttatgtgatgaatcacatttgttgatatgcatatgttgaatcaaacttgcacttcagaaaggaagcctacctgatcatggcgaattaaatttttgatgtgctgttttattcaatttgctagtattttgttgagaatttttgcatctatgttcatcagggatattgtcctgtagtgtgtttttggtttcgtttttttcatgttttcttctccaggttttggtattagggtgatactggctttgaaaaaatgagttaaggaagagtcctttctctttgattgtttgaaagtcccagtagaattagtaccagctcttctctgtaaatctggtagtcttcaactatgaattcatctggtccaggtcttcccccacccccacccctaccccaccccccgttggtagttttttggttaccggctcaatttcagaacttgatatttgtgtgttcagggtttcaatttccttctgattcagttttgggaagtcttatgtttccaggaatttatccatttcctctagattttctagtttgtgtacaaaaaggttttcataatatctctgaggatgtttcgtatttctatgggatcagtggtaatgacacctttgtcatttctgattgtgcttatttggatcttctctggttttttccttgttaatctagctagagttctgtcatatttatcctttcaaataaacaagttttgggattttttaattttttgtatgtatttttgggtctcaatttcattcagttacgctttgatttcatttatgtcttttcttcttgtactttgggggcttgtttgttcttgtattcttagctcctcttggtgtgtgttgttagatcattgatttgagatttttctaactctttgaggctggtgttcaggatgataaactttcctctcaacattgcttttgctgcatctcagagattttggtatgttgtgtctcagtttttatttatttcaaagaacatttttatttatgctttaattttactgtttacccaaaagtcattcaagagcaagtagtttaatttccatataattctgtgtgttttagatatccttttggtattgatttctatttttttattccattgggtctgaatgcataattggtacaattttactttttttaattttttgagcttcatagttgagcatgtggtcaatcttggagtatgttctgtgtgcagatgataaaaatgtatattctgtggtcaatgggtcaagtattctgtaggtatctattagatccaattggttaagcgttgaatttatgtccagaatttctttgttagctttctgcctccatgattggtctaatgctatccatggggtgttgaagtctcccactattattgtgttgctaagtgtctcatatgtctagaagtacttgtttatgaatctgggtgtgccagtgttgtgtgcatatacatttaggaatgttaactcttctttctgaattgaacgctttatcgttatgtaatgcccttctttgtccttttttaatgttgttagtttaaactctgttttatctgatataataatagtgacccctgctgttttttcattttccatttgtgtggcatatctttttccaaccatttactttgagcatatgggcattatcacatgtgagacgggtttcttgaagacagcagatggataacgcttgttattttatccaacctgacactgtctaatttaagtggggtgtttagactatttacattcaaggttaatattgatatgtgaggttttcatcctattgtgaagttgttaggtggttgcctattccgtgtttctcacagagttgatctttatggacctcacagattcccgtttgctcacagagttcatcttaatgcagcatcttgttatttcccagtgactgaggcacactaaaagcctctaatctgccatctcatttccattttctgtatgtcacttttctttttctgtttataaatcgtccaccacatggctgtgcttgagcctctctgagcctactctggcttgggaggctgcccaattcataaatcattctttgctcaattaagctctgttaaattttatttgtccaaggtttgttcttttaacacacgaaagcttttctttctctgagacccctggtggcaattggataaagaatggctactacatactgagtgacatttttctcttgtgggttttaggattctctgtctttgacttttgacaatttgactataatgtgctttagagaggacccttttgcatggaatctatttgagaatctctatactttttggaactggtaaccatactattgcaagacttgggaagttagcaactattatttaattaaataggtttttttacactttttcccatctccatgttctcttcttgaaatctcatatggtgccccatgagtcttgtaggctttcttcattctttcttttcacttggattattgcaaaagatctgtctttaagttaataaatgttttcttctgcttgttcttgtctgttgttgaactcgattgtatttttatttcattcactgaattcttcagcatcaagatttatgtgggtttttttacaatatttatctctttgtttaatttctttcagatcatgaattgttttcctgattttgttgtattgcttacctgtattctttgtatcttactgagtttgcttaagaaaattattttgaatttttttctgttattttgcatatttccttctctctgggatctgttactgaagaattattatgttcctttgaagttgtcatgtttccttggtttttcatgtttcttttgcccctatattgatatctgtacagctggtagaacagtcatctatctcaattttatggagtagctttcacagagaaagacttattcccatagatgagttctatgatgtcatttggttgggttatgttggctttggctgtaggtggacacaggcttccatgaagtttcttcagctgtaatccatgttagcaatgtctgtgagtgccttggtggcctacactatgggagtttggcagtggtggtgtggctttgctaggggtgagtttgccaaactatctctcaggcctggagtttacacatgcatgcagtgggttgaccagtttgggacctggcttggcagagttagggccactgggctttttcataggccaggggcatgggagcatgagatgggttggcctttggggaactgttttgccaggatcagggcctctgggctgtttcatcaacgaggggtacatgtcacagtggcttgtttggttcaaggaaggatccacctgaggcaggtcaaccaggctggttctctggctgcttggctggcttgggagtaggtcttctggaggttggcctactgaattgtttctccagctgagggcatggacatacggctacttggctggctcaggggcttgtccactggaagcagatcttgagggctggttctctggccaaaggaagaggtcttgcggctgctcagctggcttaggggcatgttccccagactgtttctcctgacagaggggtgggtgtggggctgctcagtgggctttggagcatatctgctgaaggaaaatccaccagatcctaaggaaagcagctagacctgcaaggccacgtttttaaataactgtgagcagagtcaaaaatggattaaatataggacagactcaatagcctacagaaagcccattttatgaaatatgtcaggaagttactcttgcatctaagaaattattctatatttgtctcatcacatccaggtgaaacagctttgttattatcttaacacccatgggttttgaacagccatagtaagcttttcatagctcatagggagtatttgtgcagctcagttaaattatgacttctaattaggatttaattaaaatagaaagcagcttgtttagaacatggcttcgtatgtcgagttacaaagcttcatctgcatctttgttaaagatttttaaaatcctctgtatgctgaattaaggaagaatgattctgaatacattctgtaaaacctatgggctccataaataaccattaggaaatattagacagaaatatgatagaatccctgaatttgtatttatgcttcctttcctaagccctatttaaagatgacacccaaaagaccaaagtgatacataatagatttaatccacgatcctcgactttgatcaaacagtagtgactaaactgaatggggttttgagaagacatgtcagagttcagcaggaaagagtacatagaaaaattttgataaattaaatacaggggaggtgaataatggcatatgtatcacagtaagtaactgaataccttgaagcaatctctccaatcagaaaacacacaatcagaacagcggttgcatcaaagcctcatgaatgcttcatttattcatgtggcccaatataatatcttaaaatgattattttctgtatttccttgtatatgacggtccctattccagtgggtctgaaacatccacattttctttagaagaatcatatttcttatcaagagaaacagtaaatgtttggttttatacctctaaaatggttttttttactcttaactttttaaaactattaacaggagcaatagttctgaaatccaaaagtttttaattgcaagagataggcttcgttgaaagggggaaaagcttttgaaaatcaaagtaaaaactctgaaagaggctgcacataacaacagatttgaaagacagtggaagacatagactgcccctaagtaagcgtaacctgggctggaagagatgggtaagtatgaaagagattagcaggacaataaagatgatggcctcatggagaggagcagatttggcagccatttgggaaaaaaatatgttagtatatgcataaaatataatcatcaaggttataaatgtttagttattttatatgctcaaaaatatattgcatgctacatttaatcatactgtaatgtacaaagtatgtgtcttaacagagcactacagggtgactatgatatatgaagccctagaaaacataaggctgaaaggtgtgctctggattttgccataggagtcacccaagcaaccatcttagctggaatctggccatgtggagctgacgtccacagcacactgccagttcgctccccttacatggtactccctcttcatgctgatgatattttaataagcttttttttgttggggggggagatctgaatagaggaaagagaataaagaataaaatcataggggaagagattatctggacaaagggaaactctgagatcatgcgctgagatcattttggacacatagctgcctattattactccctctggcatggtcataattgagatacatgtagctagacatttatgttgcattccttatctgccattggccttactgcttgggaagaaattctgcagctgaggtcatacattataattaccatctaacatcatcatgaattttttttaaatggacagttaaacacacaccaaaaaaataaaataaaagctaatttttaattaaataaaacatggttttgtgaaaagcttactatgtatattatgcttattttccaccttctgcccctcattaggaagaaggttggcttacattttttgcagaggtatttgggagaatgctctcaagggatacagctgtggtaaagcgaggaagacaagatggggcaaagggtgaagctgacctgcattgctgctgcacctgaacttcatttagccttacagggagctttggaccaagcacgacacttcagagttatctcaaactgaggcatggggctgggactttgtgtcctgcctcaatcagtcattggccatagaattcctcctagagcaggtataattttagatgaggcagttccctgaggctgagggcaatttcaatgaagagtgtaactatgaaccactggatgccagtatttctagcaccagggaataaacatgccagtcctgatgagaagagtcagtaacaaatctcagtatacatttcaaacttccatgtgcagcaacatcattttaaatattaacattagaaactattatctaggcaattcttcagttctcccctttgcaaagactcaataaatgcagactcccattattcctccaccagcttaccagatttcatctacaaactgtagtgctggatatagatgacttgagaatctaggtgtgcatggaatgtgatgtatgactatagtggtgtttcgggaacctgtatctgtttggctatctagcacatcttgagaccatgtaagaggattagagaaatgcgcaggtttcttacttcttaattttctttttcctaggattttatatacaaatacacttaagccacctctgatgttgtaaggttagccgtgtcacctgtcacaggtggtgtgaacactatgagttgctgactcgtgtccctgtaaattgcagaagcagggatattggaatccagtagtggtggtctgtgctgatgcgcacgtctttcctggcttgaatccttttcattaccgatataaatcaatctgtcggcctccagtggttaatactgtagtgaatgtctttaattcaactccaaactctaaaagtgtaatctgaaggaaaacatatttttaaagtgtccattttaaaatagaaaacaaaataaacaggatgtatatatatatgtgactttaatctttcaaagtttcttataatctgtctgttcttaacttttaaggatctatgatgtcttctgctgataaaatgttaatctgaagttcagaaattattttcggccaggcatggtggctcacacctataatctcagcactttgggaggccgaggcgggctgatcaccagaggtcaggagttcgagaccagcctgaccagcatggtgaaaccccatctctactaaaaatacaaaagtcagatgggtgtgatggtgggcacctgttaacccaggtactcgggaggctgaggcaggagaatcacttgaaactgggaggcggagactgcagtgagccaagattgtgccattgcactccagcctgggcgacagagtgagactccgtctcaaaaaaaaaaaaaagattattttcattttacttttttctttggtttaagttaaagtaaattcagtacttaagaaaatagtatatttagattgatgccatttttctgaagttacttcttgttactgatctagttatctcccttgctctctgaatatatcccaagggagagagagatcttaagtgttgttcactagttgttaatgatagattcttctgtgcagcaatttaatatgttttttacttcccacctacttttctttattgcttgcatttatataataagcatatatcatttttataaaacagtaagatagatgaatactattaaaacttcagaagaaaataaaggagaaggaatacagagctacttcaaaccttatttcattacaagcattttatctcttcatccccatttaatcacttcagcctcaaggtgaaaaagtgaaacccatagacagaggtaatcttgtcctgatacaagaaaacatttgaaaattgaaatagttaaaagtatgctcctatgagctagggctctttttacttccatttcttaatttatagtctttgtgtatttcctcaaaataagcctcctgaagggaatataaaatacagatagaaaaatgacgtcatccaactgagcccccaactgcagtcacacatgaagtcacagatgaacaaactatggcacaggagaaaccaattttaatttaattaataggataaaagttacttttcttcatgtttctccctctgcttttgggtttctgtgttttttttaaatcacaaaatatttttagaaattacagaaagcagagaaaatacatacaaaaaggcttaaagatcatcataattttatctcccaaaggcaactagcaatattttagtttaattcaagatttttttaaaggattttggttgtcacttgggatcaaactgtataagaatgtttacattgctttctgtacaaacatgatatatacaaaagtttcttatgagcataactcagtatacatgtaatacatgctcatagaagaaattggaagacaaaaatttttaaatatcaatcatcctgccatctagatataaacattcttgatatgcattcttcccaactttttaagacagtaattaaacagaaccttctgaatagtttttatttaacaatagatcataaacaacctaggtacctctaatttttgctacgagagtactggaatagaagatgttttaaggtatatctttgtgtatactgagcatgttgtccaattacttccttaggaaaaacgtctagaggtaaactactgagtcatactgtaataacattttaaaggctattcatctatttctaagattaactagaagggtatacaaattggtaattttcccaaaagcagaggatgtctgcttcacaaacccttaccaattctgaataacattactaatcttagtatttcagtccaataggaaaaaaacaaaacaaatcattgcttattgtctttttatgctttgattactataaaggctatagaatttttcatagaattactatttttgtatatttctagccttttctattgtcatccttatacttttgctattaatttgcatcatttttaaatagtcacattattgctcctttgtcatctgtttccaaatgtttataggtatttatttttcttgtacaattaacttttctaatatttcaaagtaaagctatatgataattgataacagaacctttgtttttattgtgctcttaatgagaataaatctagtcttctagccattaaggatgtatgttagtttgagattatttattgtgtcaatttctattctaatcctattttgctaaacacatttttaaaatcagatgtttcagattttgtcaaatgcctttttggcatatattaggcaaatatattttttcccttttgcatttattgaaaatataaattacatgtaatgttttttctaatattgaacttctttacattctggaaatacactctccttggtattgaatgtttgaatctgttccatacgtcctcattttcaaaaataccaattatgcatatattgggctccctttatcttttctgttattattaaaatattttattattttagtttgattcattttctgattttcccaagccatccaccctatctttgccaaaatcggtattactttctttttctacttcttattgctttcattctgaaatgtttgttttattgccatgtttttcctgagtttttccaacttgctgttagattctcctcttatcacacaatcctcttcctaagcattttttatttttagaaatatcaaattgtctgtaattttttaagaacatgaaattctattgaactgaacccttcattctttgggcaactcatttaataatgtatatttatttccttttgtttaagatttttactcatctctgaatgattcatctgccagattccagataaggaactgtgtggagtaaattgttaaaactttatgttgcttcagcatccattttgaatctaggtttaactttctcataccagaagcaaggcttagttacctttgacacatatccagttctctgcctcttcccagttcctcaatgtggtcaatccaaatgtctgcctcctggtggctacctccctacgggacatagagatacaacctagctgactcactccactgaccccacacctacatagactgtacatacatgccacagtaaccactctcagtcacaacatgaccctttgagattcatgctagcttgctctaaacatgccagttagaatttcctgtgggaagcctgcttgggtaatgccctgcaccctaataaagtccttggctcatagatcttcctccacactccacctacaggttgggcactctgttggctccagacttcctgtcaaccctcattgacacccctcttctctttgggatctgtacataataaactgcttctgacatttcatgtgtttgtgctgtgttgcctcctctgtcttacctaattgacacacccacatctaactttccttctagtcaaagctctcctggagagtggctatcttggtgttataaactggacacaggtcagacaagagccataggggtatctgccagcatagacaaatttactgtgagagggacaccaagtcatatgttgtacacttaggcattaagccatctgccagaattaaaaaaaaaaaaagcatctgtatcccatgaaaggcatattgtaaacatcctggatcaaatcccatggatctgcatcagggcaaggctggagtttatagccaatctccagagagagagcgctcaggacaaattagagaggaatacaagactattctgtggagaaaatggagagaggagtgtgaactggcaatctctagcctctcttttgtctgatctctcctttattctctgactaaatcttttagtgtccgagggaaaagcatagtagagttgagggtagggagaaaagggagtacagaagacagtagttcaaaacctatgctctgaagtcacccacaggattcaaattccaatgctgctccctgctagctctttggtcttgaaatagtactttaaattatctgtatctctgtttttttatctgcatagtccctttatagcttgttataaaaattaaatgagtcactattaaatctagaacagtttctgccacatataatagttcaacaagggttaacattatgattagttgtttctgccccatgagctttctgttacaatatgcaactgctttgtctttttccttgaatcactctaccttattctaagcatccgcctcaattaggaggattggttagagaccatagaaatgacataagctgtattcttcagttgcagtttttgactttctgtgttttttaactaagtcgttacagggacatgcctgcatttctcatgactgcctcattcctctagcttgcagtcagtcagtggcttctcatttaaggactacagtgcttactttcagagaaacccatacctggcagaatgcaaataccacttgactatcaacaagctttctcctctgtagagatatctttggccagaatacttcatagtttgaagctgtagtagacattatttcttaggtcattgtagatggtggattactccctttctttttttccttgctgtttctgacaggtttcatttttttttaaaggagagtaataaatatgccttaatttaagatttctaatcaaaaatctggaatagattcaataccttaagaatggtctgaaagaattcacctgtaaaatggtccaggctgaaatcaaatcaatggtgaattcatgataaaatataaaattcagtatggccattatattatatacactttctacttctttttaagatattttttatttgttaatattttcaaaatattccacttggattctccatattattagtattttgtttttaaattgatttaatgtttctggttatatcctcattctcatttcaaatattacatatgtatgacttctcttcctcatttgcattgccaggatttcagctatttactagacttttcaaaaagctcatttatggcttcatttatacttctgcttttatcattgtttatttctatttctattttccttagcctaatttttaatttttctagattcttgaatagtatacttgctttattttttattcgttcttgttaataataaaaccatttgcagctaatcattttgctctgagtataaggtggtgatactgggttattcttatttgcataaacattattttaatgacaccaaaatattctatggttaaaaaagactataagcatgcttaaccattctcattatagtttagtttataggttaatttcatctttgctaataggttataggttagttccatctttgctaattataaataactctgtatatagtttaattaaaaaatacttggggggaggggggagggaaagcattaggagatatacctaatgtaaatgacgagttaatgggtgcagcacaccaacatggcacatgtatacatatgtaacaaacctgcacattgtgcacatgtaccctagaacttaaagtataataaaaaagaatactttttcttgatataatatgtatgtattcatttcaaatttttatgaaaatttcacaaaactaaggattaattttctactaaagaatctagaatatatctcttaatcagtgttcttcattcttttatggagtcatattataccatttttttttcatagcactgtactatgttttcattaattgccaaagaaaatattaccatctgcttagcatcaatgacttatgacactaattgtactagatgacatagttaagcaggagctactgttaatactttttttgttcattgccctagatggtctaggatttcattttattggagaaaatctcctgtcatctttgcaaattatgttaattttattgataggttagtaaaaggtattctggacaccatgtatcgttttgtaggcaaagaatttgactgtccttcataaaacctttgtgaaaaacacagtgaaattattatgacaaaaattggacaaaaacaagaatccactggcaacatccaacattggagggtataattttaaaagttgagaacttccaggaacagtgctggaaactatgtatgctggtcagtacctaagcctatgactaatcatagaactttgtgtggaaataaccaaaaacataggtactaaaactgcttcttcctcctctcagcagtagcttgaggttcattttgaatctacacaaattgttctataataatggctaatatcaaaaatatgatcaaacttaagtcaggcaatacgctaaactttgtacatgcaaaatctcatttaatcctcaagatgacactacaattttggtttcatcaatgtgatagactaaacaaatgaataaactactcctgctgcaaatgcttacaaattctgaataaagtaaaaaagaatcttttaaaatacattactaaggcagctaaaaaagagtaaaatccccagacatcaggaactaaaagagtggtaagcacacaagttgatgcttcagtggccaggatggcatgagtggtgtgcaggagagtatagaactcaggagatctctaattgctagggtgttggacattaatatctatgcagagaaattaaacctatgtgaggtcaggagtggggatgtaaatcccagtataaagacaggacccttaaagtgctacgcccacagaaaatgaggagctcgataaaatgtgtctacatgtcttaggatgccagcaataacattttctttattttgggttctgggtgagtaaaaaaaaaaaaattaccatgagaaatcaaaacctcaagcttaagtaatctgagatgtagagtccaatttacagtgttcatgagtgatgagaatccaagcctacttcactgaagtatgtagcagaggaaaatgaaaaactgctctgaaccaatgtcatatgaaattcctacaagagaaaaaaaacgacatacaagaatttcttaatcaaaaattacaaaatgtgctagaaaatagttatcagacagaataaatcagattagtagagaacctagaaggacaaataataatctgaacaagcttataaaataatttaaatggctaaagagataaaagaaaaaatgaaaatcaaagaataagaaacaacaaaaaatagaaagtctaagaaacaaaagaacttatagaaatgaaataaatatttattgagatttcaaatccagtagactggaaaaaacaacaaattctacatagtcagtgggagaatcaagtaacaagatagagctgaggaaataacccaagatgtagcactgagtcataaagtgatagaaatgtaaaataggttaaaagattcgcagaacaaaaggagaaggtccaacatgtgtctattaagagtatgaggaaaggaagaggtgggagagcaatattcaaaaaggtaaggtctgtgaaatttttcaagttaataaaatacatgtaacataagattgcataagctcaagtcctgagcaaaataaaaaaaaaactacatgtatatttatcatagaaaaatagcagaatatcaaagacattggaaataaaaacataaaaggagaagaaagagaaaaagatagattaccctgcaaaggagtaattaaagttataccaaagttttcaatagcaagatggagaccagaaaagagatgaagaaactgaggcacagaaaagtcacacatggtccttaaagacaggtagccagtatgttgcagagtcagattttaagtaaggtgatctgactccaaagcccacattcttcaacaacacagaaagcttttctgcataacattctggacagttgtctttgactcacctttacttaaaaaaaataaaagaaaatgaaaaaacatttttttctcaataagtcaaaatccgaaatggttagaaaaaccatgtatgtgcctttttgcaaatctgaaattaatctaactaatatcaataatgtttacaaaaatttaaaagttggatttggagggcagctcatcagcagtattagattgcagatttccacactggatggaaattaaactatatttagacttgtctagaggcaaaacagttgacaatgtcatccaagtggaagcatgtgggtgagtttcaatgcataaaaatatttccaatttttaatcagctataccatatgtagtaattggagaaatcttagaaatatggcctcaatttcccacatcatctctaaagcatataaccttgggtatacatgaactaggcaacagatctttaatttaataaatgttaaacatatattttaaatctcactaatagaagtatttttaaaattggatagattttttttcacagattgttaactaggtctgtaaataattcccaatgggagggaccaatgaggatatgagttgaaataaatatttgacctaccacagtgaattctttgaaggacaatacatgttcatatacataaattccttgagcaacacaagtcctgagcaaaataaattataaatcatatcatagctcaaaaagggtaaaaggcatcaatctttaaagtatttctacatgtaactgtatcaactagtgttccatggtacaaaagacaaaagtactatcagtttatcacaggagtcccagaaaattgctgttctgaaattaatattttatttctttaattaacaatattaaatttgtgacaagagaatggtcaaaggactgcaatgaattctatagtctaataataaactaaaattactttcatgtaacactgcaagctcattttttaataaacgagaggcctacagggaggtgagtggtactgctggagcttaaaagactgagtttaaatccttcctgtcctatcaccttggggaagttacttgagcctctgttctttcatgtggataaaaaagataatagtactttcaggcttgtggtgaggattaaacaggctaaggtatgtagtagatactctacaactgggagtcatttttatctccaattaaattatgccatcatttaaagctgctatgccatcaaggaaagctgatactaggagctttctaagaacttgtgggttttggtgctgtcatgaaaggcagacacccacacatacctgaattatgtatggtacctggataccctaaagaggcaaccacaggcgttggttcattttgatctggaattccccactcccacctctcacaggcactagacattggccctaaagaagacccaaccttcacaccagaggagatgcattctgcccatcatgatcatgataggttgtaccacgtcattagacagatattgcttagcaaccaatacagtaaaaaaaaagggggggtaagtaaatgagatgggaatagattgggatagagtgtcaatctcttgtactccattttgtgacttgggcagacgggacagggcccccccaggaaaagagctcaaggattagcccagttcagcctttgacatttgtcctgctattaggaaaaaattcctcaacctttggcaactgtctctaataggctagtgacatggtctattaacgcacatcaaaacaaattctgacatctttttccaaccacattcccactcctctcctttaggaaatgagcaagctggaatgagggcagctagtacttgtcttctcccctgagccagtcatagaaccccatttcctgtaatagatctcttgtctccaagagcgtctgttcattcaatatgaagttattgggcactcaccctactatattaacaggtcctgtttattgaatgttcactgtgaattcaggcacagcattaagtgcttttataaatgtatcatgttgtttaagatttccacaatgttgtaacatgtatgttttccatctcacatggaaggaactgaggcacagaatttttaagcaacttcaccagcaggcaatataaagcatggtctaactccattatctcaccactatactaagcctggaaaaaaaaataagagatgttttctgtcctcaaggagcatggagcccagtaagagagatgtgcatgtatacaacccacaaaattcattgacaagtgctccaaagaaggtccataagcactgctccttttcaaaatatgagtccttcatactgacatcagctaatgacacttggtaatgtaccaacgcattcatactgtgcatgaggcatggatattgtcaacagatctataacaatgctgcatgagaatctatctgagccttgacagcatctaaaaccttaagcctttggtcatgacagtgttttcacctgtattacgaaggaatgctcagtcaagcctgagaaaacaatgagccaggtgaagacaacctgcaggacataagcaaacactcacagaacctgcctcagcctgagataagtaatgactggaaatgctcttccctagcaggaagcccatagagcaaggttaacagagcccttggtaagccccaagacctaagattcctgggttaagggattttacaaggatcatattgtaaagtcctgacgggcttcctcactttgttggctttgatgggtcagtaggcaataaaggtttactctgagatctgatgattttggccacaggacaaaagaacagccttgagtctctaccctaaattgatatgcagtctgagtcactgagataaatgcatgcttcctccaccccagcctctagactgaaaaagaaggattactcatttatggaacaataaataaagggagctgatagccacagagaaagaaagggcaagagcaagaatttagaaaactgaccacgaacaggcatagacatgaaattggagggtctcttttaaagctcaggtcccctgcaacttcctctagcaaactctgatttttagtcttctgacccaagttagaattaagttagaagatgtcactcacatcttgattccttcggagaagtattcacctctattacagcatttcatgccacattgtaatattgcctctcttgtaggattaagacctccatgagggcagtgaatgtgcgatgtatatcttaataaccacagcttcccacacatgggaggcagcaatgcttaacagaagacagggcctcagagttgcacccacctggaggggacagccctcagaaatgaaaggaccacatagcccaaaatgaagatgtgagattgaggatgcaccccctgaaatttacctcttgagtcagttcccagggtcacaactgccaattgcaagtacgcagatgagagtgaaataactttgataacaccacatctaatttacacgcaaatcccatctggtctaccttcagaacacatttcgaacctaaccacttcttaccacctcagtctaccatcatgtcgaacctggtctatggtaacctcctaatgcatctgtctacctccactgcctcccaccctcagtttgtcattaatacagctgccagagagaatcttgtaaaaacagaggatatcatgtcccagttcaaaactctccactgaatttccatcacacttaaaataaaatccaaagcctttaccatcatctaaaaagtcttatacgatgatgccaacttctcccagacaccacttctatttcatttcctcctactcttcccttccctgacaccaacctgtcagaatggccttcctgctatcccttgagcacgttttgtatgtttctacctcagggcctttgcactgcctgtttctgctgacattttcactccagataactataaggttcactgcacatattattcaactttaggctcaaatgctgcctgttctgagaggtctctcctgtgctcgccatctaaaatagtaacctcattattcatcagcctcatatcctgctttgtttatcctcagagggattacactatctaaatgatgttatttatttctttctttgataatttcctatctcctatactagaataagattcatgagagcaggggcattgtctttgttcattgctctatcctcaaggcctgaaactaagtcactatgcaatagattattgttaaataatttgtcttaagaatagcatgttaggacgggcatggtggctcatgcctgtaattccagcactttgggaggccaaggcaggtggatcacttgaggtcagaagttcaagaccaacctggccaacatggtgaaaccctgtctctacaaaaaatacaaaaattaaccaggtgtggttttacatgcctgtagtcccaggtactcaggagtctgaggcaggagaatcgcttgaacctaggaggtggaggttgcagtgagccaagattgcaccactgcactctagtcagtaatagaaggagactttgtctcaataaaaacaaacagcatgttaaatgggccaaaagatcacaggctccagaatttcaagtgcaccttgaagtcaaaaagtcagtgaacaagcccacaagaggaacttaggtaaatgtctatgagccccaatcttctgctccacagtcaaattgcataggacatccttacaccaagcttagcaccgtattccactggacaattgtggcttaaggaacgagcacaggaattaacctgagaacacttaggcataagccctgatcagccagtcactagttgtacaacttaggcaagttagctaacccctctcagccttaatttcctgatctgtaaaaatgaggataatgataataggtacctttcaggactgtgcaaaacaaattaaatgagctaatatatatgaaatggcccagaacattactgaagttcagtaaatgttagattaatgtaaatgttagattaatgtgaatgtgttctcacctgttcacaggcagggatgtctctaaggtgaccattcaagggatccaggcattgaatgccctctgctagttcaaaagtcatctccaaaggctcttggcacttcttagttccaaagtcaataagatcctgaaaagcaggtatagaactaaccgtaaagaacaggacctgttttataagttactataactaacataagctggtgagtgtgctttgtgagctagctggttgtaacttttgtctctaaccattaaaaagtcagctttaaaccctgatgctttgtcttatgaaaacacaagaaggcaatggaagtcaccaagccagaatttctaagcctcttttactccaggtgtctttcccattatgataacaaaggtctagaggaagggtggcaaatgcatgagaagtgaggctgccatgccctcctaagcctgtggaagacactacagattcacatggcctgtttccagtgagccctgacatgacctcgacaaagtgttcctggcaggcactgacaatgaatttgagttgaagcatgagaaaaaaaatccatttcctatccctaaggattgctgagaaggaagaacaacaaacttcgcatgagctcctcactctgaccatgccggtgtgctcaacccaaagcctaaagaagataaattatccactttttccctttttggttcccccaccctcttccctcgactctgacctgtcctaagctccatcattctttggctatttggaaactgactccatgtattcagtgccaccagctggctaattaaatagaagtgtctgtctgtagctttctccatgaaaaatattaatgaaaatgttctattttgtgttctttccttctcctaaaagaaagtacaacataattcccttatgataaaaatgtatttcacaattcaagatgactgttcacaaggcagagctattgtctcatagatgaagagacttgggtttggagaggttaagtgacttgctacatgtcactcagctaaatgacaaaactgggctaaaagccaagtttttaaaatttcagttgagaccatgttctgctccaccaatatgcctacctgaacagctaagatggctccaacccagaacaattaatatcattgttgacagtataactcactaaacattgggatagagacaaactgaacattttctgcagaaggcatacattctcgacaacaaaaatatgtgaacataggcttcatacttgctctttgagttttgttttgttgttcctattgcaatcaacttactgcatcccataataaagaactcaggaaaaacaggaaggattctggtaagaaaggaaaaaaagaactcaaaaggaaaatgaacaaacagcaaaaaaaagagaaatatattcttttaattgaagatatgctttagacacatgatagaaatgtctagaaaaccaggagctcctgtaaacatagatgagaccaaaatgtaagttgttaagaatagagatctggtgcaagagtgcctgggttttatctctgtatctaccacttacagaaggttagttaacctctctaaggttaatttcctctttctgtaaagaaaagatagtaattgtataatttcacagtggttttggtacatgcaagacaatttatataaagtcttaagtataacatctaaaattatttcaaacactaagttagctattattgttactaatattatcatttgcactagataggattcatataatgagggctgttttccctgttatgcctcttctctttgaccttgtgcaaatcacttatcttcatcaagctccagtttcatcttctgtagacagacacaataacagcagccctacttactttacaaagtccttagaaggatcaaatgtgataaaatagtacagagtgttttgtaaacagcacatcaccattctttaatcacagtcttttctaattctaaccaggtctcatattaatatattagttaagcaactaaagatttcaaggagtgtcaggctgaaatcatccttagcccttagctggatgaaatgtgcatgtgtttatgtgagaatgggctgtgttttaatatccttcacttatacctttttatcttcactcacagatgttgagtacccagtatgtgctaggcacttgagttacaatggggtcatatagttgacaaggcagtctgaggccctgtctgttgcatacttaggtaagcagttggaagttgcatgtaggaagccagagtgcacagcgggaggactgacgcttatctgggaggggcaggaaaggagattgatgaaaatgacatttgagatgaaagctgaaggaggaggaagcattaaagacgcaaaggggagggagtttcagcagtgggaaaaactagtacagaggctctgaaggaagaacaaatatgaagcattcaaaggaccaaagaagacccatatgaatgggatttagaatggagggtggggagagctcagaattaaagctggaaaggtaggcaagggtcaggtctaacagaccaagtcagaggtattgacctttattctaaaggcaatttttaaaatccacaagtttaaaataaaaattagcagtttgaaaagatcactggctaacacgatgggaggggcaagcgtggatgcaggaaaagcagtgagagcatgggctactgtactggtccaggcagtgacaagggcagttccagaaagcaccaagacaagggggatagagataagtggtctgatttaagaaatactcaggaggagacagcgcagaacttgatgctggataagctgaggggtaggagagggagatgtcaaggccagctcctctatttctgctttgagcaactgaagagaaaatggactttgtctctggcaacaagaatgtagtagacaatgaacatgtttagttgactgtgaagcatccaagtgaatgtatcaagccagcagtggaatagagtggcccagaatacgtagaactttgaaccaaagtgagctatatttgtttgtggataaaatctgtagaactcaggggaaatgttctctctaatgagggacagagaagaaatgactagcaggaaatgggtttctctcctgctcaaaagtcagacacattgaagacaagatcactacttttagttcactcccctccccttctccattcaaaaactgtcactgctctgatgatgtcacccttctcccaaatgtatttatatgcacaaatgggtgtttatgaagctttcagattctctttactggtagggaacgtagttccttatcaggacaacaaagattgacatttgacagacagcaggaaaaacaagaattaaagcagcaaggctttctaattccctctaaaattattggctttttcttacaagcaaggctgccagagtttgcaattgttcagaaattgcagcaccgagagagtcttctgactgcagcaccatctcagaagctttttttgcccaggccagcctatgcccacagctgcatttctcacttcttctcaaccagctcctctcacccacctcctctgagctagtcgctcatgacccctgggggccagctagtgtaccaacaagaagcctagaaaagcttagggaaaagtctgtggttaatgctttccttatccttagcccttcaactaaatactcctgtgtgatgtcaggctttgcttttactagatttgtatttattgacaatttgctagagtttacttaactgtaacctgaaataatgtccctttcctcctaggattttctttgggaacttaaacaaaataacatattcatcataaacaatagatgaataaaaaggagatgcttttttctctattttagagtactctgtaaagttcatggaaccatctgaatcagcatcacctggcaggcttatagcagattttaggccaggcgtggtgggtcacacctgtaataccagcactttgggaggccaaggtgggtggatcatttgcagtcaggggttcgagaccagcctggccaacatggcaaaatctcacctctactaaaaatgcaaaaattagccaggcgtggtggcagatgcctatagacccagccatatgggaggctgagacaggggaatcacttgaacccaggaggtggaggttttagagaggcgaaatcatgccactgcactccaacctgggtgacagaacgagactctgtctcaaaaaaaaaaaaaaaatcagattccagaagctccttccactcacatacagagcccagatttgtacagtgcaagatagaatcttatttccccttggcctaaggagccatttctacctgtgtactgcaaacactgaaaaacctggacacttttggtctgagatgtgcatttctcaacttcagcttcaaattggattcaccgggggagctttgtaatgacactgatgctcagggcttcaatcagactaattaaattagaacttctgtgcatggggcccaagcaccagtactttaagaagtgccaggtggttctgtaatatagccagaaatgagaaccactggtttctattttacttactaagtgtattagtccattttcatactgctatgaagaaatacccaagactgggtaatttataaagaaaatgaggcttaatggactcacagttccacatagctgggaggcctcacattcatggcagaaggtgaaggagtaataaaggcacatctgacatggcagcaggcaagagagcatgtgcaggggaactgacctttataaaaccatcagatctcatgagacttactcactatcataagaacagcacaggaaaaacccacccccattattcaattacctcccaccaccctcccacaacatgtgggaattatgggagttaaattcaagatgagatttgggtggggatacagccaaaccatatcactaagctacttgagaattctatcactgctttaaaatccattaatatgtagctactccccttctctttcactggcagtcagtcagccttcttccatcttggatacctatctcctttttagtattagaacctttacaacatagaacaagctaattgctccacccaatatttacctataaatagcactgccctattgacattctcctgcttagaaattctgagtgcattgaggccactatgagacagggttggatctgggagatagtcttgaccccccagcttcaggagagcaggtagagtctcctcctccacacgctgaccaggtagacattgtggcactgaaagggagtctggcaggtaaaaaggagctcataaccttcgggaggacacctgtgttgaggaattgcttatatctaaaaacagcttctgtagcaacataccaaactctggctttgtatagtctgtcttaattaaacttcagttgcagcctaatgggataaaatgggataaaaaaggtaaactaacagaagataattgctagggggaaaaggaagctaaactttagacagcagatcttattggtacatggaaaaccaaaacaggcaagtagccagagaaaacttgaaatatggaaactctaatgtgtggttctccggttcaaatctttctctctactaaatggcaaatgtcatgggcagaaggtggaagtaggacttttcatttctatataatcaagcttataatttcctttcttgggagtaggttttgataaggatgggagaaagcacagacctccatgaacttggggaggaggtataaaaggagaaggatatggaaggtgtcaaagccattaccaagtgatagttttgggaagagagttttctgttttgcagttcaccctagaacaggcatattatagctccctttgccccagatcaaatcaagaaaactagctctcaatgtcaatgagagagagtaatcaagaatctgagaaggattctccatgcatcttgagactcttccttaggctgacctgatttttaatctttcctcctggggcctctcctatctcttcctcccctgtactgtgtcctgcccaaatagagactatgcttcttttaacatccacatgcctctgttacatcttccctgcttgtgatgccgaactgtgttgcaactacagtctattttccttttccgacacacatggtccaaactttatagccaataatgagcttcaaaaactttgtaactcaaagaaaccataaaacaccgctccacaaatttctcaggcaagatccatggttggcgaactgatatattcactttgcccaacagggatttaacttctgatcctctcttttcctgactgtggaaagagcaagactacatggcaggaatgagcctccagagagggcccggacaaacaccagatgaattaaaatatcaccttgattacagtgtacatatgtcctatttcttttttattatgtctttctctgttctaataatatgtcccatttattttagggaagcccagtccagatagtttaagaggaaggcattaaatggacatgtggatctttatttttggggaagaaacctaagaggaaaatctgtacccatataaacagccaaaaaaaccataacagccatctatttcctcatttcattttatgtctttctctgttctaataatatgtcctgtttattttagggaagaccgtccagatagtttgagaggaaggcattaaatggacatgtggatctttattttgggggaagaaactgacgaggaaactctgtaccctcataaactgccaaaaaaccattaacagccatctatttcctcattttcttaggtcctaagggaaaaccccagtggaaaccaacactaaataagagaatggataaaactgttttggggaaatttgagtatggggagaggaatggagattgccctggggagggcataaatagtgcctctctgaatttaatatgtgatgtccagagggacctaaatgaaacacagattctaaaataaattgtttgaaaggcacttcagaaacatggaggttatgagaaagaaaattttgattaagactcaccagcctggattcagtaaagaaacactgttcttaatacctgctgtagccttttaagttgtctttttattcgcatgacaatgagtcagggcaatacactcatatttttcaaaaacctttcgacatagtttaacttctggagataatagccaaagcaaatgtcacagaataaaggataaaaaagctttatgtagaaaagtcctaggtacgggagattaaagagagccccaggtaactccagggctcatggaatgtggatggctgatcctgtttctaatgaggccaggaggaagatcacattcaagcccttaaagaaaaaattgctatctctgggaagatacctctaattccacccaaacttccctaaaatgtgttgctttggtcatagagcatagagaaggatgaaagaaggcgtacagagagtttaagaccatgtctgctcctaaagcagtgactaaccagacctattgtcagatatacactccagatgtgttaccctagccagccatttccaattgcttccttcctgcaaatctctacgaaagtctcattcaaaggttatcttttataaaaacaggtgataaataaaggcagctagagcttggggagcactctatcttgaagagctcatctatcaagttccctctaattcccctccttccttgcttcttcctctgcagaagactctccttctaccacctgacatgacacctctggaggtaaatgcccagtccttgatgagactcaaggccctgtccccctaacttcccatccataggcatggacctttatgagttgttcactacttaagccagatctacaacctttgtgattggtctggagttagacccctgacccaagctggacaagtcatatatcctcccaaaataattgagaagtgcaaattaaagagagctaggtagtctctgctgtggcttaggtattacattaaaaacaaaaatgaagtcatcgagagacaatcatacctctccatgtaaagtaagaggtagagaaagctgaagggcagagaaagaagaatgaaaaatgtatgtgcagagaaacagagatggagagagtacaaattgaattgctaattcctattttctgtccattgttgtccataaaacgcccctatatctttatatctaagtcatctctttgttcaggttggctagaatcgtttcctccttgaaatcactcccctcgactaaatgcagtcccctgttctctcctttctaatctcttccctcactatggatgcttttatctcccatatctttctagttccctgattccccacctcctattccctaaaaatgctggcttggcagtgtactgccattagatctggaaagccctggtattttattattatgaagagactaagctgagggtagaagaatctattcatctccaagttgccagtgaactctgaggcatcttagttattagtgagttgagctgaagaataaaaacaattttcaagtgcccttaggcaaaaatatgtcttacctaccaattccgcaatccctgagaggatctggaagccatagggattgtacgtttctaaaaggcaacatacagagactaaattatactttctatacatccttttcatgtgttctgggaagtgctggggttttttttgtgttttgcgggaggcgggggttggccagattctcaaggccctccctctctgaaagttttctatattatgacatggtttccaggatgcctctagtttcccagggaaaagagctgatcaccatgagttcctagaaaactatgaaatgtcatggattttcaagctatgtgccataaattaatccctccagagatataaatccggatctttagttattagtagatagcccagaagaataccttcttggaatctgaatatttccaaatcctaatttccagagactctccagccttctgtattgtttcatatattcattctttcatgtattaaaaaaaatatgaacatctactatatcccagtcactaccatatgttacattgatgcaacgagcagaattgtccaacggcgacctggggaaccaactgaaacaaggtattttgcttccccagcagatggtgttgtatctgaacttatctcttttggaacgaggggcttcctttcccacagaggatgctctaacttcccaggggcctcaagtgcctcaggaactgatcacctggcttttccacataactcctttaaacagctgacactcaaatccagactgcctgctagctaaataatcttattatctccacattgaggaagctgctctctaaaaagagaaagcaataatgggaagggctcctctcctggaacagagaaaagtatcatggagttggtagagcttaatttggatgagattttcaaggaatgattggttaatgagggaaagacaaactgttgcctgatggatgtaaagggcctcccaggcatgtggagaactgagagaaggacagtttagacacagggcatagcccaggtgatatccctagaaaataaggggcgtatggactaaaggagctcgagggaggccagtgtggctgaagcagggtagagcagggagaatgtggtttgagatgagactgtaaaagtactaaccacagctagccactattcaaagtccacaaaccattctggtttagtctctggcatgaaagagagtctacctttcataagaatcccaagactagagttgaaagcagagctatcactgtttttcagcttgctagtccatgagcatactttcataaagcagtctcctatagtgggagtactccctcctccatatattttctatcatttagaaaggatgggttcaagaaatatccctcccactgccatggtacttgcataccaaacttgcaaccagaatggtgatgataatgctctggatgctggtgattataaccattaataactagcattcattgatctactatgtgtcaggatctaggtgaaatacttcatactatatatgatttaatcttcatgagcatatatccttgtcacaaagcagagttaggggtatgagagagtatctctgagagaaagtggttataaaaggtcatgtttttttacagtacatttgtcatagtggcatgataaattgggtgccaaaacatgtttccattacagaatcattgttttagaaataaatacaggaatgtttaggcatgtccttggactggacttgggaatacatggttcacaaaacaaacacgcttcttcccagcattcttcaaacaagaatcccaaaatctggcaactgaaagaaattttatgatgaaataattggaactctcttaaagggaaagtcttgtggtcctcaagtctggaaggcagagcaaaactggttgtattttcttccatataaggagtatgaaaaagagaggtccacttctttaaaaacttttgatcttgctctagtccaatctattttccacattgcagccaggacttttgttccgaaacaaaaatacaggttcttaaaaattaccttgctaaatttatttataaaaataaaattattctccccattttcaatgccttcttcattcccagatgttgaattagtgcagctttgaacccctggagaatgctcttctcaaagcacaccccaggcatcttctggtgcccgtgatgtcccctagaacttcaccagctgccttggccatactcctagacagacctcagaatgctcttgactctcatctctatcctctctttaaccttggattggcctcatgtggtgatttccaccatagttctgcacctgcctcacattggtcaagtttagccctggttgagtttagccctagtgcttctcatgaatagtgaccacatctttctaatcagtttgtccagaagtgcaagtgagacatgatcttgaagaattgtatcctttgattttgttcaggcatgagttctctggaaatcaccttcaataataattttcagtgcaaaagcaactttattaacatagagaaatttggtatgatctatgatatagtttgtctttgtccccacccacccaaatctcgttttgaattcccacatgttgtgagagggacccagttgcaggtaattgaatcatgggggcaggtgtttcccatgctattctcatgatagcgaataagtctcatgagatctgatggttttaaaaaggggagtttccctgcacaagctctcttctcttgtctgctgccatgtgagatgtgccttttactttccaccatgattgtgagacctctccagccacatggaactgtaagtccttaaacctctttcttttgtaaattgcccaagctttggcagcttccatgtggtgttgagcttgccagtgcacagaagtcaagaagtgaggtttgggaatctccacctagatttccgaggatgtatggaaacaccagatgcccaggcagaagtttgctgcagggaaggaccctcatggagaacctctgctagggcagtgcagaagggaaatgtggggtcggaggccccacacagagtccctactggggcactatctagtggagctgtgagaagagggccaccgtcctccagatcccagaatgatagctccatcaacagcttgcaccatgcacctggaaaagccacactcaacaccagcccatgaaagcagcctggataggggctgtagcctgcaaagccataggggtggagctgcccagggccctgggagcccacctcttgcatctcacatgacctggatatgagacatggagtcaaaggagatcattttggagctttaagatttgactgccccactggattttggacttgcatggggcctgtagcccctttgttttggccaatttctcccatttggaatgactgtatttacccaatgcctgtacccccattgtatctaggaaataaccaacttgcttttgattttacaggctcacaggtgaaaggggcttgccttgtctcagatgagacttcatactgtggactttgagttaatgctgaaatgagttaagactttgggggattgttgggaaggcatgattggttttgaaatgtgagggcatgagattggggaggggccaggggcagaatgatattgtttggctgtctccctaccaaaatctcatcttgaattcccatatgttgtaggagggacctgctgggaggtaattgaatcatggggacaggtctttcccatgctgtccttgtgacagtgagtaagtctcataagctctgatggttttaaaaaggagagttcccctgcacaagctatcttctcttgtctgccaccatgtgaggcatgcctttcaccttccaccatgattgtgaggcttctccagccacgtggaactgtaagtccattaaacctctttcttttgtaaattgcccagtctcaggtatgtctttatcagcagtatgaaaacagactaatacggtctacatacaagctgccaaattagtaacgcacaacaaaaattccacattcagcttcctccagtgtcaggttctttctctcacctggatataggataaccttaacctctcaagttatcttgtaagtccttgagcttttgaggaagaaaataccctccacttgcacataaatcatttgagtgtttaatgaatttgattatatcttaaggaacaggagcaatgtcattgatactccaaaagattattttcctagtagttcattgcttgtttttaaattcaggaatgaccaatgtccagataatttttaaaaaattaggaaaaggaaaggaagctaacatttattgtgtaacttcttttggacatatgcacactctactagatatgttagttatacagtttaactcctaagtccaaactgcacacactttagatattctacagaggagcataaaactctctgggttctcaccataaaagtttcctttaatatagtcttctgcagtaagtttcctggggggtatatcttatatttctaatattagacatatataagttaataataaatatgccttaaattgatgtttttctgactgcaaaagtaatatataaatgtagaaaataccataggattatatggcttaaaattgataatttcctaaaagttacccttcaccccacaagataagcactgttaacagccaggtaaactatttcttaacttgcatactagcaccctttactttttgactcttgctttcccttcccctttcctggctcacactttgttatcacacttctccctatagtgggtatccaccctttgtgtctgtctagcaccatcattttcctcagataacattcttctctcatgtaaatcatgcattcttgacatggactgccaaccacagaactctatttccctaagcacagcaaacggactgaattagttgtatggctatctctgggcacatcaccatggccatgacaatggaggaccatgactggacagactcatgtcacaatttagaacatccacaagaatgttcctggccaaaagcccagttcttacaaaataggaagtggtctattcatcagacctgcatggatctcagtgaaggtcaaatttaaaccatctcacaccaattccaattggaatctatttattacttaaagtctcctgagaaacagatggcagagatatcctccctcagccactatccatatatcccaatctgacagaactgacacctggagttaaagacagatctgttgctttgcaatactctgatttatttctgatgacaatacggcatttacctaccacaggcaatgaaaaggagaatttcacttcttttccagtctcctgctaactctttttggtgctctgggtagatgactgtggtcaattgcctccaacagaaaatgcctgttgcctcagtcactaattccaaagactaatgttgacattctattctgaggcatcctcatctcatataaggacatatccttgtttgggggcaaaaaaatcaaatgtgcaagagataaagcaatatgaatgacccaaagcaacagcatttccaatgacatattttactgctaataacttcagaatatatcttccatcctagaaaaaaaatacccccattccattacttcccccaaataattgttatttataaaatgaggctaggatgtcataaaattagcatttacagctagatgaaatcttaaaagataaggctctggctcagagccccatccataaagtgccaagctagcattgttcaaatgttctctacttcctaggaagcagattcatgcataattgcatacggctaaaagacaaggcctatacagtacgaggtgagtttctgcagcaaatttcttccttattcctgggattgtgctcccaaatttctcagctttgaatgttctcagaatttatttgacagtggcagagaagaaaatagacttcatagaataatagtgagcaaagagtctttgacttcaattcaccaagattggcttaatcaaaaacagaaaaaaaaaatgagatgaaaaagtaaagccatctggtttgaatattattgaggtattcctatgtgtctggcacctaggaagtgctcagaaaactagctgttgtgaggattcaataacacaacatgtataactgctggacacatatgtctgacaggtacaaaaggctcagcaaacatttgttccccaatatcccatcaccactactccatttatgctcctgcctcttcttctccctagaattctgtctcccctgtcatttctactagtcaaactcctatggctcttcaaggattaacttagataaaacttccttcaagaacaccctctcaagcaaactactcatagtatctccttcctatacattggtacatttctggtaccttttttttaaataaaatttatcatcttcccagtgtattataagttcattggaaattttaaaagccagttgtattcctactgaagacatctaacatcatatgtgccagagccagaattcggactcaggtgtgtctaattcttgaacttcacttttccatattatgctacctttcatattatgaaggcatgacccaaataaaagagtagctcagtttattcatccttctctccaacttagatgtggagagaaaatcacaccttatctctcttccagtttctcttccttcatttctttctgagtacactaaggaagccacccctactgagcctgaaattagaagtcaaatactgctctgccttgtctctcatcccattcctctcagtgacagtttaatggcatgctgttaataagtcacagacagattcctgtggtcaacaatggaatacctatttttaatcagaggcacaaggctaagtaacatgttttaaccatcaagcatactgtattagttagggctctctagagagacagaactaataggagatagatagatagatagatagatagatagatagatagatagatagatagatagatagagtttattaagtattaacatacatgatcatggggtcccaaaataggctgtctgcaagcttgaggagctaggagggctggtcctagtctcaggtttaactcagtttaactcctgagtttaactcttaactcttctcctaactgaagaagttggagttcaatattcgagggcaggaagcatccagcatgggagaaagatgtaggctgggaggcctgggagctgatcaggtggtgccctccagattaagagtgagtctgccttccccagcccactgactcaaatgttaatctcctttggcaccctcagagacacacccaggatcaatactttgtatccttcaatctaatcaaattgacactcagtatcaaccatcacaagcccaccccttgtcaacttgaattcatacacatctcctgagatcatacataatcttcaaataaagacaataataaggtcataattatgcctaacataaattaactattttttgtacaactggaaatgaaccaatccccaacccaaatactattacataaagttaacaatacttacatgttgatgtgaagtcagtaaatcttatgtcacatgatatagcagaaatgaaacaaaatgaagatattttcttagtagaagggtatacatgcacaaacatgtttttaacaaacggaggaggaaatactcatgacaattacagtcctcgtttctgcagctggtcatgtggacatagctggtattgatgactaccttcttctactacccattctgtattccctttgccttcagcaagcacctcagcaggtcgtgtttttttcctggtagaatgacctaaaccttcattcctgaagggtctgggttatttgtagtcttgcctggattgggctgttgtagtttcccattgacctgaatcatagggcatggtaatactaagagatgccctaatggatctcttgtattccacacatactcttccttacctccgttgtggaatagtagactgatttcatcttactagtccaggtcaatcgccccagccaacactgtaactcccttcttagcctgttgacttaaaggtaggaggagcccaaagtgtccaggtggcaatcttaacttccagtttaatagaattgtgtgtctcctggggacagcattcatccctctataactaagacccctaggccagcagaacataatgccgcaggaacaggaggcaaaaattttgccagtggatcactaggggtgatggtgagtggtgccacttccacttccaccccttgattcctggacccgtaaatcatagctatgagagaaagagtaccatatattgaatgctgattcagagcatacatggctcgctggagaattttgccccagccatgcaaaatattgtcacctatttggctttgtaatggtgacttcaaaagggattccaccattctatccagctgcttccggatgatggggaacatggtaagaacagtaaattccatgagcatgggcccactgctgcatttctttagccattaagtgagtgccttggtcagaggcaatgctgtgtggaataccatgatggtggagaaggcattccgtgagttcacggatagtagtcatggcagaagcatcacatgcaggatacgcaaaccaatatctggagtaagtgtatatttcagtgaggacaaacctctgccctttccatcatggaagaggttcaatataatcaacctgccaccagatagctggctgatcaccctcaggaatggtgccatattgagggctcattgttggtttctgctgctggcaaatgggcactcagcagtggctgtacccaagtatgccttggtgagtggaagtccatgttgctgagcccaggcataacctccatccctgccaccatggccactttgttcatgggcccattgggcaacaacagaggtggctggggaaagaggctgagtggtgtccacagaatgggtcatcctatccacttaattattaaaatcctccttgggtcaggtcacctgttggtgagaactcacatgctcaaatatcttcacagcttttgattactcagagaagtccatactctgagtccatacctcctccccaaatttctttatcaccaattttccaatcatgcttcttccaagtccctgatcatccagccaaaccattggctacagcccatgaatcagtatataaccacacatctgcccatttctccttccacgcaaagtgtacaacaagttgcactgcttgaagttctgctcactggaaagatttcccttcactgctctccttaagagatgtcctagaaaggggctgtagtgctacagctgtccacttttgggtggtgcctacatatcatgcagaaccatctgtgaaccagggcctagtcctctcttcctctgtcaacagatcgtagggaactccccatgaggccatttggtgtaggctggagagaaggcagggttgcaggagtaaagaccataggcatttgggccacttcctcatgtaacttacctatgccttcaagacctgctcaaaactgatcacatacataccacttccatttcatgatggaatgctgctgtgcacaacccactttatgactagatgggacagaaagcacccagtccatgataggcagttcaggtcacatggtgacttgatgacccatagttaaatgttcagtttccaccaaagcccagtaacaggccaagggcggtctctcaaaaggagagtagttatctgcagaagatggcagggccttgctccaaaatcctagaggcctccactatgattcacctatgggggcctgccaaagtctctaaacagcatccctatctgccactaatgcctcaagcaccattggatctgctgggtcatatggcccagtggcagagcagcttgcatagcggcttggacctgttgcaaagccttctcctgttgtgaaccacactcaaaactggcagcctttcgggtcactcaataaatgtgccagagtaacataaccaaatgaggaacatgttgcctccaaaatccaaataggcccactaggtgttctgcctctttcttggttgtaggaggggccaaatgcagcaacttatccttcaccttagaaagaatatctctacaggccccacacaacaagacccccagaaattttactgaggtagaagttccctgaattttattcagatttatttaccatcctctggcatacaaatgtctcaccagtaagtccagtgtgtttgctacttcttcctcactggatccaatcagcataatgtcattaatgtaatggaccagtgtgatatcttgcggaagcaaaaggcaatcaaggtctctccgaggaagactataacacaaagccagagagtttacacacccctgaggtaggacagtaaaggtatattgctggccttgccagctgaagacaaattgcttctggtgggccttgtggacaggaatggagtaaaggcatttgccaaatcaatggctgcataccaggtaccaggagatgcgtcaatttgctcaagtaatgaaaccacatctagtacagcagctgtaattggagtcaccacttggttacacttacgataatccactgtcattctccaagatccatctgtcttctgcacaagccaaatgggagaattgaaaagggatgtggtgggaatcaccacccctgtacttttcaaggccttgatgatggcactaatttccgcaatccctctagggacatgacaggttcttgatttactattttcctaggtaaagaaagctgtaatggcttccatttggcctttccctccataataggcctcaccctatcagtcagggagccaatgcgggggttctgccagctgccaagtgtatctatgccaattatgcattctggcactgggaaaatgaccacaggatgagtccagggacccaccggacccactgtaagtcagacctgagctaaaactccataaatcactggatctccataaacccttactttaactggaggaccagtatgatgttttgggtttcctagaatcaatgtcagttcagagccagtgtccagtagtctccaaaatgtctgatcatttccctttccccagtgcacagttaccctggtaaaaggcaggaggtctccttggagaaggacaggagaaagattcactgcatgaattcttggtaatatagtggggtccttccttaaggtgacttgcctccccttcattcaaagggttctgggtctataaactggctcaagtctggatattgattgaggagacttgattctctgtttttataattcaaattagtcttttgtccgttcaacttagaagttttctgcttatataaattaagtagaaatgcagtaggcttccaatcaatttcacttctaggaacactgtgattaattagtcaatgccagagctctacaccaatcagactattctgattgctgctttgtctctgctgtccattacagtagctacacccaccttgcctttgatgattaagtgccaccatgtggcccctgacacctcaggatctaattattcccattgtatttacatttttacttgagtgactgaggttcccactgttagatctgacatatagagaagagcaactacagggcttctcaaagatgcaggtgctgccatcacaaatctatttcacaaggcattggtcaagggtatatcttctggaccctcctacctgggatgagtagatctaagttgactaatcctctccaccatcccactctccctaaacctttggatcccttcctctacattaaaccaagggacattagacatttctagctcactcacagtgggccatcttttaatccatatttctgctaatcaagcaaataaactattagaaccttttttaactcctcaagctgcaacattagaagcagagtctctacttagtgggctcaaatcaataaatcggcctgatgcaaatctatgttcctttcaccattatcccatacccttaatatccattcccatgcctgttctccagatttatgtttatatacattagagaactcacgtagttcttttcgagtgtagtgcaccttgtcatgggtcacactctcaacctcacctctagggtccccccgaggcttcagttattggtctaggagcaaacaggggtgttgagggtggctcctgagaagaatcaacattattttgcttggcaactgcctcaggggaggccatcactgtcacctcaggcagcacgggatttatctccccagacaaagatggaaaggctgatggcagcatgggtcagggaggggacattgccactactggggatggggaagctatttattctggcaaaaaaggttcaccagggttaacaaactcagtgtccccagcttcatcagggtcctcccacaagtccccatgccatgttgcagggtcccattcttttccaatcaatgccctcactttaacagcagacacctggcaagaccgtgcatgcacctttcattgcaggtcagccactcgcataataagagcttgtgtctgtttcttcacagtttcagctctttctctacaggaaataagactctcactcagggcaatcttagcagatctgaggctcagtatctgcttctgaagccaggagacagaatccctgagttcatcattttatttcatcactttgtccagtgaacttaggagcaaccaaccagcttcattatgttccttggttctccacatatggtcaaaggtattatgtatagagtcactaaactccttgcctctcacaagcagtgaatcaggagtgtcaaatgcatttattttacataactccctaaacagttcacgccaagaactatcagtgttctccatactaataaaagtagagtccttagcattttggggtctaatcatattaagcagccaactccagaaaccccaaaaccaacgaaaaaactccatccttaatattctatttttctagaaccactcctggcaccaaaatctgtaatagcgttctctagagggacagaactaataagatatatataaaggggagtgtattaagtattaacttacatgatcacaaggtcccacaataggctatctgcaagctgaggagctaggagagccagtctgagtcccaaaactgaagaacttggagtctgatgtttgagggcaggaagcatctagcacaggagaaggatggaggccgggaggctaagccagtctaaccttttcacatttttctgcctgctttatattttctggtggctgattatatggtgcccaccagattaagggtgggtttaccttccccagctcactgactcaaatgtaaatctcttttggcaataccctcacagacacacccaggatcaatgctttgtatccttcaatccaatcaagttgacacccagtattaacaatcatacctaccttttagtatgtatattgaagtattccatacaatgtacactgataatagaagcatcaatgtcattttaacttatatttcatacaaaataatctgcccatctctttccaatgatgtagaaaatatgactctctgatcataaatgaatgaaatagttcaatctgttccactattctggtagagctatgcaatgtgcctatgaaaaagttgattaattcctgagcaacatttaggataataatatctaaattgaggtaagtgatgattatactatatcctgcactggtcagaccacatgagtaatatgtcatggaaatcaaattttaagacagacatagaaaaacaaaaaatccagaggggagctgaaggtactgaactactaaatggtaccactgaaggtactgagtagcctttgaaccatgccaattataatgaataaagggggaactaaagaagaaaaagagatgcctcagaaggatgtctcttgtccccaaaagtctgtattattataaaagagagaccaggaatgcactgtgttactctaaaatgtaaagcaaagattagggaggagaagtctcaaaggaagctgatcttacagaactgtcatctcatagtaagaatgccttctgcagttcacgaaaggatcctaaccatcagacccaaccaaaacataagagacttcctgttcaccagtaagcttccacctctttagaatctcacaggagagcttccttgaagcaattgtcccctaagatcccttctaatttgcatattctccaaaactggctcaaccttggctccaattcaccagcttctgcccagctcagcctctgagatggccacagaagaagcaatagcagcaggtgaagtggtgagcagaggcacagctgaagcagagcctctccgcatactttaatgggtcttgacaaaagttcctgggtcctttatcctttccaaatcctgttaccaaggcaacttcttgctgtaactgtgaaagcagacagccctacatgaaattatgaccactttattcttagaacaaaatgatttgaatgatcagagctcacagcttgttttacacaaagtgagacacaagctaagtggttcctctcagaaaacaagtgtgtgtgtgtgtgtgtgtgtgcacgtgcatgcacgtgtaaaatctccagcctcaagttgcaccattagaaatttgttgtatcaagttatgctaatgtttctatcacaatgaacaagaccactggcaaagataagaaattaagtcacaaacatcaatgtgactaaacttgacatactctttctaatgtgaataaagtcaaaataggataatggttaagtgcttatcttttcaggtgagattacctgatttcaaacttgaagtctgccacttacaagctgtgtggtcttttgtctttgacgggttattaaacatctttgccatttaggatcatcagtgtaagataaaaataatacctcttcttcgagtttctgggtaaataaatgaattaatataaatatataaattatttagaatgtatctggcatatagtaagctatataagtgttagctattgttgtaatagtgaaaataatgctgctattgctgatgatgatgacagagaccaggaagcagtgaagagaagatactaggagccctaagatttttgcctgggtacatagacaactaagtcaaggaaaaaggaattgacttttactaagtgcctatgcgctcagtaataagccattagagacgttagagcctcaattaccaagaagggacagaaaccttttggatgacagaatgttaggaaatttctggaccttgtgatttctgacaagacatgaaagcatagtcatgagcatctccagcttaggacaaaagcagatgttctcaagctgacacaaaggaaatgcaaggagaaaactcctcctagaacaagattttgctacttattccctcacaattatgcccctttccaagttattaaccccttttcacatgacaggaggtggaggaggcactgctaagagaggtggaagaagtcagcctcccactaatatgtttcctttcttccgtattttccttgtatacactcgctacctggcactatctggtacctcaaaagcatctgagctttctaagcatcttggtacttgtagcaaatcagatcagacaaatataagcaattaaacagctcctacctatatatcaacacttatcagccaaatgaatgtcacttatcatctggtgactctgtttggtagagaggactacagggatggagactatcacactgcttactcccacagaagcttggattttcaaattcagttgcttaactaagtggccttcagattctaacttcttatattagaagctcctctttcctcaactctactgtcagctgccctgtagactgaaaggtcaccaaattgcccaatatccatcatctttccaggcctcttgaagctggaggacaagtgtggtttttggtgctcgctgagaaaacagcaatgtgagtccttatagtcttttttccaagaacagacatgtatctagcattatagcctcgaatactctactcagtgatatggctgcttctgaagtagctgctcccttgagtcacacaaggaagcatgaagaaaagatagaacttgacactgaagtttcaccttgcacaatgatggctccctcatgtcgctcataatgaagtattcctctcctccttttaccccagttgtaatgtgcatatatttctattaaaatactcataacctgtggtacttctttatgaatattacttgtctctatgtataagacaatgagcctttggaaaggaagcatagatactgtcatgttcatctactattttgtctgatacatagtaggtcctcaataaacatttgttggattgaatatatttacattatgaggttcattttagaaaaggttaaggaaaatgcaatagccactagtaattacagaagttagcactgatatgaaaacaataagacaagcttttgttttttcacaggcatgaaagtccaaagtaaatagactatcttttctcttcttggatccatctacatacatgtaataagaccaactatgtaccaggaactatgggattctgttgccttcatctcttttctctcacaggggctctccctgctccctgccaaggtggtggtgcctgtgtggtagaagggaagagcgagttggggctgcacaggcacaatctggaaatgaccagaataaaaatgccccagcccaaccagcaagcaggactccccaatcagatttttatttctaggcaatgctgctagggaaaaactctttcccctggagaaatcaaacaaaaacacagcttgggatgattcatacaaaggttctcaaacttagctgtactttttaaatcatctgggaagctttaaaaacctacttatgcctgggccccaattaaatccaaacatcttggggtagaaccaaggcacttatagtttttaaaagctcccaaagtgattctaatgtgtagccagggttgagaattactgatttacacagtcctgctcttcatatgcagtttaggcttgtggttacagttacttagctgctcacctgtctgcactaatatatacactactatgctttgctgctgggaaagaaatatggcaaggatgaaaaccagttctctcggtaaacacctggttctattaagatgtccagctggtgccaggcatggtggctcatgcctgtaatcccagcactttgggaggacaagggaggtggatcacgaggtcaggggttcaagaccagcctggctaacatggtgaaaccccatctctactaaaaatacaaaaattagctgagtatggtggtgcatgcctgtaatcccagctactcaggaggctgaggcaagagaatttcctgaaccaggacctgcgatctcagagagctgagatagcaccactgcacttccagcctgggctacagagtgagactccgtctcaaaaaaagaaaaaaaaataagtccagttggttagtgggaaaattagcccaatggaaatattgacaactagctttggtttgatattcaatggcttgtgcatttgtgttggcctcttactagagctattccctcttggtctgtttttctttggtcttagtgctgctgttacttctcaatgacaccaaataccattgtctgctccaagtgcttggttctcttccctgagtttgtcaacaacttttccaaagtaatgggtaacattggcagcttgcttactttactgtgatagcactgcagactcttcacagtgggaagcaataggttctctgtgtatgctcaagacagcaggtacaagaggaagcaatctgacttactccaaataaactaccaaaaaatgaagggtggggggacaaaacactttctggcccctatggaaatggacaccagcacatccgctccagctggggccagaaagtgacattttacagtgggaggcagccacagctaaagccttcctctcccgaacaacaattaggtcaattctgggagtctcgggacttgtaacacagctgaatggtttaagaacacaggccacagaggcaaaacaacttgagcttgaatcccaatattgccacctactactttgtgtaactttgggcaagttatttaacttctgtgatttattttcctcccaatgaagagaggagataatgatcacactcatctgttacagttgtcatattatatgacatgaagcatgtgacggtgaaactgagagtaaaacccgggcctagtcatcccgattcaatgctgttttataattccactattgtaacattaaaatgttttaattatacatttttacatttgcataattattacattttaactgtaatattaaaatgtaacataaccggatttagcacgcggaaacctcccggtcagaactacatctacttcataaattgagagactcctatagtgcagcattttaaaagtaccttcctgcttttctgtaaatattctttccaggttatatgtgaacatatatgccaacatttcagaaatagaaaaagcaataggtgaattatttatgggctagtgaatgttttgcctctatatttcacatatgagataaaatataaaagacagttttgttttgagaccaggtctttctctaccacccagtctgaagtaaactggtacaatcatggctcactgcagccttgaactcctgggcaagcgatccacccatctcagcctcccgagtagctagcactataggcatgcaccacgattcccagctaatttatttatttattttttgtagagttggagtcctgctttgttgcctcagttggttttaaactcctggcctcaagcaatcctcctacctcagcctcccaaagcgctagcattacaggtatgagccaccatgcccagctaaaagatgcctttgaaattatgcagtgatcctcagttggcacagcacaattgtatctaacattacacaatactttttttttgcattgatatatacattcagttttctaagaagaactcaggcagaatgctatttttgctaagagattaatatatcataagaaaaaattgtcaaccaaaataacagagatgaggcaggagaatagcagaggaagtcgggggtgaaggggacccattagatgtagactagcttgagcaatagcaaaagcaaaacatgcaagatagcagaagcagaacatatgagataagggagtaagcagtatgtaaataaaaaagtaagcagtaagttggaacaactgagcagaggaagtcgggagcgaaggggatccattagatgtaagctagcttaagcataacgtgcaagatttaaaaaaagcagaacatagagatttttttaaaagtaaacagttaatttagtgcaataagggaaagataaggataagcaatcagcttacaagagatagaataagagtaaggtgcaataagggaaaggcaaggatgaacaatttgcttatgagagcaagtgagaaacaaaacccataaaatctaacaaaccagtgctgataccacttgcgggtcagcccaaaccattctggatcttactgtgcttaataaatcttttgctgcattgctatttgtgtgtatcacatccaattctttatttgcaacaccaagaatcttgcacttcacaatatcagccagtaacagagagggactctctacaagaaaatgatatttattggtgaatagagcattgcagtgggaatatgtgtgccataataaaccatgtgcttattcagaaaggtaagggaatgcaaaggtttttaaaggaaaaatgcaggagggattatataattgtcttgagataatcatccttggctgcaaggatcaataacaagagtgataccagttcaaggttggacaggctgttgtgtggcagatgtccttgcagaagtgttttttgtgtgaggttgcaatggcatttatgcaatgttatggttttctcagagtctttgtacatggctgtgattttttcacaagtatttttgtgatagttttgttatcaggcatacaaggctctcttcatagccttccacagctctatttttcagatttttaaaaaatgtaagtgaatccattttgattctgacaactttcacagaatcacctgcctcccacacactaagcacacctcagcacatcgtgcagtggttttgtcacatgtagaacagaattggatacatgttgtattcacaggagaatactaggttttcaaatgataataaatgttcctaagatacctttctctctacccttatgattattcttttcagctagctgattaccagagatttcttattacctaaattatcaaggtttatctgtggcagtatgtcagatgtggtctacatgtaattgtaataaacaaacatcctgtaccatgtccaagtctactgcaatcttaaccaactaatcatggataccatctattgagtgggtagtagttgctttgtggtagaaactatgctaagccctttgcatgcattagttcatataactgtcataatacccctgtgatacctatttaacagataagaaattcaaagatttacccaatccaccattgatgggcacctaagtcgattccatgtcttcgctattgcatggcaatgaacatgtaagtccatgtgtctctctggtgtaacaatctatattcctttgggtacattcgattgctggatcgaatggtagctctgttttaagctatttgagaaaacttcagctgaaatttacaaaagaaaagaaattcaaagcttaaaaacgttgtcacatctaaagttacaaattaagaagtggcagaaccaggatttgcatatatgtatttttgattgccaaatgcaagtggttagccgtgaaggctactgagaaattgccaggcaaatataatgctccaatccagatgcagaagtgaggcacagtcactcagaccaaatcataatcattcatatcccttagagactggttatttccttctaaacactcaccaggcagaggatggtgtcacttaggatataaaagaccaaaaattaatttttagggaagaaaaactgataactttgacagatatccacagtacaggcattttaaataaaaatataattatttaaagttatagaataaataactaataaaacacctctataacagcaatcattttttgttgctgctgtaaaatgttaccacaaaggtaatggcttaaaacaacacaactgattctcttatagttctggaagtcatagttcaaaatcaatcttactgagctaaagttgaaggtgttaacagggttggttccttatggaggctctgagagaaaatagttctctgccttttcagcccgtaaaggtcacctgcattcctcagctagtgtctccctcctcacatcaatccaacctcttgtttccatcataacagctactactatttgggtcctcctgccctgctcttataagggtccttgggtttacatttttcccacctggataaccctgggtaatctcccctatctcaacattcttaatcatatcagtaaagtcccttttgccatgcaatgtactttattcacaagttttgggggtgaggacctggacatctttagggaggcattattttatgtactacaattaccaacacttacatttttcaagttaaaaggaaaaaattaattagaaaaaaaaaaaaaatccagtctctattgtactcacctgtgtccaatttccaattaatttgtggtctttcaggacttactttaagggaaagatattatttttctcttcttgttggaaactttctggagcatgtgggtgtagtgactggtattgctctgggttacagagcagcttggatgagcatctgtgcagaaaccactatggtaggctatatttaaaaactgtttatttcaaatgttcaaaaaataaaagggctgggtctctagcaagaagcagccttgaatttgctgcagaaagaagatagagattataagacgtagagggtggttcaatcaatccatttaatattagctgttcactaaaaatgagtgaggaggagagagaaaaaaactgcaacttcttgaatgataattaaacctgttaatcatattctgattagaaaaatatataggaataaacatgtgcttcatattcctgtgggttttctgttctggccatgaaaaataaaagagaatcaaactgccaagaggctttttgaatggggttggataacaaaaattcccccaaaaaacaaaaaactttctgcaaaatcttagtggggcaagcacatgcaaaaaactattttgttttttctccttgaattaataactggagaacatccactcacttaatgccctgggagagagttgtacagtcttctggtgtttcaacctgatgagaaaagaactctacaactgttgctacacagatagagctatgtgtttgaaggttcaaactgcttcttctaagaaaatcaagtgacattcaaagtacttttgaaaagagattaacacagttctaatactaggaaactcatgcttatctaaatgtttctcttttgtttcagacgtgcttctaataacatgtcaatgtatatattcatctcctagaaaggcattaactaatacataatcttcatttattttatgctataatattatttaaaaatatactcaaacatgaaaatatgtataatatgctttgaaacagctagtaatacctaatacaatattctcaattcaaattgctttatattagtgagaagagagacacagagacagagaatcaatcactgggctagtagttctaaacttgctatagtacctctcaaactttaatgtgcatgcacacacacacacacataaatcacacacagacacacacagagactttaatgcacaatgtacctgtgaatcatgttattaataacacacagattttgattcaatagttctgggcgtgggaatggaggtagctcatagattctgtatttcctataaactcttaagtgatgtcaatgtcactatttttccccatggagtagcatgtcatagggaaatttgtaaaattacagaaccccaggtaccaccgcagaccttcccacaaatctataattttaacaagcacctttcaagttatttctatgctacctgccttacactgactcaatgaactgagttggcacagtggttacaactcaaatgcctgcttcagacatgtggttatgtaaatgcttgaattggatttattttttaaaaggtgctaggctacttgaactttgaccaagcatcaaactagctttaattacatgccttttaacaaactattgctgcctttttatggtacacaagctacctctgaccctggagttggcagttaacattttagaggctaagatccctgtgaaaatttcatataagctgtgaaacatctacccccaggaaaatctacaaatgcacgtgaatgcattttgtaaacaatttcaggaaattgcacgttttctaatcaatccatggatttctgacaggttcatgaacctctggctaagaatccatggttcagttattatgtcttgcaaataccatccatttcagtgatggaaacatactacttttaaatattgttttggtactgttttaattcctctgatctagctccagcagttatccctgaaaatggcccatagcgtctggttcagagcttctcctcaaccactcccaggtgctctccatggtactggcctcagaatctgatttcaggcttccacctgcctctattcctcatcctgtcttggcatgctccctaattgagcttcttaaaaattcttcatccaattgtaacttttctttacgaggccaagattctgtatttcaagatttctatgccaatctcccaactttgagactgcttcttcctttaatcaaaagtcattacttaaaagaatctccagtaaatcaattaatattttaccttcctttcccatgaatactttttgacataccaagaaatgtattatacttcttattctcaaagttttaccagtcttaggagccctctgcttaaagggactttcatttttaccctttttgaaaaaaggtttttaaaatgctattttgaatagaacacaattatacctcagaaaatgtacaataaaatataagaattttaacattaaaattaatagagtgatttttattgttaatgcacactcatatatgaatatacattatagagctttggcattgattattttgtcagctattcttataaattttcttggaaatttgtgtttcttaattttttatactctattgtgcaacaatggagggttatagaattgagtattactagtgaattgaaatacatgacattatatattaaagatttttgctctaatttctctccatgtacagatataaaatggtaactatgtagaggtaatagatatgttaattagctggactgtggtaatcatttcacaatgcacatcaaaatatcaagttgtacaccttaaatatatacaatatttgttaaattgccacaaaatttaaaaatcaaaacaaaaagagatctccagtaattaattgattttaaaggcaaaactaaggaatattaagaaattttagttttttctttattgtgaaatgtattaccttatataacagcaaaaagtaagaggggagggtatccatagatttatccaaataagcatttactgctgccttatctatataaatattacctagacagctattgggtaccaagatatctatcttacatggtgaagaagaaactttacaattcaagaaatgattcatttgtttgaatataaacatttttcttgacaagtagccttagtgtttggagtccagaaggaggtctattgaatcatttggaaataatgggaattattgtgacctttgagagtgaaattttaaatcaagagagaatggatcaaaggaaaattatgcaaaaatcaaacctacaagatagaattggtctcataaaagcacaacttacctgagacctagatgaatataatagataaccaaagtaagatggtaacaatgataaatgaataggccagccaataacatttaaaaggacttcacaaagttgcatgaaagcaaggcacatccatgccttatgaagttctacccaagggactaattattcatccttattattatgtagatgaatgaaactatcttaggctaatctcattaaatatttacccctttgattttcttcttgactccatgtgtattagttctccattgtcgttgtaacaaattttgacaaacagagtaatttaaaacaaatgtattcttttacagttctggagataataagtttgaaatgaaactaaaatcaagatgttagcagcagggctggtttctttcctttcataagaaaatttgttctttgcctcctccagcttctgttgtctgccagcattctttgtctgctggccataccactcctatctttgcttctgttgtcacattgctttcttctactctgatctcctgccccttcttataaggacctttgtgattacaccaggcccacctggacaattacataacccctctccccaatatcaagatgttaacttcatcacatttgaaaagtccattttgatatataagataacacaggtttaggagtgaggatctggacatgttttgggggcattatttagcctaccacaccatacttactaagcaaccttctaatgaagtcttggtttcccctgtagctttactatagagacataaggagctaccaatgatggctcaagtttttcaattcctacagattatatttatccaaactaattcataaagtgacggtctggtcttatatatcaggcttatggacttggaagtctgctcttcaataatggatctactttcagcatgcccttattgtcaggtttctgaagcctgcaggaattaaaatctagaccctgataaggggaatctccaagcccacaaatgatacctttccacaagatgccctgcattacttaataactgtaaaagctcagtggcttacaaccataaacactaatcacagctgtaggtcaaccaggccctgttttttctcttttccttctgggttctaggctaaaggaatagactttatctggaacatgcggttcttgaggcaaagtaaaagacacagagccatcagtcacatcacgtaattctgcttgaacatggcataaatgatatctgcttacagcccattggctaaagcaagacacatggccaagcccaacatcaatgtgaagaaagtatacttcaccaacaaaggaattgcaattcactttttaaaggacatgaatatataatcatctcttatggaaaggggagccaagtattttggaatgtaatacattctactacagacttgtaagtagccaatctagaacacatggtatcacattctgacttcattcattctaaaacacatgtagattaaagggcatggcaacaataatacaaaaggtaatagacgataaatagagctacaagaatataaggtttcactggtattgtgggagtgtttaaagtaatgaaatatattgtattatattaagtcaaaggtgtatattgtaattcctaggttaaactctaaaagacgtaacatataggctttaacctaatgaaaactgtgatatttatattaacatcaagtaagactattaggcaggatgtattaataaagagggacatcccataattataaaggggttaattcaatagatatccacctgttagtatagattcgtatataaagcaaaatgcaacagaaacataatgagttgacaaatttacaatttgagacttcaacacagctcttgcaataaatgttggaaaaatagtatataagatatgaaaataaaattaagaaaactaaatagatatatacacgtgtatatgtgtgtttgtgtgtgtgtgtctgtgtatgtactcagcaaaggcaatttacatgttttccaaatgaacatggaacatttgtcaaaattgactcatttactaacccataaaaaagcttcaacaaaattcaaaaaattaaaattattctgcatatattctctgatcaatatgaaatcaagctagcaatcaataacaaaaagagataagcagaaaaccccccaaatacctaaaactgaaacagtatgcatctaaataataatccatgagtcaaggaagaaatcaaaattaacgttctagaattttggtttcactatgatagtgtaattatctttgttattaaaactaaaaatctgaaaaaaaaaactaaaactaagaacctaaaaagcaaataaaagcagatgcattatagacagaaaagaaaactagaagttacccatgcagaaatgagtttcccttttttttttcctctttctcattgatctgccctcttgtcagggccaattctctgagaaacttggtagatcagtggcattcgtggcaaaaactgtaatagaaactctgtctttaaggccagagaacccagaaacagaggccttagcaggctgcagactatggaggaagttctgcagaggggagagctggagatgggggattctctaactgtgcatatgaaactgtccaaatcttgggctcacctctaaactatgcatttgtgggacagatggaaacaccatggcaaagattttagaaatgaactgaaattagaaataccactaacagaaagaaagatagaacttcaattgtgaatccaaatgttccaacacagctaaataactaaagaacaattaaaacttgactaattctcattggaaaagacagtcagtgaatgccaatcccaagataactcagatggttgaaatatcagacaattttaagcgagcttttataactagctaaaatgagtggagagtagggaaaagacaaaatttctcaacagataaatggaaaatataaaaagaatcaaagaaaaattttagagttggaaaatataatatcttaactaaaaattcaccactcatcgaatagccaaacggagatgaaagaaaaaagaatcagtaagcttgagtgtaaaaaaatagaaactactgaatctgaaaaatagagaaaaacagattgaaaaaaaataacgaagcttcagagtcctgtggggcaatatgtaaagttctaacatacatgtcattggagtcctaaaaagtgaggagagaaagactcaggtagaaaagatattcgaataagtaatacgctcaaatatcccagatttggtgaatgaaataaatttacatattaaagtttagtgaacccattagagaaaaaactcaaagaaaattacaactgaacacaattaatcttcagaaaaccaccaaaaaagagaaaaatatctcatactagttagagaaaaacagcacattaaatacaggggaagagcaatttgaatgactgcacaattcttattagagaccagaagacagtagaagtacatctgtaaagtgccgaaagcaaaggactattaactcatagttttatttctagtgaaaatatccttcaagaataaaggcaaaattaaattaaacattattggctgaaggaaaacttatgataatttgtcccaaatagacctattctaaaattattgccagaagatgaaggatattctttaggttgaaggaaaatgatgctagaagaaaacttaaatcttctggaacgaaggaagaaaaagagaaatagtaaatatatgtgcaaatgtaaatacgtattttccttcttgagttctttaaaatatgtattaccattaaaaatataaatgataacatcattttatgggattttaacaaatgctgatgaaattcatatgacaactataacataaaggttaagctagtgagggacatgaatgtacccatacaagtgcaatgattttacattttacttgaagtggtacagtattaaatatcttttaaaaacaggaagaaattggatatgtgtagtataatctttagggcaaccactaaaaaattataaatacatatagaaaaagagctgataaattaaaattgaatgctaaaatatattcaaattatccaaaaaagggcaggaaaggaaggggaacaaaaaacacaggttaacaaataaagtatcagacttaaatccaactatctcaatagttacactaaatgttaattatctagcctaggtgcagtggctcacacttgtattcccagcactttgggaggtggaggaggacagatcacttgaggccaggagttcaagaccagcccggccaacatggtgaaacctcacctctactaaaaatacaaaaattagccaggtatgatggcacacacctgtaatctgagctactcattaggctgaggcacaagaatcacttgaaccttggaggaagaagttgtagtgagccaatagcatgcctctgtactccagcctgggtgacagagtaagactctgtctcaaaagaaaaaaaaagttaatcatctaaagaaaacactccaactaacaggtagaaattgatagagtagatttttttaaaaagcaagaccttaccatatgctgcttaagaatgatacgctttacatgtaaaggcaaagacagattgaaaacaatgtggggcagggaatatacactatgcaaacagtaagcataaaaaagcaggaatagctagaaaagacatcaaatatctgaagaaataaatttcaagacagagtactacctgagatgaagaaggatatttcataatgataaaagagacaattcatcaagaagaaatagcaactaaaaggtatgttcacctaataacagaacctcaaaccacatgaatcaaaacttggagaatcaaaaggatagataaaccactgcaaaattagagtagaagatttttaacatccatttgtcttttctttttttgttcttttctttgagatagggtctttctgttgcccaagctggagtgcagcggtgcaatcacaactcacagcagttacaactaccaggagctgaagtgatcttcctgcctcagcctcccaagtagttgggccacaggcacacaccaccacacctggctaatgttcttattattgttatttgtagagacaatatcttgctatgttgctcaggctgccttaaaactcctaggctcaagcaatcctcctaactcagcctcccaaaattctgggattacaggggttagccactgtacccagcctatttttcaataattgatagacaagctagacataaaaatatcagcaaggacatagacatctgaacagtaccctcaaattcctcaatctagttggcattcacaggaaacaacatccaaggaatgcagaatacagattttttcaagttcacatggtacattcaccaagatggagcatatgctgagtcataaatcaagtgacaatcattttaaagcactgaaatcagacaaagcatatcctctcattacaatagaatttgatttaaaaatcagcgaaaatatatctaagaaaaacctaagtatatagaattttaccactacatttctaaataatttgtgggtaaaatataaaacacaaaagaagttggaaaatattttcaatagaacaacaaaaatacaattgtgttagcgttctccagagaaacagcatcaataggatacacattgagagagagcagagaaaataagggaaaaggagagaagggattttaagaaattgactcacatgattgtggaggatagcaaattcaaaaggtgtaggtcagtctggaaattcaaggtaagagttgatgttgcagtcctgagtctgaaatccacagggcaaggcagctggctggaaactcagattttattttgtagtctggaggcagagttccctctttttaaggaaatctcagtttttgctcctaaggcttttcaactgattggatgaagcccacccacattatggagatgcttcgtttaaagtctacagactgtaagtgttaattacatccacaaatacctttacagcaacacctagactagtgtttagctaaacaactggacaccatagcctagccaagttgatgcataaaattaaccgtcacctacaacacatcaacatttgggagataatatactaaagtagttattagaagagaatttataactttaaatgcctatattaaaaataagaaatatctaaaatattatagtgttccaccccaatagtaagttagaaaaaagtagaattcaatgaaatagcaaatagacagacaacagagaaactttgaagccaacaactatttttagaatatcaataaaattgaaaaacttttagctagactaatcaagaaataagagagaacatgaacaaccgatacaataaatgaaaaggaggttatcaccgcatacattaaaaggataataatagaatattagaaacaaatttgtgctaacaatttaacaacttagattaaatgaagaacatcttgaaaagcacaatttaccaaattgacacaagaagaaacagaaaacatgaataactaaatatatacataaaaaactaaattttatgtcaaaagcattccccaaaagaaaattccaagcccaagtctacctatgatattgaatcaaatcaaatactccagaaatcaattatacaaatattacccaaaattttcaaaaacagagaagcaggaattacagctgaactcatattgtgaggccagcataaccctgataacaacatctgagaatggcattaccaataaagaaaattatcaatgaatatttctcatgtagatagatgcagaattcttaaggaaatattagcaaataaaatgaaaagatatatttaaaaagataatggatcatgaccaaatcagatttataccagaaatgcaatgctagttgtattcaaatatcaatcaacataattcactatattaaaaaataaagcagaaatagagtatgatcatttcaatctgtgcagtaaaaaacatttaaaaatatttagcactattcatgataaaagctctgaaggaactaggaattgtagcaaacaacttcaaaataataaagggcatctatgaaaaatctaccaattgacatcatctttaatggtgaatatatgaattattttatccagagatcaggaaaaaagaaatgatgcccattttcaccacttctactccatattgttctggcaatcctagccattgtaagtaaggtaagaaaaagaggaaaaggtataaaaattagggaggaaaaagaaaactgtcactgtctgcagatgatttgatttttcacacagaaaatccaaacaaatctacaaaacaactactagcaccaataaaaatatttatcaagaatgcaggacacaagtttactattttaagtatattatattatcatatatgagcagcaaaacattggaaagtgaaattgttaaaattccacttatagtcatgttaaaagaatataaaatatctaagaacaaatataacaaaagacacccaagatcttgacacttaaaactataaaacattgtaaaagaaattaaggaagatctaaataaatagaaacatataccatgtttgtagattggaagactcatattgtgaagtcaacaattctcatcaaattgttctgcagatttaactcaatcccaattaaaattgcagtcagatttttgtagaaattgacaggctgattctaaaatatgtttggaatttaaaagtttccagagaatcaaaacaattttaaaagaaaagagcaaaactggagaacttgttctgatctcagaacttattttaaagctatagaaatcaaaatagtttggtattggtggaaagatagacatgcgactaatggaatataacagagggtatagaagcagacctataagtatttgatcaattgatttttgacaaatttctatgtgaattcaaaggagaaagtcttttcaacaagtgttactagtaaagtggatatccacgtgggaaaaaaaaaggaaattgatccttatctcacaccataaacaaaaatttactcaaaatggatcatagacctaaatgtgaaatctaaaactctaatactgtaggaaaaagagaaaatatctttgtgaccttgaagtagacaaaggtttcttaaatagaaaacacaagactgggtgcagtggttcacacctgcaatcccaacactttgggaggccaaggcaagtggatcactcgaggtcaggagtttgagaccggcctggccaacatggtgaaactccgtctctacttaaaatacaaaaattagccagaccttgtggcacatgtctgtaattccagctattcaggaggctgaagcaggagacttgcttgaaactgggaggcggaggttgcagtgagccgagatggtgccactgcactccagcctgggcgacagagtgagatgctgtctcaaaaaaaaaaaaaaaaagaaagaaaagaaaaagaaaacacaaagcatgaaatattaaaattataaattgatgaactggaattcatggaaatgaaaaactttttctctttaaaagtcactagtaagaaaataagaacaagccattgactgagagaaaacacaaatatcaaaagacttatatccagaaaatatggagaactattacagctcaacaataaaaacaacctaatacaaaattaaccatgtgaaaaaaatagaatcacacatgatccattaatttcacttatgagtgttaactagggactcaaacatattttttaatttaataatgtatttaaacactttaccaaaaataaagatacacaaatggccaataaacacatacagtgctcaacatcattaaccatcagaaaaaaaagtgtaatttaacatacacataatacatacctataaaaatggctaaaattagaatgactgaccatactaaatactgtcaaggatgtggagcaactacaattctcacacatgctttttaggaacataaaacagcataatcactttaaaaagcagttctctcatttctcaaaatgttacatctatactaaccaaaaaacccagccatttttataaggattaatccacaaaaaaaaatgtatatatgttctcacacagatttgtacccaaaatgttcatagtagcttaattataatagacaaaaatggaaacaactcaaaagtgaatcaacagatgaatgggaaaacaaatcattaattatcaatagaaaggaatactagtaagcaatgacaaggaaagaactactgatagatgaaacaatttgtttgaatctcaaaatcattatgttgagtgaaataagccaagccaaaagagagtgagagtgagaaaggagagaacgaatacactctatgattccatctaattaaagtagaaagactagcaaaaccaagctgctaggaaacaatacagtggttatgtttgaggaacagtagtgaccgggaagggcatgagaggggcttctacagacctgataatgttttgtacttattaatgtaggtgccggtcatatagttgtgttcataccaaaaaaatcaagctgaatattaatgacctatgcacatttctatataaatatttgtattagtcagggttctgtagagggacagaactaataggatagatgtatatatgaagaggagtttattaaggagtgttgacttacacagtcacaaggtgaagtcccacaataggctgtctgtaagctgaggagcaggaagccagtccaagtcccaaaacatcaaaagtaggagagccaacagtgcagccttcagtctgtggtcaaaggcctgagagcccctggcaaacagttggtggaagtccaagagtccaaaagctaaagaacttggagtccaatgttcgagggcagggagcatccagcacgggagaaagatgacagctgggagactcagcgagtctagtccttccacgttccactgcctgcttttatccttgcaacgttggcagctgattagatggtgcccacccagactgggggttggtctgcctctcccagtccacttattcgaatgttactctcctttggcaacactttcacagaaagccaggggcaatactttgcatccttcagtccagtcaagttgtgactcaatattaaccatcacaatattataatacaataaacatattcataatacaaaagaacatggctggctacaaactattcattttctattcccatgagcaattaataatatgattatttctatttctattcgtagtgccctcaggaactctgtaacatagtattagagaatcacagtctctattcttgaactccagagccagtagatccttcatcctcatcagtgactaacactagcacctgtaccaccaccagtagaaacaagaaccagtagaaacaagaatctcttatatgtataagagatatacatatatgagatgtatacatgtatgagatgagagcatatatatcatatatatctcatatagatgagatgagatatatatacgtgtgtgtgcatatatatatatatgatgcccacactataagagatatatggttagctggatagatgatcacactataagagatatatgagggctaaaaccaactgactgatcatactcacctttcccatctcattttcccttccacccataagccagactgatagaatcacttgcaacattaaaattctctttctctgccatgcctcctatcattgccaactatttaaacactgacatttacaaaagttaaatgtgtatctggcacaactatactacactgttctgtagtgccaaataagtaacaagccatcatttccagaagaaatcaaggctgtaagagctacaagggatactagaaaggatgctaggctgggtgttgggaacccttgatcctgatccctgatttggcactaacttgctatgaaacctagagttctgactttgctatgtttcaaatacatttgacatctctggagctcagtactctcacctgaaaaatgttttttgactctaaaaaatgtcccttaacctttctatatgaagagatactgcttccgggaaacaaaaagagtcagggggaggctggattgatgcaaggctcctgttccttagagagcaactggtttcttggccctctcctgggtgcttctttagacccacacctctggcacctgcctcagctccaccctgctctcatggatccagaatataacaatcctaaactccaatcctagctctttcccttgttactggcaaaaacattgacaactttctaggctctctttaatttcaatttcctcctgtgtacaacagaactaataatatgtaactcatggtgtttctgttaaatatataatgtgtcagatccatacattccatgcccccttggtatcatttaaatattttgtaggcaacagaaacagaaactaccaacttaaggaaaagtttggccaggaatggcgggggtgtctcacgcctgtaatcccagcactctgggaggctcaggctggtggatcacgaggtcaggagatggagaccatcctggctaacacggtgaaaccccatctctactaaaaaaaaaatacaaaaaattagcccggtatggtggcgtgcacctgtcgccccagctacccaggaggctgaggcaggagaatcgcttgaacctgggaggcggaggttgtggtgagctgagatcgcgccactgcaatccagcctgggcgacacagcgagactccatctcaaaaaaaaaaaaaaaaagatttataaattggagtaatactggatgagtgcaaaaaactgaagagcaagtaagcatgctctgggatgactgggctcaggggtgcttcgggcctccccacagtagataagcattcctaccagggttccctaccccatctaccttctgtgttcaggaaataaattactgagcaggataatccaatgccctaccttggaccacatgactatatctataatcagagggaaaaagtctgctgattaaaacctcactgaagccacacagactaagaaggatggatctccctaaaggaaagaggcacaattactagaacaagagaggggatgcttggcagaaaaaaacagattccatgcccagtcctgcaagttctgcaagttgtcatcaatccttctagagagtcattttttaaaagttctagccaatggcactacctcctcactcatattcttgcccagacctttcctacccacccacctgcctgcctgttgggccttttgtgattccagccccgcttcaccactgggagccctgtcaagcttaattaccttaggggctgaggctctttatgcaggtgaactggggcacaaaatatcatctattcagtgggtaagcctaggtaccccaaacacaaggattttagcttttctcacgtacagaaccatacaatttctacacaactgatgaatcaataaatgcaaaaagggagatcttcacccagagacaacacaaagaaactcaggaagcaaagctgtaagccagcctctccctctgtgcactccctgccttggtgtgctcactcatgctatttgaacagctgacagaggcttggcctggtcttctgagacctccacaacatcacattagacaataactctatatttagccatgagtgaaatagaaaaggaagggaatcagggccaaacagactaagatgaacagagaagtctggactttcatttgtaatgtttcttagcaaaacaaggggatgtttggatgctgggtctgtttatttagactcaagatctcatatcctaatgtgaactttctggacaatgtcttttgattcctttaatctctctgtggcctttttctacccagtacaaaacagctggatgaaaagtcacacctgcattccacaagtagaaaaatataattcagtctaattcagttttcggtgtaacataatcactagaagtagggattcttggattctgatctaactgccaaccactgcctaacttgaggggaattgcttttcttctgtgggcctcagttttctcatcccttgagtgaagatgctgaacatcacattttctaaagactgtttcttcctgttttgaggtttaatgaagttagggtcagagggacttctaggaataaatgcttccagtgttcaggtaacacaagtttctcctgaggagaaatacaggaaaattaaagggctccatttgcccatcttgattcagctgggggtgaggagctgaaaaggacacctgctgatgctactcatgaactgtgtagcatcattctttgagagcactggttatgtagcatttgggatgatgataaaagtcaaggatcagcaaactttttctgtaaaggatcagatgagaaatgttttaggctatgctgacctagagtctctgttgcaagtattcgacaatgctactgtagtatgaaagcagacataaaatacatacatgaatgagtgtgattgcattctattacaaaaacagtagtggggacataagctgtagttgtctgacccctgatataagtgatggtctttgtgattagaaatgtataaccttatcctccctcccacttcacagacaaatgtaagtcctgcaggagtttattattaccaagagagtttggaaaatgtttcaaagccataaatagtttagaataataataaaactgtgaagatcagtgaactaggaaacaaaagatgtagattgaggccaaatgcaaccatttaactagttggcaaatgatttaacctctatgaatctaggtttcctcatgtccagtttttttggaaatggtacatgctgtgcctaaaaggaataagaataaaaatagcaacagttaacatttgagtattctcataaaattgtaaattttttttttacctttgttatcacatttaattctcaaaaaagccattattatctatctaaagtataggtattattacctaactcacaacattctgacatgtagatattattactcccatcttataattcagatactgaaggtcagatgagaagtaaaagtgagatgaaaatgctctgaaaactctacagcactacattagaataaagttatataattactcaagataagggaaacaatgtttcccaagtctttcctccacatgttgaaattgtgcagtttcatcatagtatctaaaatccaatagaatatgcatgttctaatacccactttatgtgtaatcaaccactacccacttatgaagcttctactctccatacagggccccaacttactcctaaggagaggctagagaatctatcactaaatttccttgtccttcctaacagcatatccaggaaaatcgagttgctgctattttcatagactcagtagttacatggcaacagagatccaggtttatgtcccacttgtgctggtaagatatatagaggaatgagaagggaggggttgtcagcaaaacctggcatgttgcaactcccaacaacttcttcaggtgagaaggctgtaagcattctcccttgcctaaacctgtgtaacgaaagggatggcaggtagcagtgaatacctttccatgctctaaactagatcagacaaaagaaacatacatggagcatcatttctaagtgtttgaaaccattccaggcattacctttaaacatttaaaattttttaaagagcaaaagtcacagttgttgaattccatttgcaaggcacctgacatagtgaaatgttgccttttttttatttattgacatatatttttctcttgttaaaaggaacatagccttaatatagaaaactagaagtatctaaaaaaatagtttataagaatgatccataattccatagggtaaaataattattattgtaggaagattgtttccaaagatagccacagccattgctcccatcctgcatgcctcctttgcaatggtcactctccacacccagaggtggagttgattgtctgatctgacactgcagtcttctttgccaaaagaatgtggcagaagcaacacgtacaatgatgctaggctttgagaggacttggagcctttgtttttgtctgcttaaaaccctcagtctccatgggtttttttttaagcctgttaaaaataagagatttaagtaaaatctagagtaatataacaccccacaagtccaggtttgttgtgggaagtcaggtaccccaaacagagggacccgctgaagccatggcagaagaaaataaattgtgaagatttcatggacattaattagttccccaaattaatacttttataatttcctatgcctgtctttactttaatctcttaatcccgtcatcttcgtaaactgaggagaatgtatgtcacctcaggaccctgtgatgattgcgttaactgcacaaattgtttgtagagcatgtgtgtttgaacaatatgaaatctgggcaccttgagaaaagaacaggataacagcaatgttcagggaacaggagagataaccttaaactctgaccaccagtgagctgggtggaacagagccatatttctcttctttcaaaagcaaatgggagaaatatcactgaattctttttctcagcaaggaacatccctgagaaagagaatgcatccctgagggtagccctctgaaatggccgcttcaggggtggctgtcttttacagttgcagctgtagggatgaaataagccccagtctcccatagcgctcccaggcttattaggatgaggaaattcctgcctaataaattttggtcagaccggttgtctgctctcaaaccctgtctcctgataagatgttatcaatgacaatgcgtgcctgaaacttcattagcaattttaatttcgccccagtcctgtggtcctgtgatcttgccctgactccatttgccttgtgatattctattaccttgtgaagcatgtgatctctgtgacccacaccctattcgtacactccctccccttttgaaaatcactaataaaaacttgctggttttacggctcagggggcatcatggaacctgccaacatgtgatgtctcccctggacacccagttttaaaatttgtctcttttgtactctgttcctttatttctcagaccacttagggaaaatagaaaagaacctacgtgaaatatcaggggtgaatttcgcccaatatctggctgaatttctcctgatattagggcatggttttcctgcaggtttatattgaaggtatggggtatctcccattacagatttctattgaaaatcactcatatcgagaacagaaaatatctcaaatcaaatgaaaaaagaaaattaacaggcacaaacaccaagataacaaaaaaaagttggaaatatctggaaaatattttaaagcagccctcatataaatgcttcaatgagcaattatgaccatgcttgaaccaacgaaaatattgaaagtcacaggaaaaaaacagaatatataaagaagaaccaaatggaaattttagaactaaaatatgaaataaacaaaattttgaaatgcagtgaatgggctccattagcagaatgaagagggcagagaaaggaatcaacgaagtcaacaattaaaccatgaaaattacccaatctgaaaagagagagaaaacagactgtaaaaaaaaaagcctcagctacatgtgggactgtaacaaaggatctgacatttgtgtcattgaagcttaggaagaaaagaaaaagattgtaaggctgaaaaaatagtaaaagaaattatgatgtaaaatttccccaaactaccaaaagacatcaatctatagagaaaagaaactgagaggaagccaaacaggataaaaagaaaccttcatcaagacataccatggttaaacttctgaaaactaaagacaaaacaaaacaacaacaacaaaaaaaaaaaaaaagaaagaaaaagaaaaaaaacctcttgaaatcagccagagagaaatgatgttttccctatttacctaaaggggaaaacattttgaatgaggcagatttctcatcaaaatccacgatggcaagaaaaaaagtggtacagcatttttcaagtcctgaaaggcatgaactgtcaatccagaattctataaccagaaaaagcatacttcaggaatgaaaggaaaattaagatattctcagatgaaaaccaactaaaagaacttgtcaccagcagacctactgtaaaagaatggcaaaaggaagttctgtaaacagaaagaaatgataaaagaaggaatcttgaaacatcatgaaggaagaaagagcatagaaagataaaaaatatgaataaatacagtaaagcttctcctcttaagttttctaaattatgtttgaggattgaagtaaaaattgtaacaattcctgatgtggttatgcagaggagataaatgagacaaatttttagtcggggagaataaagggatgtaaaggagagtaagatttctatacttccctctaactgacaagtgttgacaccagcggactgatagacgtgtatgcatatatatatatatatatatgtgtgtgtgtgtgtgtgtgtatatatacacacacactatataaatgtgtacatatacacaaatgtatatatatatacacacaatgtatatatacacaatgtatatatagacacacaatgtgtgtctatatatgtacacaatatatgcaatagctagagcaatagctgaaacaactataaaaaagatgcgctcaagaacactataggtaaatcaaaactgaatggaacacacaggaaggcaaaaaaaaaaaaaaccaaaaaatgaaaaagaacaaatagaaaacaaaaatttctcaaaaaacacaattataggcatacagtggctaaaacccatactctggagccagtatgcctgtgttaaattcctggctccaacacactgggcaagttgcctaacctccctatgcctcggttactttatatgtaaattggacataacaatattcactgcacagggtttgatgagattttaatatgttaatatttacaacagtgcctaccacatggtaaatattatatctatattctccaattaaataattaaattgattccttaactagagacaagaaaacatttaactgttcctcttttttgcccttttaaattacactgtgacaaaccttcttttacattaggcttactccacatttctgatgatttttacaatagacaagccctctgaaatatgttttgatgtttatgtgcagccccactcttttttcctaggcagaataaacttcacagacttttataagaggttgtttcgacacagaacttaataactaaaatagttggagttttcaccaaatttgttttgtcggcacacaaaatagacagtggaagattttgtggtatgtcatgtaaaggtgtcctaattgtttgtgacttcatatatcactacaaactctccaggatggcatagtatattggttaagaatatgagctttgaaattcaatcacctgggttcaaattccagctctattctttataagctgtacagtcttgaacatgttgcttaacctcttcatgtttcaggtgcttcatctataaaaaggaagaaataatagtatctacttcacaggggtgttataaggataaaatgagttaatccacctaaaatactcagaagagtccctgccgttaagccaaaaagaaagactaagtgaaatccccttcaggtggcctaacttcatcctgaaaacatgcagataagaaaatgattatgaatctcaatgcaaaatgctgaagaaaagaggaaaaatccctaactctctcattatgtagcaacgttagctaccaagagtgttataatagagctctgggttatgtattatcaccatctgtagcctgctaagcattcccttcccaataaatcatctcttaaggatgactgaaaattcacaagtaatttcgcataaataatttttttgcatctgagccaattctacctgcatgcccatatgggagcttggaacatttctttgatgacaaacagattggcctgggaaataagggaatctgaaaggctcagtgcgtgatttgtaatcttcgcaacttttggttaaaaggaactccgtgactaaaggagtttattcttaggttcctgtagctgtaaatcaaaatacaagatcatgctttaggagatattgtttgctgtgtttttaaatggagtttaaaataaactgttaagagctctgttaaactccgggcttagagtatattctattttgggatattattactcagtatgtaaacaagctgtaccaagataaactgtacaagatttcataattccttgctgctcaagaatagcagctggttgctgcaaaaatttcagtttcccccctatctttagtttctcttttccttatctataatggctgatttgactgtggaatccagacatgggacagactataaaaactatgaattaatctatccattttattcaaaccttgccgcaagatattcaagacccaaaggaattttcctgtgaaggtcaaattttatgcatcatagaaagtagagaaaatgtttgggattgatacacctttccccaactcatacctaattagtatattggcaatatatctcagatttcctatcacagttccaatgttaaaatgtctggcctattcttagctcaaacgtcaagttattctagaaactctgatagctgagcattcttgttacattattaagttatcttataagatgagccatgtgccctcatttaaggagtgaaaaataacaagaccgtgagactagcaagctcctcttgtttctaacttctgagtatgttctgctcattctcagagctcaaagtttgagtctggattctataacttgaagaacttgatgggtgttccaaagaaagcctcagaagagaggcctcttaagatttcttaaaaatttcttccctaatgttctttggacgcgtcatagatttaaagtagaattcatggaaacaaaaagactctccttgaagactcagctggggactctccatattaaaacctgttctcatagagaataaagttcaagggaacaaggcaaggtaattgaagtagaccaaagaggcactccagcctctatagccttaacagtgtggactctggagtcagaaagcatgggtttgagtcttatctctacaacttattagctgtgtgatcttagataagtcataatcctctttggtggtaaaaataatgtcatcttcataggattactgaggattaaatgaactaaaacactaacaatactgcttccaaagtagcattttctatttatatattcttgttattgaggctgttattaatattatgtccacattgagagaagtagacaatggatgtttggaaaataactactaaaacacattaagtgcctacaatttacccatactatgctaagcactcactattcaaggacataaaaacatatgtataaatgtgaacaagagacaaatcccccatgcagaataattccaaataatttaggtagatactttgccttcagggaggtagaacacatctccttactgcttgaatataaactgtataaagtgatttccttccaaagaatacagtatggaagtgggtggggagcaagtaaatacaatgaagaaatctgacaaacagtaacttagctagctgtctgaggtcaccaccaacagtatgaaatcatgttaactgtataaactcaaaccccagtcaactcatgaggaaaacagacaaatccccaatcctcgaaactgtcaaggcatcaaaatcaaaaaaagcctgagaaattatcacagcaaagagaagccaaagaagatatgacaactaaatgctatatggtagattctggaacaaccaccacaaaaaaaaaagacataaggtaaaaactaaagaaacatggaaaaaatatggattttagttaataataatatatcagtattggttcattgattgtagcaaatgtaccatactaatgtaagatattaataataagatgagctgggtgcaggatatatgggaactcacttatggtatatttgtaatttttctgtacatctaaaatagctccaaaaagtaaagtttattttagaaagaaaaaaaaagagaagagcttggctcacgaggaactcccaatgtaatgtggaagatgaacaagtaattaaattataaattgtaatgcagtgcagtgtatgtaacaacggaaacatgtaaaatgtacagagcctacaaagaacacagagggattaacactgttgttgtgggtggtaaaacaaggctttatgagagaggcattgcctgagctgcagtttttaggaatgaatcaagaggaagggaaggcaagcctcccaaactgaagggatgcctaggtaaagacttggaaattattgaactgtttggtgttgtcagggcactacgtgttagggaatgaaatggcaagataggagactaaagaggagtgatgaatcagatcagaaaggacctgacctgtagctagaccaaggactggacccctcttagacagaaggaagttgagcctttcaaagctattttcaaacagagatctggaagagctaagcagcaggaaacactgctaacaggaatatcattccctttaaattaaaatgcctgtcattcctcactgccataaatgacagctggaacatactggacctgacctacttttgattccatatgtctgctaatgccattgggctcaatctattgctgggtaataggctcttgctagggaaagatttataactggagaaaaaaacttaacattagtcagaaggaatctcccggaatggacagaacaaatatcaaaaggacccagtcctttagacttggcctggatgaccatgtgtgccattcacataactgtgcagtccatgtgaatcagcaccaagtcactgagggtggagaagtggcggacattcggctaggggaacgggctgtaaatgcacttttacaatcagctagaattgacagaaatgccctgggaattgggctccaaactgaacacaaaccagccacccagaaaggctattaagaatacaattctcttccatcatgcagaaatacaagcatactatcacattaagatcagtagggtgggtcaaggatttgattgtgcagattgaaataccagttaataaaataaatgcagataagaatttgtccaatcaacacttttagttatcagaatgatgcggacagacagggttgttagatgtcccacaatgcctgggacagccctatccaacaaacaattgtcttgcattccatgtgcctttttcccccctaattttttattgtaataaaatacacataacataaaaatttactatattaaccattttttattatactttaagttctagggtacatgtgcacagtgtgcaattttgatacataggtgtacttgtgccatgttggtttgctgcacccatcaactcgtcatttacattaggtatttctcctaatgctatccctcccccagcccctcacccactgacaggccctggtgtgtgatgttctccaccctgtgtccaagtgttctcattgttcaattcccacctatgagtgagaacatgtggtatttggttttctgtctttgtgatagtttgctgaaaatgatggtttccatcttcatccacgtccctgcaaaggacatgaactcatccatttttatggctgcataggattccatggtgtatatgtgccacactttcttaattcagtctatcattgatggacatttgggttggttccaagtcttcgctattgtgaatagtgctgcaataaacatacgtgtgcatgtgtctttatagtagcatgatttataaacctttgggtatatacccagtaatggaattgctgggtcaaatggtatttctagttctagatccttgaggaatcgccacactgtcttccacaatgattgaactaatttacacttccaccaacagtgtaaaagcattcctgtttctccacatcctttccagcatctgttgtttcctgacattttaatgatcgccattctaactggtatgagatggtatctcattgtggttttgatttgcatttctctgatgatcagtgatgacgagcattttttcatgtgtctgctggctgcatagatgtcttcttttgagaagtgtctgttcatatcctttgcccactttttgatggagttgttttttttcttgtaaatttgttgaggtctgtgtagattctggatattagccctttgtcagatgagtagattgcaaaaattttctcctattctgtaggttgcctgttcactctgatgatagtttcttttgctgtgcaggagctctttagtttaactagatcccatttgtcaattttggcttttgttgccattgcttttggtgtttcagtcatgaagtccttggccatgcctatgtcctgaatggtattgcctaggttttcttctagggtttttacggttttaggtctaacatttaagtctttaatccatcttgaactaatttttgtataagttgtaaagaagggatccagtttcagctttctacatatggctagccagttttcccagcaccatttattaaatagggaatccttaccccatttcttgtttttgtcaggtttgtcaaagattagatggttgcagatgtatggtgttatttctgtggcctctgttctgttccgtctgtctatatctctgttttggtcccagtaccatgatgttttggttactgtagccttgtagtatagtttgaagtcaggtagcatgatgcctccagctttgttctttttccttaggattgtcttggcaatgtgggctctttttggttccatatgaactttaaaatagttttttccaattctgtgaagaaattcattggtagcttgatggggatggcattgaatctataaattaccttgggcagtatggccattttcacgatattgattcttcctatccatgagcatggaatgttcttccatttgtttgtatcctcttttatttcattgagcagtggtttgtagttcactttgaagaggtccttcacatcccttgtaagttggattcctaggtattttttctctttgtagcaattgtgaatgggagttcactcacgatttggctgtttttctgttattggtgtgtagaaatgcttgtgatttttgcccactgattttgtatcctgagactttgctgaagttgcttatcagcttaaggagatttggggctaagatgatggggttttctaaatatacaatcatgtcatctgcaaacaaggacaatttaacttcctcttttcctaattgaataccctttatttctttctcttgcctgattgccctggccagaacttccaatagtacgttgaataggagtggtgagagagggcattcttgtcttgtgccagttttcaaagggaatgcttccagtttttgcccattaagtatgatattggctgtgggtttgtcataaatagctcttattattttgagatacattccatcaatacctaatttattgagactttttagcatgaaggactgttgaattttgttgaaggccttttctgcatctattgagataatcatgtggtttttgtcgttggttctgtttatatgatggattacgtttatcgatttgcgtatgttgaaccagccttgcatcccagggatgaagctgacttgatcgtggtggataagctctttgatgtgctgctggattcagtctgccagtattttattgaggatttttgcatcaatgttcatcagggatattggcctaaaattctccttttttgttgtgtctctgccaggctttggtatcaggatgatgctggcctcataaaatgagttagggaggattccctctttttctattgattggaatagttttggaaggaatggtaccagctcctttttgtacctctggtaaaattcgcctgtgaatccgtctggtcgtggactttttttggttggtaagctattaattattgcctcaatttcagaacctgttattggtctattcagagattcagcttcttcctggtttagtcttgggagggtgtatgtgtccaggaattcatttatttcttctagattttctagtttagttgcatagaggtgtttatagtattctctgatggtagtttgtatttctgtgggattcgtggtgatatcctctttatcattttttattgtctatttgattgttgtctcttttcttctttattagtcttgctagtggtctatcaattttgttgatcttttcaaaaaaacagctcctggattcattgattctttgaagggttttttgtgtctctatctctttcatttctgctctgatcttagttatttcttgccttctgctagcttttgaatgtgtttgctcttgcttctctagttcttttaattgtgatgttaggctgtcgattttagacctttcctgctttctcttgtgggcatttagtgctataaatttccctctacacactggtttaaatatgtcccagagattctggtatgttgtatctttgttctcattggtttcaaagaacatcttcatttctgccttcatttcattatttacccagtagccattcaggagcaggttgttcagtttccatgtagttgtgtggttttgagtgattttcttaatactgagttctaatttgattgtactgtggtatgagagacagtttgttgtgatttctgttcttttacatttgctgaggagtgctttacttccaattatgtggtcaattttagaataagtgcgacgtggtgctgagaagaatgtatgatctgtcaatttggggtggagagttctgtagatgtatattaggtctgcttggtgcagagctgaactcaagtcctggatatccttgttaaccttctgtctcgttgatctgtctaatattgacagtggggtgttaaagtctcccattattattgtgtaggagtctaagtctctttgtagatctccaaggacttgctttatgaatctgggtgttcctgtattgggtgcatgtatatttagaatagttagttctttttgttgaatttatccctttaccattatgtaatgactttctttgtctctctttttttttatttattattattatactttgagttttgggtacatgtgcacaatgtgcaggttagttacatatgtatacatgtgccatgctggtgtgctgcacccactaactcgtcatctagcattaggtatatctcccaatgctatccctcccccctccccccaccccacaacagtccccagagtgtgatgttccccttcctgtgtccatgtgttctcattgttcaattcccacctatgagtgagaatatgcggtgtttggttttttggtcttgcgatagtctactgagaatgatgatttccagtttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcctttgggtatatacccagtaatggaatggctgggtcaaatggtatttctagttctagatccctgaggaatcaccacactgacttctcttttgatctttgttggtttaaagtatgttttatcagagactaggattgtaaaccctgcttttttttgctttccatttgcttggtagatcttcctccatccctttattttgagcctatgtgtgtctctgcatgtgagatgggtctcctgaatacagcacactgatgggtcttgactcttatccaatttgccagtctgtgtcttttaattgggccatttagcccatttacatttaaagttaatattgttatgtgcgaatttgatcctgtcattatgatgttagctggttattttgcctgttaattgatacagtttcttcatagcatcgatggtctttacaatttggcatgtttttgcagtggctggtaccagattatatcttaaccatttttaagtacacagttcagtggcattaagcacattcatattgttgggcaaccgttaccactatccatctttagatctctttttatcttacaaaattgaaactttatactaattaaatgatagcctctcattctactctcctcccagcccatggcaactaccattctactttctgtctctataattttgagttctctacgtatgtcatatgggtagtatcataccatatttatctttttgtgactggcttatttcacttagcataaaatcctaacagttcatccatgttgtaacatgtgtcggaattgtcttcctatatttataagacaaaatgataatccattgtattatatacaacattttgcttttctattcatccgttgatggacgattgggttgcttctatattttagctattgcaaataatgatgctaagctactgtgtttgtgtgttagtttttcacaaaaaaaagtttaaaaagaaaaaaaaataaaaataggataagcttaaaaaataaggataaaaagaaagaaaatatttttgcacagctgtacaatatgtttttgttttaagctgtgctattataagaagtcaaaaagttttttaaaaattaaaagtttataaagaaaaaaggtacagtaagctaaggttaatttattattgaagaaagaaaaatattttatacaattttagtgtatctaagtgtacagtgtttataaagtctacagtagtgtacagtaatgtgctaggccttcacattcactcaccactcactcattcactcacccagagcaatttccagtcctgcaagctccgttcatggtaaggcctacacagagtcaagattattagtatcactgtcttctacttctgcatcttttcctactggaaggtctccagggacagtaatagaaatggagctgtcatctcctgtgttatcatgctggaaagccttctaatttttaattatttaattttttttgagacagggttttgctgtgacactcaggctggagcgcagttgcacaatcatgatagcaatgccttgttttggaatacctcttgaaggaactacttgaggctattttacagttaactataataatgataagtatagcacagtatatactaatcaataggaatttttcagctccattgtaatcttataggatcaccataatatgcagtttgtcattgaccaaaatgtcattatgcagcacatgactgtatttaatttatatatgcacaaccactagttgtttatatacaaaagtacacaaaagttaactatttgtatatcaaaccaaatattctttattacatgattaacataaaatgaatataaaatatccaggaaaacacatttagaaagagcacaagttttatcttatgatagttcttaaaacatggtagcaagaacttggttcttcagttctgctactaattaactctatgaactctgtaagacacagtaaggtttttaataagctaaaggatcagaaaaacctagatttttaaattatggtgtagcagggcattgatttgcacaatgctgcaatacaactgagatttgcaataacaacaaacaaatcagatctacttttcccaggtctgatttcatctttatgaggctcccatttctaccagtgttggaaaaaatacttaaatttgacaatttaaggtaagtaagtctcagatttttaaaagcttccttcagacaaagagatgattgtgacacccccatgaataagagtggtctatctacagagaagaaagaagatcatgatttaagggacgtgagaggactgcagcattttgctaagacagatgtaaggatgcgtgggcctagtgggctagaaatggctccgtgtgtcagtcagtgaagacagtgaggtagaaggggggacttgactccagaggtgggaattcgaatactggaccagattgaggactagctaatacaggaccagggtagaagcagttctacattagacacgcccaccagtgtgctgtgttggttcaccattgccatagcaacaccaagaagttaccatccctttccatggcaactatcccatggcctggaagtttccacttgtatcctagaaatttctgcatgaactgccctttaatttgcatataattaaaagtgggtataaatatgtcagcagaactgcttctgagctgccactctggacacactgcctgtatggtagccctgctcgaaaaggagcagtaccactgctactgctgtacactaccacttcaatataagttgctgtctaaaacctaaataaataaaaagcctctttcaatgtaacaaaatattttgaatagtcaattcaaagttctaactcctcaagagaagttttgcccattttccccagtttcaaaattctctacattcccttcttatttacaggatagtatctgaatagaggagaaattaacacacatccttgccttagtagggctagactatccagtctacctgtttttcttacctcacatttctagaatgcaagtgcagttggtacaggcaagctcttaggcaccctctactggtgtctgcagagatccagctaatgttgatgtttgctcctaaatcttctagatatagtggtcaaaagagttcaggaaataaatgcccaggaaagcacaagagagactatcttcagccatgatgatcagaaaactacacccatgatttcaatggccatctgtaggtagatgactcaccatgttttatctccagtccaggtgactccttgagcatatgcagccaaatactacttcacatttcctttatggtgtctaaaagacaccccaaattgagtatattctgctaaatttataatcttaatccccctaaactgtgtttcttctggtgttccttaaatctataagtgaatctaccataaacccagctattcaaactagaaatttagagttcatccttaaaagttcctctccctcagcctgtctatataattaatcatgtcctattacttcaaccttctaaatacctcacaaatatgctccttctctctctctctgctgccaccaacctaattcaaccaccattgtctcttcaactggtttacctacatccactctggccttcttccaatccattctttccacctcagccagagagatgtttgttaagtgaacacaatgccatcaacacacacacacacacacacacacacacacacacgcacacccctcttaacactcttagttggcttcctgtaactctaaagtaaagaccaaaatctttaagtgtctctcagagtcctgtgtcatcgagtctccacttgccttgcagcttcccctcacacactctcccttattttctgagctctggcaacactaatctgatttcagtctgttaatctgaagaattccttctgacacaggggcttgccatatgctagtttctctgttttaaaggctcctctcccaacttaattctcctttgcttggctaatagaaactcttctttctgatctcaccttatcaccatttccttgggaagacttttctaatcttgctaacaatgtaaaatcctcttatcatatgtacttcttggtttttacattacatgtgtatatgtgattttttttactaatggatagctttctcactacattataaactgaatgagagcagaaactatgtttttgtttgccattttatgggtggcactcagaacaatgcatggcacataatagggtgacatatatgtatatgtgtgcatatatacatatatacacatacatatatacacacacatatgtatacatatatacacacatatatacatatatatacacacatatataaacacacttacatatattcattgaaaacataatgaatataattcacccagaaattatttggagattatatttttaaaatgcaggtattgatgtttgttgtgttaaccctcaataaagtaagttatttaaggccaggcacagtggctcactcctgtaatcccaacactttgggaggcagatcacctgaggtaaggagttcgagaccagcctggccaacatggtgaaacctcatctctactaaaaatacaaaaattagtcgggcctggtggtggacgcatgtagtcccaactactcgggaggctaaggcagagaatcgcttgaacctgggaggcagagattgcagtgagctgagatcgcaccactgcactccagcctgggtgacagagtgagactccatctcaataaaaagaaaaaaaaaacagaaatgatattcagacgagagaatttgatttcagtctgtaccacttattagccaagaaaacgtcagataatcatttaaatcagcagcagcgttgttatgctattacctgttttcaatcacaatgctgcagataaactgtcaagtattatataaatgtaaggcattatgatttatcagcaaaatttaaaagctttttctataaaagccacaaaaaatacataaaacatgactaaagctaggacaaaaagccttacagttttcctcacaaactttaattctatattagtgtattagggttctctaaaaagagaaccaatagaatatatagaaggtagatataggagaggtgatttattaggggaattggctctcaaaattatggaggctaagaagtcccatgatagaccatctacaagctagagaaccagggaagctagtaatatggccccatcaagtccaaaggcataagaacaagggaagcccatggtgtaaccctcagtctgaggctcaaggcccaagaacctgggagccactggtgtaagtcccagagtccaaaggccaaagaacctggagttctgatatcctaggatggcaaaagaagggtgtctcagttccagaagagaaagagagtgcaaattcacctttccactgcctttttgttctacgtggaaccctggctgattagatggtccccacccatattgagtgaagtggcttttccttacttagtccattgattcaaatgccagtctcttccagaaacacactcacagatacatccagaaataatgctttaccagatatctgggtctctcttaatccagtcaaactgacacctaaaattaaccaccacaatgccaaacccagtcaacttgccacccatttgcatcttcttaaaccacattgagtctccaaataaagataataacaaggtcatagttcaatctaacaagatacaactaacctgtatactacgaaaaatgcacttatcccttctccagaagaggaagtgaagtccctgagtgatgtttactcttctcctaatatcccataacttaagtactgtgatgcaaaattaataatacttaaatactgatatgaactcattacatcttatgttacatgataaaagaataagaaaggaacaaaatcaaagatatttgcttgatatatgtatatataggcacaaacatattttaacagaataaggaggaaatactcatggcaattatagcctgtttttttaattgctcatgtggtcactacttgtatttataactaccttctactactgattctatattccctttgccttcagcaagcacctcagctggtgctttttatatggcagagttacccaaaccttcattcctgaaaggtgtgggtcattcatagacctatttagattgggttatcgtggtttcattgaccgtagtcacaggggatggtaatactaagagaaaccctaagggatctcttgtattgcagacatactcttccttacctccattatggagtagtagtccaattccctcttggtattctggatcaattaccccagccaacaccataactcccctccatatcctgttgactcagaggcatcagaagcccaatatagccaggtggcaatcttaactgccaattcaacggaatcattgtgtctcccagtggaagttctacttcctctagaattaagacctctagtccagcagagcatacttactgaaacaggaatcaaaaatgttgctagggggtcactaggggtaatggtgactgatgccactcccatttccaccccgtgattcctggacccatgaatcctggctataggagaaacagtatcatatattagacactgattcagagtttttacagcctctgaacaacattgccccagctcagcaaagtattatcatcaagctggcactgtaacagtcttcaaaaaaccatcccattgtcttattaaaccagctactttaggataatggaaaacttgctaagatcagggaattccatgagcacgaacccattgccatgcttctttgcctgtgaagtgagtttccaggtcagaagtgatgctgctctgtggagtaccatgatgctgaacaaggtatgtttaagttcattaatgatagttctgtaagttcatgaatggtattttgtaagttcatgaatggtagttttggtagaagcattgcatgcatagaaggcgtatccagagtgtctattctaataaagaaaaacacagccctttctatgatggaggtagttcaatgtaatcaagctgcaaccaggtagccatgttatcaccctggggaatggtttcatagtgggggctcaatgttgatctcagctgccggcagattgggtactcagaagttgctagagccaggccagcctttgtggtggaagtccaccttgctgagctcattaaaagcttcagtctctgccaccatggccactttgttcatgagctcactgggcaataatggagagtagatggggaaggaggctgactggtattgacaaaatgggtcattctatctactggattattaaagtcctcctcttctgaagctaccctttggggagcattcatctaagacagaaatatcttcatatgctttacctattcggagaggtatatccacatacatctttcacatatttctttgtcaccaattttccaattatgttccttccaaatctctgactatcatgccaaaccattggctacagtccataaatgagaatataataacgtatgtggccatttttccttccaacaaagtgcaaaagctggtggacttaccaaagatctgcccactgggaagatttcccttcaccactgtctttcagggatgtcccagaaaggaggggatagtgctgcagctgtccgcttttggattgtacctgcatatcgtgcagaatcatctgtaaaccaggccctagtcttctcttcctctctcaacttatcataaggtactctccatgaggccacaggtgtaggctaggagagagaaggtcttgtagcagaacaaaccatcagcatttggggccacttccttatttaacttacttgtaacttcatgacctcttcaggctggatcatgtacatactacttccatttgacgatggtgctgctgtgcatgtccaactttatgacttgatgagtcacagaacaccaaattcatgatgggcagctcaggtcatagggtaacttggtggcccatggtcaagtgttcagtttctactaaggcccagtagcagaccaagagctatctctcaaaaggaaaatagttatctatggataaaggcaggacattgcttcaaactcctaaagacccacagtgttatccacctatgggggcctgtcaactgcatccctacctgcctctgacacttcaagcaccactggatctcatgaatgacatggttcaagtggcagagaagccacagtaacctaaacctgctgcagagcctccccttgttctgggccccactcaaaattagcagctttttaggtcaattggtaagtgggccagagtagtgcacccaaatgagcaatgtgttgccgctcaaatccaaattggttcactaggtgttgtgtctctttcttggttgtaaaagaggccagatgcaacaactgtccttcaccttaaaagggatattttgacatgatccacaccactggacccctagaaattttatggagagaacaggcccctgaattttagtcagatttttcatggcctgacatgcaaatatcttcccaataaatctaaagttgttgttatttctcactcaccaagcctaattagcataatattgtcaatgtaatggaccagtgtgatatgctgtaaaagggaaaggtgatcaaggtccctacaaactaaattatgacatagtgctggagagttaatatactcctgaagtaggaaagtgaaggtatattactggccctgccagctgaaagaaaactgcttctagcaagccttctaaacagggatggagtaaaaggcatttgatagttggttccaaaattgtggtgtagatacaagctggcttctctcccctacctcagaggacaaaaaacaaatatactacgattatcaccagtgatatttcagaactcaaatatgagccagagacaggtatcagaccacagtgaactgaaaaaaattctgagcagactgtaagagaatgagcctttcatatctgcaatgcccctctccccaatctgcctagcaccaaatgcccagaaaatttctctctgactcacattttctacactggaaaaagtgagatcaaggaggacaactagcttgcccaccatcttgggatccctggcaggatatctgtctctgtctcaaactgcaagacggatcaggagggcctgaagggagaaatatctctgaggacagccaaagacaaagggtggaggtgaaattaccattcccagttctggaatctgaaacaaccattcccagctctggaatctctgctctgtaacagccaaaggagatgccatatcacagtggctgctcaggagcaccacctgtgggtggttcactccacaatccccctgggcacaaacccttagccagtgttccctcactaccaggatatcccctgtgggatattccccattcaggatgggcaccactctgattgcttactagaaccaaggcaaaccagggtttaaggcatcatttagtgctaaaaagggggcagtgacctagaaggggaaaaaaatcaacagctaaattacgaagaatctctaagcaaacacatccaataaaaaccaaaaagagccagacagagaagactgaaataaatagttaatccttccatgcaatgttatacatgtacatccacagggaacaacagcaaaaatgggagccattgaccaaacaaacaaagcaaggaaccagtgactgaccctaatgagatgggatatgtgaactcttggaccaataattcaaaatagcaattttatggaaatttagtaatctcaaaggtaagacagaaaagtaattcagaaatttattgtcagagaaatttaacagagattgaaataattttttaaatgaaacagaaatctcataactgagaaatacattagctaaactacagaagttattataggtagaccagtaacagaatggatcagtgaaagaggaatcacagaggaaagaatcagtgagctcaaagacaagctatttaaaaacacatagtcagaggagaaaaacagaaaacagaatgaaaagaaatgaagatcgcctattagatatagaaaattacctcaaaaaaagaaatttaattattggcgttcaagaggaaatagagcaagagcaagggtagaaagattattcaaagaaataacaatagaaaacttttcaaaacttgagaaagagataaatatccaggtacagaaaggtgagaacaccaaacagattcaacccaaataaggctatcccaaggcatataataattaaattctcaaaggtcaaggacaaagagaaggttctaaaagcaaaaagaaaagaaaagaaccaagcatcatgtaaaggagctccaatttttctggcaacagactgctcaatggaaatgatacaggcctggagaaaatagaatgacattttcaaagtactgaaagaaaaaaaaaactgccattcaggaatactatatccagcaagttattttttaactatgaagaaaaaataaaatctttctcagacaaacaaaagctgagagaatttaccaccaccagatctatcttacaagaaatgataaagacagttcttcaatctaaaagtaacagtcactaccatgcacaaggaaaacatttgaaggtagaaaacccaccagtaaattaagtacatgaaaagcccaagacattctaataccataattgtgatgtgcaatccactaataactccatgaagccaaaaaagacaaatttatcaaaaacaacaatagctagtgcaacttgttaagaaataagcaatataaaaatttgtaaattgaaacaacataaagtcaagatgtggagggaatgaagtttaaaaacaaaagaaaaattctacactttgtttgtttttattctttcctttgtgatctaagataagttgtcatatctttaaaataatttgttagaccaaatggatataatacttatttacagaacatttcatccagcagctgcggaatacacattcttttcctcagcccgtggattactctcaaggatagactatatattaggtcactaaagaagtcttaaaactttcaaaaaattgaaataatgtcaagcatgttctctgactacaatggaataaaactagaaattaataaaagaggaattttggaaactatacaaatacatgaaaattaaacaacatgctcctgaatggccaataggtcaatgaagaaattaagaaggaaattgaaaaatttcttgaaacaaatgataatgggaacactgcataacaaaacctatggaatacagcaaaagtagtactaagagggaagaatatagctataaatgccaacatcaaaaaagggaaaaaaaaacttcaaataaacaatctaatgattcaacttaaaaaaccaagacagcaagaaccaaacccaaaattaaaagaaaataagtactaaagatcagagcagaaataaatgaaattgaaataaaaaaatacaaaagatcaatgaaacaaaaagtgggtttcttgaaaagttaaaactgacaaacctttagccagatcaaaaaaaaaaaaaaaaaaagagaagagacatataaaatcagaaatgaaaaaggagacattacaactgatactacagaaattcaaaggattgttagtggcttctgtaaccaactatttgccgataaactggaataaagagaagaaatagacaaattcctagacatatatgtattagtccattctcacactgctataaagaaataactgagactgggtaatttataaagaaatgagaattaattggctcatggctccacaggctgtataggaagcatgtctagggaggcctaaggaaactttcaatcatagcagaaggaaaagcaagcacatcttacctggatgaagcaggaagaaaagagagaatggggaggtgctacacacttttaaacaacttgatctcatgagaactctctcactatcactagaacaacaagggagaaatccacccccatgatccaatcacctcccatcaggaccctcccccaacattggaaattacaatttgacatgagatttgggtggggacacaaatctaaaacatatcacatacacctaccaagattgaaccagaaagaagtccaaagcctgaacagaccaataacaagtaacaagatcaatgccataataaaaagtctcctggtaaagaaaatcccaggaaccaatggctcgctgttgaattttaccaaacattaaattgattgagtaccaattctactcaaactgttcctgaaaatagaagaggagggaatactcccaaatgcattctacctggctggtatcagcctgatgccaaaaacaaaaaaagacacagtaaaaaaaaataaaaagaaaactgtaggctgatatctctgatgaatgttgatgcaaaaaatcctcaaaatgctagcaaactgaattcaacaatacattaaatatatcatttatcatgaccaagtgggatttatccctagcatataagaatggttcaacatatacaaatcaatcaatatgatacatcatatcaacagaatgaaggctaaaagccatatgatcatttaagttgatgctgaaaaagcatttgataaaattcaacattttcaggataaaaatccttaaaaaactggggatagaagaaacttacctcaacataataaaagccatatgccacatattcttagctagtatcatgctgaatggtgaaaaactaaaagcctttcctctaagacctggaacatgacaatgatgcccactgtcaacactgttattccacgtagtactggaggtcctagctagagcagtaagacaagagaaagatataaagaacatccacattggaaagaaagaagtcaaatcatccttgtgtgtggataatatgatcttatatttggaaaaacctaaagactacacaggaaaactattagaactgatcaacaaattcagtaaagttgcaggatacaaaatcaacaacaaaaatcagtagcatttctatatgtcaaaagtgaataatcagaaaaggaaatcaaaaagtaatctcacaacagccacacataaaattaaatgcctaggaattaacttcaccaaagaagtgaaagatctctgtaatgataactataacacactgatagaggaaaatgaagaagataccaaaaaatggaaaaatattccatgtttatggattggaagaatcaatagtgttaaaaatgtttgtactactcaaagcaaaccatagatttgatgcaatccctataaagtgacattcttcacagaaatataaaaaagtatcctaaaatttatatggaaccacaaaagacccagaatagccaaaggtatcctaagcaaaaagaccaaaactggaataattatattacctgacttcaaattacactacagaggtatagtaaccaaaacaccatggttctggcataaaagcagacatatagaccaatggaacagaatagagaacccaggagatctagaacaagacaatgatacccactttcaccactttaatctacataacactggaagtcctatccaaagaaattagacaagacaaaaaataaagggcatccaaactggaaaggaagaaatcaaattagccttgtttgcagataacataatcgtatacttagaaaaagctaaagactccaccaaaacttatacattatacattaattcagtaagattataagatctaaaatcaacatgaaaaagtcagtagcatttatatatgacaagagtgaacaatctgaaaaaaaaatcaagatattaatcccatttgcaatagttacaaagtctataaagtatctaggaatcaatttagccaaaaaagtaaataactataaaacagtattaaaagaaattaaagaggacacaaaataatgaaaacatattccgtacttatggattggaagaattaatattgttaaaataacaatactctctgaaacaatttacagattcaatgcaatccgtattaaaataccaatcacattcttctaaaaaacagaccaaaaaatcccagaatttatataaaactacaaaaggccctgaatagctaaagcaatcctgaacaaaagaacaaaactgaaggtatcacactacctaacttcaaatatactacaaagctatagtaatcaaatcagcatgatactggcataaaaacagagacatagaccaacgggacagactagagaatacaaatataaatccacacatttccagccaactcatttttgacaaagtcatcaagtgagaaatgaaagtctcttcaacatatggtgctggtaaaaccagataaccatatgcagaagaatgaaattagacctctatctccaaccatatgcaaaaatcaaatcaaaatggattaaagactcagatgtgagacctgaaactatgaaacacctatagtaaaacattagagaaaagctctagaaaattggtctgggcaaatacgttttgggtaagacttctaaaatacaggcaatcaaagcaaaaataaacacatgggattaaatcaagttaaaaaccttctgcacagcaaagaaaacgagcaaaaaagtaaagggacagcccatagaatggaaggaaatatttgcaaactattcatctcataagagattaataattagaatatttaaggagcttaaataactcaatagcaaaaaaataataatttaaaaatgacaaaaaggtctgaataaacatttctcaaaagacatacaaatgcacaacaaatacatggaaaaatgcacatcacacacaatgtcactaatcatgagaaacatgcaaatcaaaaccacaaggagctattttatgccagttagagtggctatcatcaacgagaccaaaaaaaaaaaaacaacaaattctgcataggatacagagaaaaggaaactctcacaaactgttgatgagaatgtaaattagtatagttattaaaaaaaaacagtatggaggtttctcaagtgactaaaaatagaactacctaccataagattcagtaatactattactgggtatgtatccaaaggaaagaaaatcagtatattgaagagacactcacacactcatgtttcttgcagctgtgtttacaatagctaagatacgaactcaacataaatgtccatcaacaaatgaatggataaaaaatgtggtgtatatataaacaatggaatactattcatccatttaaaaatgaaatcctgtcatttatggcaacatggatgagcctgggggacgttatgttatgtgaaataattcaggcacagaaagataaatactgcatgttctcactcctgtggaaactaaaaaaaaaaaaaaatgagttcatagaagtagaaagtagaatcataattatgagagggtagggagggtagccaggagaggagagagagagtttagttaatggataccaagttacacctcgatgaaattagttctcgtgttctgtagccctgtagaatgaatatagttaatagtaatttactgtacacttccgaagagctagaagagaggattttgaatgtttacaacattaaagaataataaatatccaagatgattgacatgatagttaccctgatttgatcattacatattatatacatgtattgaaatatcactttgtatcccttgaacatgtacagttattacatatctactaaaaacaaaaggaaaaaaataaccaattaaagaaccacaagatgaaataagtatcaatgaagaagaaactaattacaataatagctgaaactaatagaaaacaacgaatagaaaggataaagaaagacaaataactatgcaatctggttctttagagaaaaaaataggtaaactttttcagcaggatcatgaacaagacaaaacaacagagcaaaaatagagcaatattagagttgagagaaatagaagcacagatgcaggagcaattaaaagaattacaagagaatgctgcatgaaaatgtaaggaaacacatttgaaatgctgtaaaaattaatgccttccctgaaaaacacaatttttttaaagtaacctaaaagaaatggaaaactcaaatacaccaatcaccataaaatttggaaaagcaactaaaagtccaccattcaaaaaggcatcacgaccaaatagggtcatcaccatgtttgacccatctttcaaagaacagaagattaatttaatctatttctttccaaggaagaagtggaaaatgccttcagttaacttttgaaagataaaatcattctaatacaaacttgataaaaatgattctaatattaccaaaaaaatcttcctatagaaagaaaaagaaatccttttcctagatttaagcagcataagaacaggaatgtttatgattcaataccatatccttagcacccacgttagtacatgacataaagcaggtactcaacaaacatcttttgaattagtaataggtcagttctcctcataaatatagatgccaaaactaaaaataaattttagcaaatagaatctgacaacacatcgaaatatttatatcatgtcaactgatgctgaaaagacactcgatctcctgtcatatagtaatttaattaaaattagatagttgaattactctgttctcatgctgctaataaatacccaagactgggtaatttataaagaaaagaggttcaactgactcacagttctgcatggctggggaggcctcagggaacttacaatcaaagcagaaggcgaagcaaaagcaggcaccttgttcacaaggcagcaggagagagactgccagcaggggaaatgccagaagcttataaaaccgtcagatctcgtgacaactcactcactatcagcatgagggaaaccacccccatgattcaattacctccacctggttcctcccttaacacctggggattatcgggattacatttcaagatgagatttgggtgggaacgcaaaacctaaccaaatcaatattacaggtataataatatgcagtaccaacattttttattaccatggaggctctagcagttctgttagatcacaaacaaataaaataattaatataaacattgaaaaagaaaaaaaagtactatgttattcctgacatatgctaatagaaatcactgacggataaaagtcaaaattcactaaagtggatataatatctcattttccaaaaacaaaaaaaaaaaatgtaaggtagatagacagatagatacttaagcatggaaagatatatacaaggcatcattttagattaccatgtggcagagaaccgagtcaatggagaacaacaggaaggagaagccaggcaaaattcaaatgcaaaaaatcacacccacacacatttttgtaagattatgtatatatgcacatataaaaacatgtaggtaaggaaattttgaaataattttaatcttattaataaaattgtttttaaaggtttattttcaaagacttgtgttgctccaaaggaaaatatagaataaaataattaataggtcatccttgctgactccagctccagatggagagaggcaggttgagagcatgggaagcatgagctccaacattacctttttccagggcactgactctagtgcccctggcctacttagctacacagtctttctctgtaactctctatacggagtgcactccaactttctggtgatttattagtcacaggagagaattagcagaccaaatacaggtgtgcgctgcttgattaattacatctctccaccaatgggccccatcagagagctggtttcactccattaagttgttgctcagtcaaataactgtattattccaatatctaattgtttactttctgtaaactgattctaatcccaccctggcatagttatgaaactagaagtaagtgtcgttctaaagcagcatccctccagccccattcatttgaccatggtattcataaaaaggaaagctcattgaacacatgtggttaagtactcatgagctacaatctttggttgaattaatgtagtcagaaaaaaagtaaatcactcagatgtttcaaatgatgctagaaatgctcagctttcccttataaaataacagaaactgttagagaatttaaataatcttaataagatcaaaatgatatatttaatcttatatttttgttttaaatttgggttataaaatattttaatgtaagaagtgaattttattatttatcacatatcctctgaatattaagtatatttctgattctggtgcagtaccaagattattcttacattttgtttttactacgacatcatttttcaaatcctagttctcacaagtccatgggggcaaaagctagaagcatatagattttacatcttgagatattttgatattcttaaattggattaaacaaaaattattatttcattgtggataacaacctttttctttttaaagaaactaaattgattgttcatcttcaattttgtaataatcattctttgtgaagttttttactagctatagctttgaaaaccaggaaaatagcttttttgattaaaaccatttaagccatagctagattcgtgagaaactaatttgcttaattaaaatatttaataattaacagtcaatagtgcagtagcattcaacaccctcctgaggtcaggacagatgtatatgtaaagtttagagagaagctgagtgggcctggaaccatttgttggcaactaccatggtactgcagaatcaaacccaggtgacaggacacaatttgtcactataaagctgaatttctttctaaagatcatatatctattctgtactaaaaagtttaatttatcgaccaggcgcagtggttcacacctgtaataccagcactttgggaggccaaagcgggtggatcgcttgaggccaggagttcaagaccagcctagccaacatggcgaaaccccttctctactaaagacacaaaaattagctgggcatggtggtgcacacctgtagtcccagctacagcccaaccctcaggaggctaaggcaggagaattgcttgaacctaggagttgaaagttgcagtgagactagatcgtgccactgcactccagcctgggtgacagagcaagattctgtctcaaaaaacaaagtttaatgtatcctgttaatactaatttggcccaattctttacaaaataatacgtaggacattttatgatcaaaatatatttgttgtctcccttcctcatattaacaagcagtaaatagttgcatcattgaaatcacttttttcttgtccccaaatttgtcctttgtccaccaaaaaaggacactgctagacacttcagtccatcctgacacaacacattattaataacttgataaacatgtggctttcccccactagattataaactctgtgaagtcagaatgcttgtctatctggatcaccaatcccattgtatcatgagccttgtgtagttcttggaacatagtaggaagtcaatatttgtggaaacaaaaagaggagggaagggaaaaggaaatcaggaagcaaacaggcatatattaatgaacagtcactcactagacaataaatggttgtattattaatgattccactgatgtcactactcacattttacggacagttataagccatttgcttgcatttgcgaagactgcattagcctttcagacattttgatgcatcctagccacatatgatcttatttccaagttaacacctctgaaagaaacttattgtggtttctgttttatttctaaactaaatatagggtacccacatttttaaagcaaaacgacaacaacaaaaatttttctgaagatatctgaaccaagaacatcaagttctgttatgaggatatgggttttccattaaatggcaaatgccttgtttcatagagttaagcaaaataatatcttttttaaaacttatgtttaagtgtagggcactgaaagtccaattcagaaatgttgctgctatggaaagagcaccttcattcagttgtaaagaagccaattttcatccacttcacatttttcactctcagtcttttattcttttgagctaagaaaataagcaatgacactctgttagcttctaaagtttctactatggtctgcataattatctcaagaataccattgtattttagcacattttcaaaaagttattgtactcaaaaatgtgcctatttgtcaacatcctcttgcctctgtatagcaagatgaattttcttttcttctactggttcttacctggaactcttccccagtatttgaaatcattttaaactgacaaaataattatctatctctgttggttttatccaagaatggactatatgtcatgactgtcagaacttttctatctctcttatatggcagatatcactaattcattatggcaaatctacagccaagatttgatatatagaatttttattaacatacgcattctgacagtcacctgcaattagagagtttatgtgagataaaacttttttgccatcgctggtctagaaactacctgaaagcatttagggcaattaaatatcttgagatccattccagttttattatttatttcatctacaaatcagcttactcccaaggatttaggagagacaaatcaaacaatcttccatacaccagaataataaaatgtagacactctttgtgctgatgtcaacgatcaaggaagagagtagtgactaggtacacatttaagcggtaggaattgtgtgtcctagaaaaagacagtaaacctcatttatcttctctaaaattggaatcaaaacccatgatctgagttacagtaccctaccccaaaaccttttagtggtcaagattgcaatggtccctttagatcttgcataattttttaagaaagtacatgagatgtaggtaatatgtatgttagaaatgtggaaataaacttggtcttaggcaaaggggaatagaaagaagatcctaagaaaagaagagcttagatctaaccctgcctgtccacattggcagaacgtgggaaaggaaagaaagaaagaaagctgctgcaggatggaggagccaggagtgggagcaaacctgcttccacatcttgtttatatttaggagccattgtgttcccactagcgagtggagtggtgggcagtggcgacaagttatatccaccacagtgaaatccaacacactgggtattaacctttgaaatcttgggaagttcatctgattctgttatagatatgggctggagcaacagaacgaagtcacctcaggtaccaacaatccagtaccaacaagagtcatcccaatgtcaagaaaaatctcaaaagtgaatcttggctacaaaatatttgaatctgtgactctagaactatatctgttgtatcttttctaggttttcccctttacattctttcacttcatttattggagacaacaaaaaaaatagtgtcatgagagggatgttggcagtggcaatgttccctgagctcatcttggagagaaggactggcagagagaccttgtgaagcactaacaccccctccaggacatgttcacaggatacccaccagaccggatgacaaccaaaggacccccttagaagattttaatgtggacaggagtgatgacaaattcccctttaaaaagacttgaaagagaatcaacttttgatggctcccaaaagcagctaaatatgaaacctgcaacctgcaacacagcatgcctccacagtgtcaaagttccttccatttcctgggtctatgcactgcatatgtgtaaattaatttgaagagtgaagcaaaagcttaattcagtcaaaaacacttttgtaaattatatctgaataaagtttgttggcagagggtgaaagaaggaataatctattcaaaacctgctatattttactattaaaagtgtgatgtccacctgtaatcccaccaccttgggaggctgaggtgggcggatcacctgaggtcaggagtttgagatcagcttggccaatatgttaaaactctgtctctactgaaaatacaaaaattagccgggcatggtggcaggtgcctctagtcccagctactcagaaggctgaggcaggagaattgcttgaacccgggaggtggaggttgcagtgagctgagatcgagccattgcactccagcctgggtgacacgagcaaaactccatctcaaaaaaaaaaaaagtgtgatgtctatggcacttgtgggtctgtttataatttgtgttatgacctgtccaagttacacaagctttcatttgatggtaccatacatttttataattgaagctatggagtagggacttattacaaatacattgtaggagggattgggcatttatttggattgataatcttcagagcccgaacccaatcaacaatcacatgcccccaccattttactgtgctgtgcagaagtggtaagaatacacccttgattagtattttaacaagcaagaattttaccaagttaatatgtttataatgaatactctccataagatagagaaatattatttattgtgctttaatggaatatttgagtaaaagaaaataacttttatgtacatctatttttaaaaaaaatcccaaaacatccatgatcaaaactattatgagctctaattactaatgtaaagcacttcgtttcatatagagatggtcttcttaaccccataattgtagaaggcttcatttcagtggttccacaataatggggtaagttagtcctggactgttcatttcacttaccagaacctcattgcaagcattcttgttatgtagtgtagtatgagacaatggtatcacttgtaaaactttttgtgaaactgggcctcaaatgtatgaactttgtctcctatgaatgtcatttgttagggaatcagttgagatttactatctttcctactcttctggagataattcagtttccatccacctctggcataaggttaagtattgtttaaaaaaaaagtactgccctgaaatccacttctctaaatagtttcttgtataggctcctaactaatgttaaaagcataatctgattttcataaatatgagaatatgcttcagtataaaataatatttggtattaacagaaggaatctagggagtttatgtagtttcaaaatcttacccatatttttctactttgccaaatatagaaccaatgacccaaatgaattggtatgctcggtgttcctttccccaacttcaagctctttttcttttgcggggtcaggggagagagtttcacacgtaggacactgtcttagcttcctttcaaatatctggtatcccatcagagcagtagaaatctagaaactgttaccattattcccctggtccatatgaaggcacaattgcaggagagaagaactaaatggtctgtatcagtcagaattttcagagatgcaaaaccacatatatatgaatatatagaaattgaatatacacttggccctcgaaccatgtgggagttagggatgccaataccgttgcaccattgaaaatcaaggtataacttttgacttcccaaaaacttaactactgatagcctactttgactggaagccttactgataacatagtcaattaacacatattttgtatgttttatgcattacacactatattcttacaataaaataagctacagaaaatacaatgttactgagaaaatcataagagaaaaatatatttactattcattaagtggaagtagatccacgtaatgaatagtaaaggtcttcatcctcatgatcttcatgacaagaaggctgaggaggaggagcagaggaggaagtgttggtcttgctgtctcaggggtgccagagggagaagaaaacccgcatataagtagacccatgcagttcaaacccacgttgttcaaggatcaactgtacacatccataacaggctgtgtgggtgtgtgtgtgtgtgtgtgtgtgtgtgtctgtgtgtctgtgtgcactaatagaatgggctgtcttattttaaataaataaagagatttgtataagaaatcaactcttgagattgttgcgggcaggcaagcccaaaattcctaaggcaaaccaacaggctaggaactcaggcaagaactgatgtttcggtcttgaatccaaaatctgctgggcaggccagcaggctggaaactcaggtaggatgtctatgttatgggcttgaggtagaatttcttgttttctcagaaacctcagtttctgttcttaagaccttcagctgattggataaagctcacacatattatcgtctgttttacttaaagtcagctataactgcaaatgttagtcatgtctacaaaatggcttcgcagcaacacctagactagtatttgaccagacaactgtgcaccacagcctagccaaattaatgcatgaaatttgaacatcacatagtcctattaatttcccaaatcactgagcttccggaaattaattcttttttcatcgttttatttatttttatttcaatagttttgggggtacagttagtttttggctacatggataagttatttagtggtgatttctgagactttggtgcacgcatcacccaagcagtgtacattgtaccaaatgtgtcgttttttattctttacctccccaacccccaacccttctccccaagttgctaaagtccattatatcatccacaaattatttacatatcattctaccagacttataaataatttttcttattccaaaataaattctagaaatttcaagatggttgctttaaacacatagcatagaccatttagaaataaatgtggagattatgtcacagataagttttagctttgtttaaagataaaagctgtaaaatattgtgagggcattctgtatcaatgtaggagtaaatcagaatttgaaagcattctaaggtcagatgtccaggattatatcaccaaaaaagcatgtgactggaattgaagtaacacagctaagctcaacacacataacaatacatgctttgccagagtgcagtgtttatttcttgttttttttcttccttttataggaaaaagaaatgcaactttttcagaagtttacatcgtctgacattgctttggtttcagtaaataaggtcagaaaatatgaaagtatttaattattccccaaaattcaacaataaataaagaaaatgtggaccttatttattttatgactaccacatatttaacatcccgttattctaaaagtttctttcatttgttcattaatgttgttattcaacatgactgcatgccagcaatgtctctagtagctctcttctgtgtactggcaacgcagtgattcccagcatcgaggcagtaactcccagaaggaattggttgtgtttatagaacaactgtgaggcagagagatgacattttttctttgcataaatgcataatgttgcctgaatgggtatcactacatgccagaccggtgcatcagccaagccgaggcaatgtttgtatgtgcttggtaacatcgctgtaagaacattcctcttagtaacttccctttttgggaagttgcctatttctgaacactctccccatccatactcccaaactcattatttttttttctcttctggtgttctagagtttttcctcaacatagagtgctatgccctgatcatcactgatcatcacttatttgtttttatttgtttcttattcaccattttatgtcctgctcttggcacagtgcctagaataggacaagagattaacagatatgtttagagtgaactgatgcaaatttacagtttatatgaagatcaaaaactgccctgagtaggaagtcagaagagggaggagaacataccctattcccttaccaaacaagcattgccaactgtgagctatatcactacccccatcactgaaacatgcagtacaaacacagtgagaaccttctcctaccctggaagaattaacctctaattccctaagccatctattgtatgttataaattaactttcatatgcgtatagagtgttctgtatcatccatagaaaaattgacaaaatagtcacccaaatcagtttctgtgttctatgattcagaaaaggaagtgacttgagaaaggctgagtatcccccatggctatttggcaaaccttccatactctataaatgcatttgtactgagtaactgtagattattgcactcttggctgatttctttcactttcctctattttgtttaatcttgaccagtttaattcgtattggtggcaggaatctatactgtaactttcttattttaatgcaccactagtagataatagttcttccctctgtaagtcaaaagcctctctgtcagcctttctactacatcattatgaagctctgcgcagcagtagtttcttacttctggtactttcttagagcagcaattctgcttttaaatttttctcagttggccatgaggacagtcaatgtcaaggaattcaaaagactgggggaagggaaacggacctagaagccctatataaagtctgttatctggcagcatagaacctaatctagggacagccagaatatcaagtgaagaagagattgaggaatactgggtgtttccaataccatggatgtctattgactgcataactcaacatcttatttttttattcatcattctcctgataaaaacaggacttgctctcctcgtattatgctgttcttggtaggagctcaaatctcaaagcaggtgagacaagaagatgaaaacaaggatgtttggtcactttacataaatttttactataaggaaaatatagccttctcccttctgtttccattaaataaaatagggctcaccagtttgcttaatcagaatacaccctggctattttttggctattttaccactttaatctgccaaccattctttcaaaatagatgtgataaaaacagtgcaacctgtgtgtctctccaggacaataagtagagtgttattataaatacaggagaagcacacttttcatagatccttattgggctactgaatttctagagttaaggtctacatctaaaatcccaaacagtatacatagcagcctggagatattttctaaaatatctgatggggctaaatgatactgataaataaaacaaatgattcagttagagtttattttgtatgtgagagatatttgccattgtttgatcacttaaaaaattaaagataaaccctacttagactgctcctttcttcaaaagcctcagtctgtcgtgggggtgtggaccagacaaaacagatccccacttggtgcaggtaactgaggaaaatgagataaagtgtacttccttacttcttgatgatttttctcttcaactgaactactagaataacaatgtatttgatcatctaaatatgtaaatataaatatataatagcaataaaaacaaatacttctgggctatttactgtgagtgagcaggtactattctaagctttttacatgtattaattaatgtaattattacaaaagccccatgcaacatattattattattattattattattattattattattatttgagatgaagtttcactcttgttgcccaggctggagtgcaatggcacgatctcagctcactacaacctccacctcctcctgggttcaagtgattctcctgcctcagcctcccaagtcgctggaattacaggtgcccgccaccatgcctggctaattttttgtggttttagtagagacagggtttcaccacgttggtcaggctggtctcgaactcctgacctcaggtgatctaccaccatgcccagctaaacttttgtatttttagtagagacagggtttcaacatgttggccaggctggtctcgaactcctgacctcaggtgatccacccgcctcggcctcccaaagtgctgggattacaggcataagccaccacacccagccaatatatattattattaatctcatcttacatattaggaaacttaggcacaaagagatcaagtctaaggtaacacagtgaaaataagtatattgataaaatattaaaaggcaatattattaggtaaaactagtattctttgtcactaaattttgttttcatcaccacttaattaaaccttggctcacgaaaatttttattttctcaaaaaaggaaaaaaaaaaaaaaacaaaaaaaaaaccttggcttaggtgaggacttccctcctagcgatttgcagtttcctcattataaaacatggtgcatcttcctggtggcaaagtttaataccagttctcactaaatggtctcatgtgcatagagaaaatggctatctgtttatacagattgtgttgtctgtggtgattccatactctttctctttctgcatgagaaatagaaaaaccaagatgatgtctgaaatcctcaagagtttcccccaaagcagtcattctagtgatcattgtcttccaattcaaaaacttattaaggaaccaagtgactggttctttcaaatagccaccctccccttccccacagagttccttgctcagcgcattaccatctctagttatcctgtgcatagcaaagatgattccttactggggcctggcccctggaacatttaaaagcacgatttagaaagagaagcagcttttaaatgcagttatatgctgcttccctcagtagtacaaatgtcatgtaaatcctaagtgagccttttatttaaaccaactatacaaacatgggtaccccaaataaaatttgctgcattttaaatcctagacaaattcatggtaacaaacagcctcagattccactatgtataatgaggaagatttatagttccttagcttgtgtttcagcacctagtttgccgcccaaataatgaggctactttaattaagaattctagactcccaagcttttaaagcagtggcccattgagtgatgcaaatagaaaacaacacataccattcctctcccttcctcctaccccacatctgctccttggcttgagaggtgggagcatgtcacaatgtcctggcaacttgtggactagggcaggtcatacaatcctcaaactaatgttaaatacatggttcattgtagaattccacagttatttgtctgtgaggatgcattaaggataaaagtcaggatgatcagcagacccacaacacaacaaatccataatcaataacagccaactttaactgaacactcactgtgtacaacgcatggttctaaatgctttacacattttaacttattttgtcttcatagggaaactatgatataggcgctattcttttcatccactttttacagatgagaaaatcgaagcacagagaagttaaataacttgtcaagatcatactgctagttggaggcagagccaaacatttgaacccaggtgttacagcttcagaatccctgagcttaatcattatattccagctgcctctcagagtagttttatgttgactgtccttctcttcctggcttcagagatgaagaagtattttatcagctccttactcagatttatggaaaagacaaatttcagaaatctcctgttgtatttttttttggagggtgggatggtttgaaactttctcataaacatttactgaataaaaagaccccttataactctcatatttttctagcagagaacctctggataattaaaggtagttagtgggctgggtgcggtggctcacgcctgtaatcccagcactttgggaggccaaggagggcagatcatgaggtcaggagatcaagaccatcccttgcagtgagccgagattgcgccacagcactccagcctgggcgacagagcaagactccgtctcgaaaacaaaaaaaaaaaagaaaagaaaaaaagaagagtagttaatgcatcccatttgtacttatatctgtgacactttaagaatccaatgagtacaaaaagcatcaacataggtcacaaatgatacaagcagagcagcatacctggagagtgggtgatttctgagcccattttatctcactacatccaaccactatgaattcgctaatagaaatatgtcagtttcaaccttttcagtattcctgacatttatttaaactcaaggaatgaagaggaaatttcactgtaggctacaaaagcaatcaagtcattggaccatctccattgcagtttcaaactagcaaacttcattcctctgtgggaattcaggatgattctctatttcagagtccagattacaagtcagagtataagaagagcccaagtcttctttatcttacccattaatgtgtcagtaatgtgtcgcaggtgcctagaagtgttcctggcagatagtaggcactgagtacatattggtgaatggaccagttagaacaaaagagttatctttgagtctggtttcattaatttcatttaaggtaaccaggtaagactttttaattcaaatttattatataattcctgcaggattcacaaactgaaatatagtaggcaagagaaatctttgttcaaatttgtacatctaagactatttcagttgtcccaggacttgtcaattatactaccagcatttggcaacaggttgaagataaaagcctccacccacccaaaacacataccccaaactcacgtgaaaagtggtctctcgaatcagacctaagcttaaattcaaactccaccacttaagaactgcattttgaacctcttgtaacttcagctttctcaactctaaaatccagtaagaatgcatacaggagttacggtaagcattacattagataatatatcaaaagggctagcacagtgcctggcatacaggaaatgcctaataagtggatggaaagagtggagtgggaacatgctgaaccctctttcattctgaggctcattctccatgtaatttttaaaatcttcactttttatccctaaaaacacaatttttctttcaaagaatctatttgtgctcctctaggtcactgaaagtctcagagaagaattgtgataacttctagtaatttgctaggggagcttggcaagagtggatctcatcaccatggcactgagaaatctcatactcataatgagaatatgtttcacaaaatgaaagaattatatagattctagcttgttgctagggccgggtcctcgtttaaattaatgtcaagctgtatttccaagtaattctaatgaaaagagcccttgactgtcccataccctaaagattccaatataatgtattattttaaatattaacgtgtggaagagcctcttagactctcttgtcccagtcaggaattctgttgctcgtactggggaaatatgacaatttttgtcacagaaaaaaattgtgtttaattggtgatataaaccaaaaaatataaaagatgcatattggacataaaatcatttcattagcttacaataattagtgttatcactagcaatgtaatcctaagagaagcagactgttggattcaaggcagaaaggaagggaaatgaagctaatgttttaaaatttatgtaatgtaccagaagctaggatatttaaccaccagcacttactgagcttagtacgtgccaagctctgtgcttagtaattttattcccatgctcttatttaatgctcacctattctttgaggtgtgtaaaatctatcccaagtgagaaaactgtagcacaaaagggataacttgcccaaggtcctttaagaagtggtgagttcagaacttataccccaaaaatctggatcccaagtctaagatttcttatgctaccatttcatgttccctgttgaattaagaggatgataaaatcttgaccctcataattggaattattaggggtacaggatctaattttatgattaatatacagcaaaatacactgtcatataggacgaccatttcacaggctcttcaagaactgaagttttgaagatgcactttggatcctctctcaaatgaggaagaaagtagatctcaatctctctgcagatcaactggttctaactgaactctgcaattgtggagttttcacttatcatgattttgttttgtttgtattactatccaatttcagatccacaggttacacacgataagttttctttattcactcaccaacttctcccagcccatgactctttctccaaaacctttcctgtgtattgtcataagtaggtttcataatcagaaataaaaagagaatcaaattcatgccaactcaactcactgggactggtttctgaaggcatgcttcagacccttcacttgcttttcagacaagactgaaaataattggtctgtgctaggtctgttttcatgaaattattctgaagaacagtcattatgttgggaagattctactttatccatctccatgggtttgctaaatgaaaacagcagtttgttgaaaaggcagttgtaagattttaaaaccaacacatttaataaagtccagtttggtttcttacacatttctacggacatgacctcaaatcccaaagtttaaaccactttgactttggaaaagatatccatctgtagctataatgtattaacttttctccacaatgttcaggatgctatgatgagttcagaaaaaaaaaagtccttataaatatacagatttacatcctacaacaatgtcatgactattaaactatgtgatatttggtcagttcgtgggatatttgtttttataatgggttcctaaaatgtgttccagactgggaggtggacccatgcagaactcttctatgtcttgggatttataatggcctttgcggctttcacatatagaagtggtttagcaaagctggaagagtttccagaccaaagaccttggctctaatcctggctcagttggtaggattcacctaatttaaacatattttctcatctctaaaatatatggattgagctagataatttctaaggtccccaagaagcctaaagggaagagggaaatctctaaagcctccttctactcctccaccccatatacacacaccttcttcacttcttccccttcccattgcttaacaccactggaagcagggtgactactgggattggtctgatttccagattccaggacactactggacagggtcgctgtgcagtggaaggcacttgggggtggctcaccattccctgtgcagctggagttgggagttgggcccccaagctttctttccatgctgctctgcgctctcttcctctccatgaactgccagcctgagcccatgactctattcaaaggctagtcattttagaaactggattggaaacaattacattctttcttaacagtcttacactctcctgtctctatctgtgtagttccactcccatgcagctggaagatatgatagattggatataactatctgacaggaaaaaaaaatatcctcatacagtccaatcagtttcaccagagttctatagactaagacctcaagctcaaacccaactgtcaaacatgtagctttgtgcatttcccctctgtgtgttccacatgcatgtatcttcccagaggaccttccaaggaggataggaggctgggcctgggtgggaagaagatgttctgaatcccttggctctaacactctaccatcaccaataataccataccaataggatggtttagagaatctcttttgattttaaaaacaactataaataacaattttatcagaaattggtttatgacttgattaatgtagagcttacctgacaaatataatatatgccaaaaattcacttgtctgaattagtttgcatagaatccaaacccctctctttctcagagtatctctaactctatttctttccttcactgtctctttcttttcctacaaacacacactatactgtgagcatgtaggtgtatcacagcatcacattgagagagactgagtctgctccttcccagccaagccatctgaaccgaggagtctcccttgatgacccaaaaaagaaataatagaattggtgcccgtttttcttgttgacagcccacatacaccacacacacacacacacacacacacacacagagacacacacacacacacgcagcacctagcttatattttaccacactctgggaactgtgcacctcaaataaaagtcactgcaacagtggagagtgaattatcaaggacatatccctgaaatgagaaaatctgcaggcaagagacagctgccctctatgcctagtggagcttggagagtcctcttcaccagcagcaaagctgaacagagctcccttctgcttttcctttagggcagtgacttatcaatagtgaaactttccaggtccttagcctcccatcctctcatgagaatcctatcatttccacaccattgactggagcctaaatgctgcttttggtatggaagtaaaggaaataaagcttaaggaatattcagcagccacctccttaggcacttatgaaagctcaacttaaagggtcatgtctggcttcccagggcagcaaagagaaaggagagaaaaaagctttcaagagctgtaaccttccggcattcgttcagtcagtactttctttccatagtgataacaaatgcaggctatgtcaaagatttttagtttttcctaacactccctgagcaattctcaagctgttgccataagcagctcatgttttctaatgcacaagagcattttagtaattaggcatgagatgctgcttaccattttagaacttcaatattgaagcctagtagaggaagttttggctgagtcttctcagtttacaagggctacttacttgtaccattttttttttcaagaagagtcctgggtacaatgacaagctgggaccaaacccaaggcagagctggctccccatagagtcccagaaagtgagaactgtaccaagcacttccctttgtactgcataacagcaggggagaattatgataagggaaggtaggagggaagaaaaaggagggaaggccagggctgaccaaagatggaaaaagaggaagttagaggacatagtctggcaaaatctggttaccttccctccttaggcggaggtaggaaataacaaggaaggtgcttgatgacactgcatttcttggggtggcatgagggaagaggggaagggccctacattctggaataaccacacaagctctttacctcattcggctccctcaacctccatgcaaacgcaaatggctaaacctcctccatataatatgctgccctagccaggaatggaccccaaaattaaatctgttatttcttgtaaaaatattacatattcagagtaaaatcttcaattatgcaaaatggcatatgatgaaaggtaaaattcctttgcctgtcacctgacttcccctcatgtgcccttgctacagaaactcacacttaacaatttattttatatccctagagaaattattcatatatgaaactgcacctatatataatgcttttgtaaaaaatattcaaatgagaatcacgtaaagcatactgttctgtcacttgcttttttaactcagtgtatttgaacatttttccataatcatacaccagaccaaattcactgttttaaggactgcatagtgtttgggcagaccataccatgagagtcttctcataagtgaccattagataacttccacttactttgcattacaagccatgctgtagttaagttatttgtacatccatctttgtgtacctgtgagagtatatcttagaagactggaatcctaggcttaagaagtatataaattgtaaattttggtaggtaatgtcggattgctcccaacaatactgcttacaagtttttgctttccaatgtccttgccaatacccaatattcactaataggtaaaaattgtactgtattattttcatttacatttctttaattatgaataaaactgggtatatacccactcattacaagtcctaagtatggatttataatgccctatttacagacacataaatatacacagaaacatttctcccaggaaggacctattcatatcctttactcattttcctttgtattgttcattcattcctcttaatttgtaaggatatataatatgaaattactgcatttttatcaaagggcttttactttatttatagtactgttttaatactgaagtttttatgcttttttcagtagcccaattcatcgatcttgtgcttcataacttctgggtgttatgtcaggccccaagggcttaccaactccaaaattattttttaaaatcactggtattttcttctagtatgatcatgttttacttttgtaagtataaatgttttaattatttggaattacttttgtgtaagacatgaagtaagaatctacctgtatattttcccaaaattttcagttgtccaaacctaatttattactaatctaattttgcctcactgatttcagatgaaattgggcacattcagggtggtatggctgtagactgcgccgcttatttcaattgtcaaatgccaaaacatatgcaggtctttttctagactctgtaatatgtttcattgattttttaatttttacctcagttataaactgatttaattctgtaactttttatacatttcagtatctgctagggttagtctttcctcataactcttctttagtatattttattttcaagctggaaaagttagaagcagactctctcttcaaaggtagaagtttgcatttgctttgaaggatgactatgctggagctttgtgaaaagccatttgaataggtcctctggttatgtaacacttacctatagctctggggaagacctcaatgcaaactcggatgcgttctgttccaactgaagccaaatgttctgtttagaaatataaattgggcaaatcttttagcagaactgtttctacttatatagtcaatagagaactgtttcttccctaagcatggatttataatatcctattcttatatatgaattcatgtgacagagaaatatgttttcctgccctggcagaatttgtgcccaggagttgcagagacagggtgaaggagccagtgcaagagagaggccagaatggaatcctgattctgtcttcagcctacactacaagagagactgtaggaaacaaaaagaaataaaaggaaaagaaaaaacaggtctggagaaggcagcccatcctgaacctgagctctttattccacagtttgtgttatcaaagattgaatgggctgaattgggaaaatgtatattgttctgatttattctgaagccttcagggaaacccttatttctgtggccttttcctgtcagggaaaagagaatgactattcccaatcatccaggaaggggagtgaggaaatgtggatatttggaggcctttagggtctgtgggcctagcctccaggtaagagagatgtgctcaagggcagtccacggtgagtggttgggtaatgcgtgggtggttttgagagctgtaaaagaggtacacccagtagatagcctcacagaggagctttgaaaactgccatgtctggaatcctttttgcattctctgttgtgattcacttctgaaacccctaagccttcacaaagctttggactatctaacaagcaattatggggggtttaagggaagtggtttgcccactttggggaaagtggtcgagacgcatgcagctgcagggtgaagagaggggaaactgagcacagacagcagccagataactaaactgacaacactccccactcccaatttctctaacatgtgaacctttacctgggggtcccagaaatgctgaagtggggaaagctgggatacactggaattcctacaggcagacaaaattgggtactgaggggaagtgtgacctcacatctgctgaagaataatcatttcttgtaacaaatgctcaattcttgtaatttctacttttgttgctaaaagtgaggtatccttttactcattaaactatttaagtttttcaaacaggccagcttcttttttatgtttttgtttcaaaagttttgaggtacaagtggtttttggttacatggataaattctttagtggttatttctgagatttgagtgcatctgtcacctgagcagtgtacactgtacccagtatgtagtcttttatcccttaaccccctcccaatctttcccctaccctggctccccaaagtccattatatcactcttatacctacgcatcctcatagcttagctcccacttataagtgagaacacacgatacttggttttccattcctgagtaacttcacttagaataatggtttccaactgcatccgagttgctgcaaaagacattatttcattcctttttatcactgagtagtattccatcatgtatatataccccattttctttatccactcattggtcaatgggcacataggttggtttcatatctttttgtaacactcagatttagaaactctacttttgtttcataaaatgaggtatctttttactcattaaattatttaagtgtttcaaacaggccagcttctatctaggccttacccaacagacactgttttcatgtcaatcctatcaaggcagaaagagtttttatcctaaacaacaataaatgaaaatccagcttatccaggtggttacctcaagtctccttttatcagactgagggcttggagatcagtcttggttgcaacctttgccagcaagcagggtaagtctccagtgatgggtcttgctctgttgcccaggccctcacatttccacatagatacagcctgtaggggagcacatttcttttccaggtgttgctaaataaaaataattaaagaactgaggttcatatgagcctttttttttttttttttttttttttttgacaagagtcttgttctgctgcccaggctagagttcagtggagtgattatagctcattgcagccttgaacttctaggctcaagcaatcctctctacagacaattttgtaatttgattttcatttagggtctccccagatttttttctgagacagggtcttgctctgtcccccaggctggagtgcagtggtgtaatcacagttcattgcagctttgacctctcgggcttgagtgattctcccacctcagcctctggagtagctgggactacaggtacacgtcaccatgcctggttaatttttgtattttttgtagagacgaggtttcaccatatttcccaggatggtctcaaactactgggctcaagcaatctgcctgcctcagcctcccaaagtgttgggattacaggcgtgagccactacgtccagccaaggtctcccaggttttaaacaatcatgaaaaatcatcatttgactaatgtaccattagtctttatgaatttattcattcatttaataagcacctattgagcacatgtctgtggtatgtgcaactttataccatagaaaatagagatgttgatgacaatttgcttgcatttttacaagcttttatttttaaaataatttccaaatgtattaccttatctaatccgaagtagaagaaacatctttgattttctttttgaaaaattaggctctttgagaaacaataagtcccacaccaatgtaaaaaaaattaattgtatactttgcttatgttttataaaacaggaaaattaatgagatcatctgagaaggatacttgaaagtgtttgacacttagagcaattttttaagtttgaggatgaatacgagtaaattttttaaatttttcatataatcaccatctggaaattttgcgaaaaaccactgtactaattgatgctattagtatgcacaggaaaaaaatagtgcaatggaatatataatggagtctttccttccattaattttcctatatgtgctgtgattacatatatttcaatacatgtaatttaatattctgattttttttttgagatggagtctcactctgttgcccaggctgcagtgcagtggctggatctcatctcattgcaacctccacctcccaggttcaagcaattctcctgcctcagcctcctgagtagctgtgattacaagcacctgccaccacagctggctaatttttgtatttttagaagagacagggtttcaccattttggccaggctggtttcaaactcctgacctcagacaatccacctgcctcagcctctcaaagtgctgggattacaggcatgagccaccacacccagcctaatattctggtttttaagtaatattagagcataaatattaacatgctattgtacagtattcataaccatcttgttagtatttatatcatattacagtaggtgactactatatgattataatgtatcatataacaaatgccctattactagacacacagtcttccaacttttcggctatattgtatataattatctcttcatattgctgttgttttcttacagtagttactagaagcctatttttaataatttatcttcttttgactttaagctttcttgttgaaattatgacagatcattgcaaaattaagatcattaaaatcctaataaagagttttgctgcacttgtcacttgtttaaatctacatctgttcttgagttactagtcctccacaattttctctgactgctttgttcctctgcaaagtaaataatatatttttctgtcaacttttggtgtacagaagtgggctcattaacaacaataagccactctgtacccaaatataagagctaaacataaaaaatgaatcagtaatgggagacactaagtgttgaattaaacagcgaaatatcttgggcctctggaatcattcctgcgcattgaagactgacttagtaacaccttttcctgagtaacacagtgggtttgctctgcctctatttattttctgtcttttttccctaagcctgtttgcataaaaacgaaacgtttctggtttcccacctgcataacaccattctgctactcttctatactcctttaattaatcagtcatcatgaaatcattttatattcctcccatctcatgaatagagaaaactatccatagatcctattgagccattcacagtgcttgctaacatcccattgatggtaggttttataaaagaaagcaaatcaagacttctgttatatttaaagtttcacatccataaaggtttattgcggcctccctgcaattgactcctagaaaatgctttctttcagtgaatttcagtgcagatcatttaaagggggagaaatatgcaattattgcagaaacaaaacctaaaggaccaaatttcttcacccaaaaaaataaataaatacacggttctataagatacatgcactttgaaatatctctacataaattgccaaatataactaggagcgcttcagaaggctggttagctatttaaggtatatacaaagaagattggataaaaatttgcaaataggaatgttaagatctttttatctttcatgttgtgacaaattaaatacattattcactataaaaatttcaaattaacagaaaagcaccaggaagaaaataaaataaaatccactggtaatcctttaatcttttacatagaaagaaccacattattaatattatgcatattttaaatatttttctattagagcttttttgggttttagttttagttttcacaaaacaaggatcatgctccatgtgttttaaaccttgatttttttcaattaaagatacactctgaacaatttcctgtggtattaggttcctaaaatgtgatttttgtcagccatatattctatatgttaatataccacaaattatttagttcctgtttttaagttgggattttttagtacacataattgtaattacaactttacataaatttttgtatgccccttattatttccttaagagagacttctggaaaaattactgattttgctagccaaacagtactttaaagatgtttagaaaatgttgtcaagatgtccatgaaggacatgtcattcatttaatctatgaaaattatattaaattttatttatttttttccagcttcttggaagcattattgacaaacaaaattctataaatttaaggtatacaatgtgatgtttttgtatacatatacgttgtgaaatgattaccacaattaacctaactgacatatctactacctcacatagttagcattgtgtgtgtgtgtgtgtgtgtgtgtgtgtgtgtgtgtatggtgaaatcactctagatctactcttttaacaaattttgagtacaaaatacattattaactacagtcatcatgctgtacaggaagtccccagaacttactcatcttataccagaaggttttatgctttaactaacatctccccaacattcacccccgagccactggcacaccatagtactctgtttttattagtttggctattttagagtccacagataagtgagattatgtagtatttgtctttctgtggctggtctatttcactcaacataatttcctccaggttcatccatgttgtcacaaataagatttccttcttatttgaagcagaatagtatcccattgtgtgtatatacattttctttaagaattcaccagttgatggacacttaggttgatttcatatcttggctttctacaatggctgtactaatttacatttccaccaattgcatgcaagggctccctttctccacttcctcaccaacactttctttcgtcttttgataatagcctctctaacagatgtgaggtgatattgaagtggcatcagtcatctggggtaatacccaaggtttgttgcctcaagccaaggaaatcaaggatgcagacacataaagagtaaggctaagagtggaggtttgatatgtgaaagaaagagaaaagctctctctcctgcagagagaggggagctctcgagtgggtcttccagttctgtggtgaaatgcacagtttttttggttttgtggggtttttttgtttgtttttttgttttttttttttgagacagagtctcactctgtcgcccgggctggggtgcagtggcatgatcttggctcactgcaagctccacctcccaggttcacgccattctcctgcctcagcctcaggagtagctggaactacaggcacccaccaccatgctcggctaattttttcttgtatttttagtacagatggggtttcaccgtgttagccaagatggtctctatctcctgacctctgatctgcccgcctgggcctcccaaagtggtgggattacaggcgtgagccaccacgcctggccaatgcacagagttttatagataagcttaaggaggcagtgtctgatttacaccaggcccaaaaggtgtaccatttacataacgtgcaaagaagctggctgccccaccctaatcttttattatgcagatgggttctctacctggccagcaccatgttgcctgttcctttactacatgtggttgacaaagaaaaaggaagatggggcctccatgttgaacatacctggcttccaggtagccttttcctattggcacagctgccagcatttacctgtgcaagcttctaccttgcttttctatgtctccagcttgatttttcaggctgctctttgttagaaaagaaaaatcaagctcctctttgttagaaaacaaatgatttgggggctgctttttattaaaagggaaaccttactgaggactcttttactctcactatttgtctaaataatttctttttagcttgtgtatcaatatcttttaggttttagtttgcattcctttaatcaatagtgatgttgaccatttttccatatacctgttggccatttgtttgtcttcttttgagaaatgtctattcagatcctttcacccatctttaaatcaggttatttgttttcttaccattgagtggactgagtttcttatgtattttgaatatcaaccccttatcagatgtataatttgtaaatatcttctcccattctgtaggttgcctccccagtctgttgattgtttctttgtagtttgatgtaatttctttgtctattttcaattttgttgcctgtgctttggagttcatagccaaaaaataattgcccagaataacatcatggagcttttcccctatgttttcttccagaagttttacaatttcaggtcctacagttaagtctttaatccatcttgagtcagtttctgtatatggtgtgagaaaagagtctaatttcattcttctgcatgaagatacccagttgtggaagagatgctcattccctgttgtgtgttctggtacctttgtcaaaactcagttgaccatatataagtagatttatttctcttccattcaattatatgttgttgtttttgttttaatgccagtaccatgatgttttgattactatagctttgtagcatattttaaattcaggtaatatgtgacctccagctttgttctttttgctgaggattccattaggtattctgggtcattgtggttctatatgatttttaggattattttttctatttctgtgaaaatgtcattgtaatttttataggaatttcactgattatgtcaattactctgagtagtatggacattttgacaatattaattcctccaatctgtgaacatggaatatctttccatttatttgaatcttcttcaatttatttcatcagtgtcttatagtgtaggtttcagcatatagaactttcacttccttggttgaatttattcctattttgttatttttgataatatcataaacaggattattttcttgatttcttatttggatagctcgttatttgtgtacaaaaattggtatacaaaaatgaaactgatttttggatgttgattttttattctgcaagttttctgaattcatttgttgtaaggttttttagtggagttcttagggttttctatataaattaccgtgttgtctgcaaaaaagagacaatttaacattttctattctgacttgaatactttttacttcttcctgttacctaattattctgtctaggacttccagaactatcttgactagaagtggtgagagtaggcattcaagtcttattcttgatcttagaaaaaaaaaaaaacttgccactttttgctgttatgtatgatgttagctgtgggtttgtaatatatggcttttattgtgttgaggtacattttttctatcactaatttattgagaattttatcatgaaaggacattgagttttgtcaaatgctttttatgcatctattgagatgataatatagtttttcttctttattctgttactatggtacatatacatttatagatttgtgaatgtttaaccatccttacatccctaggatactaggatacttttaaactgttgttgaattcagtttgctgatatttccttgaggatttttgcatttatgtccatcagcattaatggcctgtaattttcttgttttgtccttgtctgaccttactatcatagtaatgctggcctcttaaaatgagtttggaaatattccttcttctaagtttttttttttttctctgagaaagtttgagaatgattgatatttgctcgttaaatatttggtagaattcagcaatgaagccatcaggtcctgggcttttcctcgatgggagacatcttattactgattcattctcattattcataatcagtctgtttagattttctggttttttatgattcagtcttggtaggtgctatgtgtctaaggatttatccattcccactaggttatccaatttgttggtaaataatttttcgtagtcatctcacgatcctttatatttctctggtatcagttgtaatgtctccttttcatttctgattttatttttcttccttttttctttgtctagctaaagttttgtcaattttgtttcttttcaaaaaaccaactgtttcattgatcttttctactgtttttctagtttctaatttatttctgttccgatctttgttatttcattccttctgctaactttgggcttagtttgttctttttctagttccttgagatgtcaagttcagttgtttgtgatctttcttcttttttaatatcactatgtgtttccttcttagtactgcttttgctgcatcacgtaagttttggtaagttgtgttttgttttcatttctcttattttctattttctcttttgatttcttctttgacctattggatgttcagaagtatgatgtttgatttccacaaacagtctgcatcacttaacgacagggatacatcctgcgaaatgcattgttaggcgactttgtcatttgtgctaacaaaatagagagtacttacacaaccctagaagataaagcctactacacaaacaggctatatggtatagcctattgctcccaggctacaaacctgtacaacctgttactgtactgaatactatgggcaattgtaacacaatggtaagtatttgtgtatctaaacaaagaaaaggtaatgtgttgtgctgagtcattaggctgctgccatgccactaggaaacaggactttttgagctagattactatctaatgggaccacagtagtatatgcagttagtccctgacggaaatgttattatactacacatgactatatttgtgaactttctagttttcctcctgttgatttctagtttcataccattgtggttggaaaagatactagatgatttcaactttcttaaatgtgttaagactatttgtgcactgggtgggatgatgtggttcccgttctgatttgggcatagtctacatagtctaggtgcagctacatcagctgagggcagtgatgctgaagattgcagggtcccagtggccaatgctgttatgtccacagcattgaggacagctgttggggtcttaggtggtgaagactgctgaggtcgtcctgatctgtttttctccaatagaggaagtcttagaagaaggaatccctcttggtgccaggtatagctcacaggtgtgcttatatgatagggacactgcctgatgcatggtgcccagggagtggccaggaagcccatgtctagaaccaggctgtcacggagtttcaggcctcctgggtctgagacagcagaggcccttgttttcatggtgcagggcctcccactgcctctttggtaatggtgtatgaggcatgggagcttgttgggcagccgtgaatttagtgtctagagcctgggcagaagcagagttacagcaaggggtgtggaggcgcctgctgtggattggctctggtgtctgaggctggagatggggaggctgcataggagccagggtctagagcaaccaccacttgcggttagggtaagcccaaggttggcaagagtggttgccttgtcccagggtggtacaagagcagctctttcttgggagtcagggagtgcagcaatatctccctcacccaaggacacaaggtggcattggctgttggctacctcagtggtgaaagctgctggtatctttcatggcacaagctactggggtccatatgcctccactaaatactaggagggaactaaggagttcaaggctgccacagggctgtggaggtctcaggcatgaagatcaccagagtcctccacagagccagtctttggggatgtgctggcaaccactgcatggccaataaatagctcttgcccttccttgtttgcagctgtctccagaagtctcagttatgttgatctccacagtgatcctttctaggaggttattatccattttttgtcccaccgtgttgctgcagtttcttagttgaggaaatgtccggctttcttgcagcttaaggcctatttggaagaattggctaagttagaccaactggagttatctcctaggattttatatgcaaacagtaagagaaatactctttcctctcaattgggagctataattatactatcctggagttctcatcagtcttgccctctgctgtgtggaggcaacagaataaagaggtcaagaactatgatggaagctgaagaaaatggtagtggccacaagaaccacagtctttaagctgatttgattccctagactcatctctctgttcccagttacaaaagacagtatggtgctccctgcctttttgtctttaacctacttgtctaacacagactccttctggttcatgctagtaagtgccttactttcttttcttctattttagaagatgggatctaggagtcctagaagcaagagactagaaaggagattctaagtttaagtccatgtttttattattctttcctgtagcactactttctccaactattttatttactcatacaattaattcaatcaacaaatattgagcaactcttattcaccagatagtctactatgtgctgaggatacagcagtaaacaaaatgcataaaattctttaccctcagggaatgtgctttctagttactttaccatgattattgcctagttaactagtggtgacaagaaaattaatcattagaagtacgtcccttgtgaatttggcacccatatgcatatccttaagaattgtggagccatcccaaagtgaggattctgaagatggattattgtgctgcttgctcaagcttgtgcttgactccccaaacttgcctgctcactctcccagcagaccagctagtgtggggtgccccaagcaagagaggtttttaggatgcagactggctgatgtaggttatgcaggtctttacctccattgatgtgggctcatgtttcaggcagatggggagtacttaaggtggcaaatcctttatggagagaaaacttgacattcagatggttgtttttaaatgtttcactttttgtacagttgacagatatcataaataatatcaacctttacatttgatatggagttaaacttgatcagtactactaaataaaatcaagatctggtggggaaaaagaaaacaaaaaaaaaacaaaaaaaaagttatctttatttggagatttattaatctccaaataaagacagtaacagggtaatcgtctgcctaacatgatgtaactatcccgtgtgtaaccaaaaatgcactaatctcttcccagaataggaggcaaatcccttaggcaatgtttactcttctgatatgccataacttaaacatgttgatgtaaaattaactatacttaaatactgatataaatgcaataaatcttgtattacatgataaagaaataagaaaacaaaaacaacacatgtacatatgcacatatatttttcacaaaataggaaatacatgacaactacagtcctcatttctgtaactgatcacgtggttgtagctagcatttataacaacatttttctattaaaaattttgtattttctttacctgcagcaagcaactcaactggtcatggttcttttgttggtggggtgactataaccttcatgccaagattctgggccattcatagtcttgcctgaattgggtggttgtaatttcccatgatggtaatcacaggtcacggtcatactaaaagacacccgaagggatctcctgtattgcagacccacccttccttacctccattgtggagtagtagtcaagtttcccctttgtagtcaggttcaattatcttagccagagtcacaactcctttcttagcttgttgacacacagaggcaccagtagcccaaagtggccgagtatcaatcttaacttccagttcagttggaatcattgctgtgtctcctggcggaatgattcttccctccaaaattatgacctccatgccagcagagcataaagtcatgggaacagaaagcaaaaattttgctactggatcactagagataatggtgagtggtgctactcccgtttccaccccataattcctggatccatgaatcctggctatggaagaaatagtatcaaatcttggacattaattcagagcatatacacccttctgttgaaccttgccccagccctacagagcacctacctggtgctgtaactgcaacttcaaaagaccatctgactgcatgatcaagctagctagctacttcaggatgatggggaacatggtaagaccaatgaattccatgagcatgagtacattgccacacttctttggctatacagtgagttccttggtcagaagaaatgctgtgtggaataccgtgacagtggataaggcactctgtgagtccagagatggtagttttggtagaagcattgcatgcagggaaggtaaatctatgtgagtgtctattttagtaaggacaaaatactgtcccttctatgattaaagtaatacaatgtaatcatcctgccaccaatgtaatcatcttgccattttgtagctagccaatcatcccaagggcatggtaccatatagggggctcagtgttggtctctgctgctgacaaattgggcactcagtggctgctatagccagctcaaccttggtgagtggaagttcatgttgctgagcccatgtataacctccttcccagccaccatggccactttgttcatgagcccattgggtgataatagaggtggctggggaaagagcctaactactagtcacagaatggatcactgtatccacctgtatccacatacctcttgcccaaatttcttcatcatcaattttccaatcatgttccttccagttccctgattccttgatcatttgtccaaaccattggctacagctctggccatttctcctttcaagtaaagtgcacaaccagctacactgccatatgttctgcccactaagatttcccttcaccactgtctttcaaggatgtcccagaaagggactgtattgctgcaagctgtccatgcagaaccatctgtaaacgaggccccagtcttctttttctctgtcaattgattatagagtactctccattaggccataggtgcaggctaggagagagaagacagtgtagcaggagtgaactatgggcatttgggccatttcatataacttacttgtgccttcaggacctgttcaagcaggatcatatatagaccatttccatttaataataaagtgttaatgtgcatgcccaacttaacaatatgttgggtcagataacacccaatttataatgggcagctcaggtcacgtggtaacctgacagcctatggtcaaacatttagtatcaactgaggcccagcaccaggccaaaagctgtctttcaaaaggaaagtagttatctgtggatgatggcaggaccttgctccaaaatcctaagggcctcagctgcaattcacctatgggggccttccaaaggcttcaaacggcattcctacctaccgctgacagctcaagtaccatggatctgctgattcatgtggcccaagtggcagagcagcttgcacagcagcctggacctcttatagagccttctcctcttctgggccccactcaaaactagcagctttctgggtcactcagtagatgggccagagtaaaacatgcaaattaataatatgttgcctccaaaatccacataggcccactaggcattgtgcctctttctcagttgtaggagcagccagatacaacaatttatccttccccttagaaaggatatcttgacacgccccataccactggacctctagaaacttcacagaggtagaaggcctctgaattttagggggacttatttcctatcttctgacacacaaacttctggccaataagtccagactggttggtacttcatgctcactagatccaatcagcataacatcatcaacataatagaccagtatgatatcttgtggaagggaaaggcaatgaagatccctgaaagcctaattgtgacatagtgccagagggttgatgtacttctgaggtagaacagtgaaggtatattgctggtcttgccagctaaaagcaaagagcttctggtgggccttatggacaggaatggaaaatgaggcatttgccagattaatagctacacaccaggatatgtgttcatttgctcaggcaatgaaatgccaactggtacagcagttggaactggggtcacaatttggttaaggttacaataatccactgtcattctccaagatccatctgtcttctttacaggccaaataggagagttgaataaagatgaggtgagaacaactacccttgcatctttcaagtccttggtggtggcactaatttctattgtttttgattcactattttcctaggtagaggtggctctaatggcttcaatttggcctttctcaccacactacctttcactccattagtttaggaactaatgtggggattctgcccactgctaagtatgtctgtgccaattatacattctagaattagagaaatgaccacagactgggtttggggacccactgaacccactgtgaggcagacctgaactgcaactccattgatcacctgacctccataagctcctacttttgctgacgagccacagtgacattttgggtctcctggaatctgtcagtacagagccagtgtccaatagtccccaaaggtctgattattttcttttccccagtgcacagttaccctggcaaaatgccataagtctttgggggaaagctaaaggaaacattatcagtacaaatttttggtgtaccagggtccttcctggaggggacctggtctcctctgctttcaaggggttttttaaactgactcatgtctggaactaattgaggggccatgattctctgtttttattattggagttagactttttgtttgcttgacctgaaagtgttctgcttatatagtaaagtaaggatttaataggcttcctatctattttatatctaggaacaccgtaattgactactcaatgccttaggtctacatgagtcagactattctgattgttgctttgcctcttctattcattacaataactacatccactttacctttgctgttgggaaccaccacttggcccctgccaccccagatccagttatccccattgcatgtaagttttcccattgagtgacacagcttctcaccataaggtcaggcctacagagaagtgcaatcacagagctcttcaaggatgctgtaactccccttacaaatctgtttctcaaagtattcgtgaaagattgatctggaccttcccagtgtaggccagtaggttttacataaaaaatccactctagcattacagtctctttaagcctctaaatcccttcctttatgttaacgaaagggagatgaggcttatccaacttgccctcagtgggtcatcttttgatctatgtttcagccaaccaaccaaacaaactgctactgcctttactaacttcctgagctgcaatgttacatgcagaatctctgcttagcgggcccatatcaataaattcagcctatcccactattccttccatcattattctacacctttagtatcaatttccatatatatcccccctttcctgcttatataaattagaaaactctatcagagtatagggcacctcctcatgggtcacactctctacatcacttttaggggcctgctgggtctcaagtctagttacagggatagaagcaaagagggatggtgggcatgagtcctgaggagaatcagcattgtctttcttggcaactgcctcaagggaggccactaaccttttccataggcaatgcacagatcatcctttcagaaagagatggaaaggccaataccactgtgggtgagaatgccactgccttggaaggtggagagaccacttccactggcaaacaagactcatggagatttaagagctcaatgttcccagcctcatcagagtcttctcacacatccccatcccaacttataggatcccattctttcccaaccaatgccctctctttaacagcagacaccctgtgaggctgggagttcaacttttgctgtaatgcagctaattgcatgacaagggcttgtgttgattttcagcaatttcagccctatatctacagcaaagaagattctaactcagggcacattcagaagctcttaggctatttatacacagctgcagctggtaaatcaaattcataagctcatccttttctttcattgcttcgtccagcaacattaggagtaaccaaccaatatcattatattccttggttttccacaaatgttcaaaatatcacatgccaagtcaccaagttccttgccttttatacatggtgaattaaaagtatcaaatgcattttctgcatgtctctgtaaacagttcacaccaggcactttgtactattagaagtagagtccttagcatttttaggtctaattggatagagagccaattccaggaaactccaaaaccaattaagaaaactcatccttaaaattctatttctctaggacgatacctggtaccaaaatctgtattagtgagggttctctgagacacagaaccaataagatagatatagatatgtaagaggagaagaattggctcacatgattatggaggctgagaaatccaagagagatcatcagtaagctgtataccgtgggctcctggtagcatggctaagttcaagtccaaaggcctgagaacccggtagaccactgatgtaagtcagcacacagccttccttcttgatacccatgccctgtagtgtctactaaagatactttcagttattcctggaagtcaggatggagaatgtttttctacaggagaccaactctgatggcagagtcacaatgtcaacccttcccggcaaaatgaattaaaattaaatttaaattgaattttaaaattaggaatgcagtgtatggccccatcctatggatgacaatatggaagaaaaagtccgaaaggaataaatggaggtcagagtatggagtgcaaggcactacagaaaaagtagagaaaagtggaagaaaaacaaggcggaaaaaggcagaagcagcataaatgcataggaagaggaaagtgagaaaacagagaacaaaggattaggaagctgataatgacaaacagacagtgagtccttcctagtgtgagtcagtcacctccaggactgcagcctaagaagtaacaagaacaatgcatctttaggaatgatagccagctcaacaagagaaatcaacagaaaagtgtaacagatgagatggagcacagggaatagagactgaaacccatttctttggctgaccagcttttgccagctctctggtcatctaagcataaaatgcagcatttgtgcaggtgcacctgtagatataatggcttaacatattgtaggttaattttgtatgattctttatgtgtaaagagtagaaaagaatgaattattttcataaaactgttaattctcataaaacaattccagcaatactaaatagtagaagaaaaaaatgagacaaagacttcatggtgaaaacaccaaaagcaattgcaacaaaagccaaaattgacaaatgggatttaattaaactaaagagcttctgcacagcaaaagaaactagcatcagagtgaacagacaacccacagaatgggagaaaatttgtgtaatgtacccatctgacaaaggtctaatatccagaatctacaaggaacttaaacaaacttacaagataaaaacaaacttcatcaaaaagtgggcaaaggatattgacagacacttctcaaaagaaaacatttatgtggccaagaaacaggataaagaagcttatcatcactgatcattagagaaatacaaatgaaaaccacaatgagataccatctcatgccagtcagaatggcgattattaaaaagtcaagaaatgatgctggcgaggctgtggagaaatgggaatgcttttacactgttggtgggaatgtagattggttcaactattgtggaggtcagtgtggcagttcctcagaaatctagaaccagaaataccatttgacccagcaatccctttactgggtatatacccaaaggaatataaattattctactataaagacacatgaacacgtacgtgtatttcagcactatttacaatagtaacgacatggaaccaacccaaatgcccatcagtgatagactggataaagaaaatgtggtacatatacaccatggaatactatgtagccataaaaaaaatgagatcatgtcctttgcagggacatggatgaagctggaagccatcatcctcagaaaactaacacaggagcagaaaactaaacaccacatgttctcacccataagtagaagttgaacaataagaacacatggacacagggaggggaaaaacacacaccagggcctgttggaggatggggggcaaggcgagggagagcattaggacaaatacctaatgcatgtggggcttaaaacctagatgacaggttgttaggtaaagcaaaccaccatggcacatgtatacctatgtaacaaacctgcacattccgtacatgtatccaggaacataaagtaaaataaaaattgtaaaaaagagaaaaaaatgagatagttaaatcccacctacttgaaataagcattgttaacacgtagtggacatcatttcagataaaacagctaaatcaatatctctctacatgtagatataggtattaacataagcatatgtgtaacatatatgtacacacacatatacatacatgcacacacaagcacatatctctctctctagacacacatacttacataaatatataccacacacacataaaagaatgcatggtggagaaatagaaagatgtgcatataacaatagaaaaatagaaaaaaaatcaatgatggatagaaagatgatagatgacagacatgcagaatggacttatattacctgctatttttaataaaaatatttcagtggagtcatattatttaagcatttatttaacttacacatgtacagtcatacactaggatagataaagaaagagagacagagaggaaaattaaaaatttatataatgtagacaatttaacttacattcacctcacacaatgagcatgaatgagatgttcatctattgttctccattcactttcaatgacagtgtaccttttacaatgcaagcatttcactgcactgaatatgggctctggtatttaaaattattctttgcataatatgacctcaaagaccacagtaggcattaagtttatccagtaatcaactgaaaaatcagcaatctcctccaaagctggagattaaattggctgtgttgagctcactcagcaagtgactttcactgccatgcactttcttatgagattttcagagaaaattttgactatatgtaatattcatattcagagatcatttgaaagcctatgtcttgagcaagatgaaatttgtcactgtacatttttaaaaacttactagaaggtactgaagagaaactgaaaacttactaaatctcaaattaatgttgatttacaagagattttatttatgaaaactttctaatatggcttggctctgtgtccccacccaaatctcacctctaattgtaatccccacgtatagagggagagacctgctgggaggtgatttgatcatgggggcagtttcgcccatgctattcttgtgatagtgagagagttcttatgagatctgatggttttaaacgtggcagtttcccctgtgctctctctatttctcctgccttcttgtgaggaaggtggttgcttccctttgccttctgccatgattataagttttctgaggcctcctgagccatgtggaactatgaatcaattcaacctcttttgcttataaattacccagtctcaggtagtatctttatagcagtgtaaaaatagactaatacagttttcaaaacaaaacacatagggttgttctgtaaactgtgcttaggattccttttcaattaacctattttatgtttagttaatatttattaatgcaatcctttgaaagacatggaaattaacacttatacttccttccaccattcctccctcaattcacactttttattagttatatgattatttcattttgccaagtcttacagcattatgatctgtcctacagacataattccccatttttgtttggtctctgttatcaaacattccaccagtactccacacatcatgacatcatcattcatctctttatgtttgtattttgtcatcaagtcagtttttcaagattggcttacagagattacaaagtttagaatgtctatgttgtaacttaccatttaaattaccaagttactgagttactggtaactattgttccattatctttaggcaccgagtagtgctattaagaagcccgggccaggtgcagtggctcacacctgtaatcctagcattttgggaggccaaggcaggtggatcacctgaggtcaggagtttgagaccagcctggccaaaatggcgaaaccccgtctctactaaaaatacaaaaaattacctgggtgtggtggcgggcacctgtaattccagctacttggaaggctgaggcaggagaatcacttgaacccaggaggcggaggttgcagtgagcagagatagcatcattgcactccagcctgggaaacaagagcgagacactgtctaaaaaaaaaaaaaaaaaaaaaaaaagaagcccaagctcaaggccaaacatatttttcccttgtacaggatttcattgtttgaccattgaaattttctttattcctaaaatttagtaatttagcttacgtatgttttactgttactatattaaggtattttttgctttctagaataaattggtatttttaatctgtaatttcatgtttttatttagttcaggaaagttgtcttttattatatttttgttaaatacttttgccccatgtctaaattaacataataggcttccaataaatattccttgaatgaataaatatgtttgaatactttttctgtttcatttattctgttctcttcttcaggaagtcaactatatttatgttgatgatgttttctctgtcttccagtttgatcaccttttataatcttttaaatatctttgtcttttccgttttgtttttgtgatttctgaagcctatccagcactcttatctttatctgtgtcttcagcatttacattattcttgttgcttctaaagtatgtttcatctctataatgattttattttcttgcagttcttccttaggttctactggcacactattaacttcctgcttatgtattatattttcttctcagaaccctttgagttctttttagagaaaacatcatgatttctttgaaaacattcaaacttatttttctgaactctactgtatgttttagggtaattctttttgtgatatattctctaggctacttccttaaaatgaaaacaataattcctctttaaatggggccaactattagctaaggaataatgtgggcaagaggatctaaggctatttacaatgtaaattgaggtttattgttgtgggcacagtttcaccaagtctgccactacctacgcggtaggcaagaagctcttgagtatatatatatatacatgttaagctaacagttttaatgagaataaaaggaaagagccatctggacaccttcatccacctcacagacatgcttgtctttaacattctttgctgataaaacaaataaaacgagattgaaatatatatagttcctgttgtagacccaacactcccagaaacagacagacctttctctgtcattttcaagtttcccataggagcaaaatcgatggaggcaacacttctgctcagtgttgttcagcatcactgtggaatatctcctcttcccaagtgaaatactgaaatggtaatgaagacagttggcaaataagaaaccaggaataaacaagggcaaaattatttaggaccaaaagatgtgtaactgaaagggatgcttgagaaaaaagggggatgactcatgctccaaattatgcaggagacagagttaagtgtataagaaattctaatattgggatttagagtttgagtatggcagcatttcaaaaccaatctgtgccactagtcagacaatcaattaagctctgattacccacattcatcctcttgctcatatttccagtacctacacagaacagccaaaagcagagcaaagattaaaatcacagctttgactgctctgctccttccccagtgcctccgcctgcaccaggacctgaggagccatggcaagggcaacatagatgcagagagggaaggcatggctgctgagatctgccagagggcaagttcgcagatggagggacctaatgctttgcccttgaagctttagtgcagctgacaatcaagtcctttctatattgtgggtagatgaacatggtttccctgctctccatactgctcctggtgagatggatcttagaccataaatagtgtcagtgaggttccttttttagagatgccatccctgccattgaaaatcactaaactggaactccacaggggtattcctcacttagtaacctgagtcctgacacagccatcgatattctacaaatccttagaattgtaggatggggctacaggtttgaggaaaatctgtatgcctctgctgtcctgttcctacttcttcaggtcgagaatacactttggggcaggaatacctcacagattgcaggctggagttgtggccattttcttgtttctttgaatataaacaggcttctctttttcctatttttcattctttttattgctttttatatgttttaagagaagaaagaggagcaaaaatgcttttacaagaacacacttaatcagaaacgctataagtgtgatttaaacatttagtgcattttgattacaattcacagtgtatgtgcagagaaagtttggtggctcagagcatggagtctcaagtcagtttaaatcctgcttctatcgctcatgagatcttgaaccagtgatttaatctctctatgtctcagtttccccatataaaaaaaagtaggtaataggatcttactgataaacttactttcagggttaaacaaaataactcattttaaacatccagcatatagtaggagcaccaaaaaaatactaccatttttataaattttccttaactgttctcttttattagaaaatgctggcttaaaaaacaatgaagtattggttgatttgccatatctacgtctaggtagacttattaatcatctaatataattagttttatatccaagtaagaaaatacagcatccttttccccagaaggaaaaatatgcaacacttccctgtagttctattccgcaaatgtatcaatgacaggtagtaccaaccctttataaaagtatggcactttataagtcgcttgcatatttattatcaattttgatgctttaataacactctgcactctgaagcagacatctattattcccattataggtagataaaaaatgaaagtgatctgtttgagatttcacagtaagggtctcaaactagaacttttctctttctgttctcatcaggacacatggaccctcataagaggaaagcagcggtgctaaggaaacaagtcatcctctgcctccctaaagtattggaggaaataaaacaccaaaacagacatggcccacatgcctctcctctttataatcatgcaacttaggaaggcttagaataagttaatagaaattttctcaaatcctacataaggaaggaagaagggagataaacaaaccctacttctgtccttaaaaagctgatagtcaattttaggctctcgcagacctgaatgatgtagtttaagaattttattttatataatctttgtggaaccaacctatagccatgcctgacattatcaattcacttcaaacttcccccggtacctgaaaaaaaaggacaaggcttgaagagatggcaagaagaggtattagaaatggcagcctacaaattgctcaatgtcaggctgtcattgggaactgagagctgtgtcactaatgggtagcagctgagactggctggggcagtgctgcacatgaggtaaaaagaatgagctttattaactggactttcctccttggactccaaaactcttgacatctagagcaggttgagtatagacctagagcaaatatgccagtcacaataattggaagagttctttaatacatgactttatgaagatgccaacaattttatgagaataactgattgaagttgtaataagatctgtgtacagttttacagttgttaacttaagcatgcagaaaatatttaagtagatttctcccaaaaagatgttctctcttgctcttccacctctgtttagtccatctacctgaattaattcatttcacagcagagaggaagttttagcttcttagctttgggtcaagaagcataattcccagattcagtttgagttgacaatagcctatcactgttaaacatcctccaaagaggccagcactttaaatgtaaaactgtccactaattgtgctcattaatgaagaagagcaactacagaacttaagagataaaaacaaaataagggttcctaataaagagagaagatggtttattactccaggcctcaagactaaaacagactttacttggccacggaagaagtagcttgggctccagagtagctctctctcagcgcagactgcagtcactggaaagaaataccagcctaagccctccccagtgtcccctgattctcagagtcctccctagctgagcaacaccatagagtcccttgcacattcacagcatcatctcagtcagtcccttcagggcccctccaacacttccagtccttctagtattctgtggaccataggctaaatcaaccactgaaaataacaagacaggctcttccagcagcagttgaggcattgcttgtggatccatcctgaagtatctatcccataatagaactttgagctgctactttgtacttgttgtgtgttattccccaggcaggcaagtgctgccctctgtgacaacttctgaaatcagcacctaggacgttactatcccacaactcctcatcattgccgcatgcattgctaccacccagtaccggttttgcaggcataaagctctctggaaaagtacaaaagttttcatcttacactaaagctgagaagcactgaaatagaattaaaaataagaattctcctttacacaaatagtggattcttggtcactctcttcaagcataatgctaacaccaggtgatatctatacagaataatgtaaaaccaacaataagtaacatttggcggtggggggggggggttactataggccaaacatgatcttaattgttttttatgtattatctgttttgatccttaaaacactcctaaacggttggtattgttatccatatgctgcagatgagaaagttaggcagagagatttaaaaaattgcccaaagtcacacagccagcaggtggttgggcaggcatccaacccaggtctgtctgacctcatgccttgggctcctacccaccatgtttaccatctcccagggcttagacaaacatcatggaataactttacaaagatattattaatgctttatatttgtgttgcattttatagtttatgaggcccttacatgttggttgtcatattttatctttccaaccccaagaagtagcctatctggtttcataaatgaaagttcttcagtgttaggtcattgagagtcaaagtaaaattgaccaatgaatcaaagcttttaataatattatcaagttaagcctcaaaaggagctcttctgaataccagaccaacattatatttttactgaaccaccatgtaaagcatgtatttttacacagaaaaagttataggaaaatttaaagctttctatttataaatgactgtttgactaacacaaggattagaaactaaatacatttccaaatgctgaataatgtgcatagttaagaaagatagtgaaattttgtcattgctttatccttggtgcctagaaaattgccagcacaaagttgttgctcaataaatgtttatggaataaatgaaagaattgcaggagtgggggatcatggtatagctgcacataatatgctgtgagcagctctttagtcatgtgacaagaaggatctgatgtgctagaggaaagtccttgaattgatcatagtctgatgcaatgggacatggcagcatggcatgttgggagttgggaggaagcttgggttttaaaatctaaaaagcagcctttgacttgctcctacaccacttcctatatgttcttgggaattgatgcaaccactcacagcctctgctttcctcagtaaaaagagaattcatttaaatcacatcacatgagtgtttatattatgagtttaatcaattatttagatgtaaggtgatgggaaaagcacagaaatttattatttgaattgtgctgccagtccattaaataagcatatgcactggagggttttttctttgttctctctctcttaaaattgtttaacattttcattttcatataaactgcttattctatagtgtatattatggtacatggttattaaaccagtctacctcagttgaatacctgaaaccctgtttacttgatggacaatttaaataattttcaagagcagttcagacgggggatgattttcatttcatataatgacactaaaacttaaactctatgtaaaataggactccactaaacaaagccattcaggaggctgagacagagaatcgcttgaacctgggaggccagggtgtagtgagccaagatcgtgccactgccctccaacctgggcaacagagcgagactctatctcaaaaaaaaaaaaagagtttatagatttggggatgaaaattaaatgaggtaatacccataaaacactgagcactgggccaatactcaagaagtactattttctccacccacctccaaaatctaatacaaagttccctctgtcaatggaaattacaagtctgagatcaaaccagtagaaatacagttcatgttcccttttctgagattcatttaggcacctttgctggaagccttctctaaaaacaactgaggaaatgagctagagactgccaataacattcaactgcttaaatgtttctattggttgaattttcatattttttatttctcttattatttcttaaactaaataaactatctcaaaaaataattcggatagatttttaaattcatggcatgatagacatcagaaaattattcaccttcaaaacttctgtctggcaatttgatacaatgtcaagataatttcagtttcttaatttctttcatatagcaatcacttaaataattgaaacaaactttctaagtcatatccttccctatttattcatagttatccaatcaattgaaatattttcctgtaacttcaactataatataataagtgctttaatcagataagtttaaagtttaatcaactcagacttctatgtctatggaaatgttttaataatctaaactaaaatcacctacaataattcactcactcctctcaatggtatttggtagttcaaggaggggcatatgccatgggattagccttcaacggctttgtattgtattaagcaaaaatcattttctttaaacacaatataaattgcattttaatatctctatagatttccatattaacaagtggaaagcacagcagatttactaaataaacttgaacagaattgcctagtgttattaataatttcacctccatattttaaagatataaatttgcttgtttaaaaaccacctgatgaaattttagtacttctattttgaaaacaggtaagttcaatggcattagggtctttgatgtcacagtaaaggtaagcatatgcacattgtttgtgttttaaaaataatccattatgttgcaaaaatgcagttggatcgtgtgtatgcgtatgtgtgtatgaaagtgatatataatgtctaaaatattactcaaaagccaaagatattatttgataggtgatatggtttggctctgtgtccccacccaaatctcaagttgaattgtaatcctcagtgttgggcgagggacctggtgggaggtgattggatcataggggtggaattcccccttgctattcttgtgacagtgagttctcacgggatctggttgtttaaaagtgtgtagcgattccccctttgctctctctcctgtcgtcatgtgaatatgtgcttgcttccccttccccttctgccatgattgtaagtttcctgaagcctcctcagctatgcctcctgtacaacctgcagaactgtaagtcaattaaacttcttttctttataaactacccagtctcaggtagttctttatagcaatgtgagaacagactaatacagtaggcaagtcattacaagtaggttaattcaggcccacagggttattggaagcaaaaatctactaagccaggaagccactcctcaaatggtttctcagttcataatgatatcaaatactgtgacttgattgatgtttttttctcattatatattccattaacacttggaaaataatcagaaaaggaataaggaaaatctgaaaatcccacttactattaaaaatgtacttattataatattttgaaagtatgaaaaagtataaaatggaaataaaaatcacctgtaatatcaatatccagagataataacttttaacagtttgatatatacacacacacatatatgtacatatacatacatatacaaggatatatacataaatttttaaattggtattaaattactatatatgtagcttcttacctgaagttcattggaaattgtttttttcatattatttatttccaaaatatgattattgatgaacataatatattactgttagtatacaagctccacgagcacagtgactaaatctgtcttgttcttataaccagtaacaagtatgccataatttatttaactacttccttaatgtttgacgttcaggtggtttccaagttttcattgccataaatgttacaatattattaatgcatgaatgttccctttctctgacattcccctttatctgacagatgtttaattttcatcttctcccaccctcgaaggggagttctgttttgcctgatgattatttgagcttttgtgatgcagattcagagggaaagaagtgaggctggagttgaagaacaagaggtatgtgggcaggactggaagataaattttctgagaattttgaaggataagatgtgggagtaactgtgtgagggaattagatgggagaattaaaaaaaattaccatggtctatgtaacctcctcactgaggttttttaacgcaagtacagaaattacagaatcaaattttggttttttgttttgttttttgtctgtcaaatatacacccttgaatattagggtagccccatttctgaaataaagaacctccaaatctcagtggcttaacatcattacagtttatttctcatgtctctttccgtccaatggtggtacaggggtggactccatgtgatgacatagagaactcagctccttccgtgtggtggatttgatatcctgcagggcctctgagccctgcactgatccttttgcaacctgccttgagatgaagaaggaaaaggagcatggaggatctgcaggagtttaatgggtcaggctagaggtggcgtacatcacttttgcccccattccattgcccagaactcagtcacatggtccccacctagctgcaaggcaaatcaagaatgtagttcattgtgttccagagatagtctctgctatcatttcctatgctatgaagtcttgataaaactgttaactcgaggtacctatgttcccttggccaaatggtagacatagggccttggtaaggctatttggaagatctttctcaggtatttgaatcttgagtacagtgacagaagaaaggaaagtatttgcagttggctcatcttgagggtaacaccctgtaaaatcctttatgtgttcctaaaacctacacccttagtgcagcctcatacttatctttcataagggctattcagcttttccttcatgtctgtgaactacccacatccttccaaataattctttttttttttgtatgttatccacaattattctttgttgcctgtaaccaaaggaacctaattaatactgaacttacagtgttttaaaattgtattcagttgttattgatatgtgtttctctgttcacaacactactctcagatgatggctttataagatttacacaaataatgtcaagataaattgatttgtacaaaaatctttaccctatttctgattattttcttaggtcaaatgcctagatcaaatgtatgtttattaaaatatagtaatactaattatgtacttcagtcaattaaatattattaatcttttcatatgatacacattccatttcagctttagaaaattgtgttttcagcattaatgtaatagcaaacagaagaaagcatacctgagcactacacaacacagtgctcatgttaaagttatatcgatgaacctaactgtgccttgaggaaatctgtacagaaattctagatacagtatgagctttcctggagagtggtgccctctgttgcaagagaaagggaggaagggaagagtgtaactagatcattagtgcaggcttctgtggcttgtttggtttccattacagtcagttcagatctgggatttagcagaggccattccttcccccttcagcgttgtttgtctcttttcctctacgtagtaacttctcagcctccataaagcaccaggccacaacagaatcagtccacattagtcagtcgggtctttatgaaattgcccatgaggtcttgttgttgcatgtagacaaattcagagagaatttggtttgtcttcttggcttaagaaataggaaatttggggatatagggattcatgatttttactgagagaaaaagcctttttttttagctttgcatatctagaacaattcatatacaataatattcagctgtgaaattgaagtagcttacattcttttaaaattcacctcaggtgtggccaacatggctgagtgttttgttgttgtcttacttgttgtgctgtttgaaaaatacatcctttaccaaaatattaccatataatgttttgaattaatatttaatgctaaaataaatatttaaagaagcacaaacacaaaattaattaaatgaagataacttacagagtaatacaaaagaaagagtatacacttttaataagaatagggtggaaaaagtcttaatttgataccaaaggcagaagaaaataaaaaagctttttaaaagacacctattaaaaagatctggtaggataattttgtgagcaaattttaaagtaaataacatttgtttacttatataaataaaattctctaatgagcctggaacaatttatagaaaaataggaatatttcaaaaatgtgtcaatacatgacactattgccaaatcttattaaacaaaaagagaactactgaccaatctcacttataaatatattgacacccaaaatcctaaacataatagtgggaaatagaattaaataagacactgaaaggattttagattgcaaaaacgtattaatcattctagactgcaaagatattatattagtaagtcaattaatatactttcttagctgccaacatttgtctatttccaaatctattcctggttttaaaaataacaaactgtgaaataggattggatatatcccacctgaatatattttttaaatgcatattgcaaatctaaggccagcactatgctcagggaagaaataatggaagtatttccattaaagtcagaaataaagatgtcttagatcatcataataatttaatatttttctgaacctcaagccaatgctattaaagaaatgaagtaagaggtatacatatttaaaggaaggatgcaaaattatttccagccaataaaattttatataatttttaaaaatttataattttctgtgaagccctggaaaacttctggaactgttaagagaataagtaaggtagctagcttcaaaataaatacacaataatatgcaatcattcttcacataccagagataatcagtaatcaagctaccacatatgcaatcataataaacaccaaaaatacaaagagcaaaaactaaaaagaaatgtgcagcgataaaaattacaacattttaccaagaaatacacaagaattgtcaaataaatgaaagacataccttgtttgtggacagaaagacttggtgttgtaaagatgtcagttctttagttctttctctaaaacagaccataacttgtatgtaatgccagtcaaaattacaacaggattattttaaaatttaacaaaaattatttttaaattcatctgcaaagatggtaacaaaaattacgaaaggactagaagagaggggtacacactttttctattagatagtaacaccttgtatttagcagtaataacaataacaatacatgaatagcattggtgcaggaaaagacaaattgccaagggacagagaatcccggaaacagacaccaatctcacatattatgagatttaatgtatgacaaatgtggcattttaaatcacagggaacagattgattactcactaaataattgaagacaacaaactagccacattaggggaaaaattaaatttcataaattccagttagattaaaattcttaataaatgtaaaaagtgaagcaaaagtatgagtaaacacttttaaaaactatagaatggaacaagtctttctaaacttgacaccaaagccagaagccatcagtgaaaatgaatttacatacaaattaaatatttctgggcaaccaaaacaaagaatcataattattatagacatttggaaaacagaagaaaagtttagtaacacacatattggacaaagaattactactgtacaaagagctcttgaaaatcaattataaaaagaaaaatggtcaaagactatgcatagttgatttaccaaagaagaaattaaagtagatcaaaaaatagagatgttcagtttcgttattttctcaaatataagtaaacaataaaaaaataaatcttttaaaaccataagattggcatcagataaatgtcaaaagcctaacactggcaaaaggaaaggaaatttggcattatcaaaaacttttgatagagtatgaatagacacaattttggcaggtcggtcaatccatatcatcatcataaatgttgctatttttgtaatccatgataaataaatcccatccaatccaacagtcttataactacaaattctccacaaagagataataacacaacagggaaaacataaatgcataaatatgcttattattttagcattcataaaagcgaaattgaaaagaaacaacaaaatctccatcactggatgattggttaaaaacatgagatactctgctaccattaaaaaataagagtgtgtgtttttttatttactgaggtagaaacataatctcagcatgttttttgtttgtttatctgtttgtttggctttgtttttgttttttgagacagagtctgtctctgtctcccaggctatggcgcatgcagtggtgcgatctctgctcacctcaacctccacctcccaggttcaagtgattctcctgccacagcctcccgagtagctgggactacaggcatgtgccaccatgccaggctaatttttgtatttttagtagaaatgcggtttcaccatgttggccaggctagtctcgaactccgacctcaagtgatccaccagagtgctgggattacaagcgtgagccaccatgcctgacctctcagcatgtttttaagtgtgaaaaaattaacctgcaatgtagcataaacttatttacaaagcattatgtccacatagctatatgtgtctatatacatttaggtatctggaagtttatctctgaatggtgagatttttgtgattttattgtcttcttagtagctttttctgcatttaattagtttgtcaatgagtatgtcgtcctaactacaaaatattagtttttcaaaataaatagccttaccaacaagatcactatttgcattgtctttgtccttccctttacataaatactaccacaccttatcaatcttgtgatatattttcttcacattttctttcaccaggatgcatcttaaaatagatggcatcggccaggcacagtggctcacgtatgtaatcctagcactttgggaggccaaggcaggcagatcacgaggtcaggagttcgagaccagcctagccaacacagtgaaaccccgtctctactaaaaataaaaagtagccgggcgtggtgtcagacgcctgtaatcccagctactcaggaggctgaggcaggagaattgcttgaacctgggaggcggaggttgcagtgagctgagatcacaccactgcactccagcctggacaacagagctagactctgtctcataaaaaaaaaaaatagatggcatctcacaatcgttgttggccagcaggatatcacgacatagttgtcattgcctgtgcatgtacaaacttggtcatggttattcatattgtcatcaattaattaatgcattattggtatggttatatgtcacctgacagggatacattctgagaaatgcaatcattaggcaattttgtcattgtgcaaacatcatcacagagcatactgaaactagatggtatagtctgctacacatcgaggctatacaggatagccattataatcttatgggaccactgtcatgtatgcggtccacccttgagttatgcaacacatgactgtacagcatttattgagtacaactggtatttaaaattactttggttactactggtacataactaattacctcaaaccttggtggcttaaaataacaacaagcagtttattatctctcatggtttctgtggaccagaaatttgggaagggtttggtcaggtggttctagttaagaaatatctcatgagctcttcaatactagctggagcaggtacagcagaagtggagcaagcaggagcagctggaaactggcaaagcatcttttgtcatgtagtttcagggcttctccatgtagtccctctggagttgggctagtctgggcttcctcacagcatggcagccatagggtggtcagacagttaacatggaggctctgggcttcagagcaagcgttccagcaagcacggtggaagttgcatcatcttttcggacctagcttcaaaagtcataccgtaccatatctgaggcattcttttggttaccagcaagacagaaactagcctggattcaagtggggagaaaccaagcctcccctcttaatgtggatatagtaaggttctagaagcatgtgtgcaacaagcgctattattgtagtcatctttggggaaaaaatatctatcacaagtgttttcaaaaatgttacaccattatttagcattgaaatgtagttattttaaatccagaaaggtactgcaagataaaaataaatccatttctttgttgaacagagctctttcaataagtgtaaaataaaaattctaagtgataagaaagcagtgtctcatagttcaatcaccagaatttattcttgcttagtagctgtaccagagatgtctttcatttccccttgcagatccacttcccacactccttgtgaggctgatggttagacaatgtggacgtgctcctgtgccctctggcttcacgttgggttggaccaatgaggaggcctggcaggagatgggagggagagggggagtaatggcagagcattggctgctcccttgctccctcctgggagcttacctgacccactcaatctgctcgacaaagctctccccttccaggtgtctgtaacatcttcctcctctcattcttttgtggtgaggtagtgacagctttttaaattctaaccccagcttcctgcacatttttttgtggttcctctacacctttgtaaataaatcccctgccggtagagaggtgcacagaacaatgccgcatcttacaagtaatggcatcttagaaaaaattaagtacagctttaaaactgactcattctctttcactttacatgttagcaagatgtgcagagactggcctgtccaaggccttcccactgtcgggaggtaggctggtggtaggcaagagctaaggggagagacatgagaaaaattccccactgtagaaggccatggctactggactcagggcaatgatgcactgtagtatcttctatgctagaattcccttgtgctaaagcacaattcttatgtgttgcagtaatatttttctcagtgttacagcctgatcttatctatggcctaagtagggcctaaacccacccttgctgtgtaacagaaatagaaaaacagcaagaagggggaactggttaccagacagcaagcagtgacctaaaaaagcagaggatgcctacatagaaacacttgagtgagctgacaagtaatgagcagagtggaataaggacatgaatgctctgcggtgtccccgacatctggggcggaaaaggtaaaagacagtacccccttctgccacatatgactcagggtgccaaaggagagaagaaggggatccctgcagactgggacgcctaggtttcctacaggtttaatcatatttaggtgaatgtatttcttgaatgctcttgtgcatgagcccattcttagccaggtatatgcattttagtggtgggagcaagctagaacttcccaaatcaccttgaaatctgcttcacagttagcaatttaatactcccagatacaccagacattcattgcattgaaaaccaggcatattcttttcaaataggattggaagaagggacattttcctactttcatctgattcttttgaaagttaccagaaaagagtatccagactctgattggttgtgggaagttgctttataaaaagtcggttaacttttttgaataaaaccattatctcatagatgactgataagctaacttcaacaaaaatgaactgtattttttctaatataataattctaattattaaaattcatcaagtaaaaaaatgcactgatcaccaaaattaattaattaattaaatggatcctgaggaaagccagagctttgtcacaccatgcacagtttatggtgatagaactcttgcaactttctccttctctactctctcctatttgccagattataaacatttcttctacatgcaaagatcctctgactccccaattgtagttgatacttatcttcttttacctggatatttatggtgtctcctaaagataagctatgatgttgtattttgccaaaggtgttcacctcccttgaatgtgaatttctccagcataattctttagtatttcaaacgcaaatgagagttatctgaaaaataatctgcaagacacctcccctcattctgaggctttcctcttttcatgtgttaatggattgatacatttgttgtggaaggtaaggaaatagatgtttcttcatactactcggcccccacctaaaatcatgagggtctccaaaactccacctacctacggcagcaaccctggataaatattaccaggagtctcaattgtccacatgtgcaatgtttgatgtatacactttatatcataattaataggtacataagtataaaatgttacacaatacagtcagtgaagcaaaacgttcactcttaaaattcaaactttgagatattagaaatgggaaaactgaacgagcttttgccatgtttctttcagtacaagttctctattacgcagaattattttagttgctggtgtcagaaacccaattctgtggtttgcagaagaattttctttataaaattgaagttttaagggacgtcagtgtttatgccatttttccagttccaaaatgattccattccattctagaaatttgaagtatgtaacctgaaatccttaataaaatttggatttaattttataaaatgtaaaaaaaaaaaaaaaaaaaaaacgaaatctactcgcttgtaaaactgggaaaggtcaggggtaatgtgggcctcaggcaccatgaattaaatgaacaactatggtgttatttgaattcattcacctcctgactgtttttctctgcagggcagctgacaacctcggcaaggcagaagtcaccatgaaagcttccttttctcaagtatttaccattcaaaactttagggaaattcattaacataaattggcaatgatattagatgatttaattttgaaggcaaataaaaggtttttggaggatactgttgcattgctgctaggaatataaattggtctaaccactttgtaaaactattaggcagtatttactaaagcaaaatatacatgtggtctatggcccagcaattccacttctgggtatgttcccaaaagaactgaatgcttgtgtttataaaaagatatgtgcaagaatagtcatagcagcattatacataacagtctccaaatggaaacgaaccaattatctactaataataaaatgaataaattgtgttatatccatacaatagaatacatacaattttgaaaagaaacagctagtcctacacacagcgagatgaatggatctcataaacattgacaaactagacaccagagaatacatattatattattctatttatacaaagttcaaaaacaaggaaaactaacttatgataagaggtcagaatattagttacctttgcagttattgagtggtgaaggtataagtgatctgctagggtgctggaaatgctcaataataaggaagtggtagttatatggatatgtaaaacttcaccaaactttgatgttcttcattgaatataaaatatacctcaccagaaagtttaaagaaaggagaaaaaaaaaggtccttagagcaataaaaaaaatacctatgcctgatacgcgattgtcttctgggcatacacatagtactcatctgagtacccatccaattattaaaaaaaattcctaagaagtgacatttaatgtaacttgtatataaaatatttgactttaaatacctaataaatgtttgaacattcatatattttactttattatattcttatttcttctttacaatctgtcttagagttctaataattataattttgagagcctgtttctactgtcagtttttccttctggttcttacttatttccttatgtgtttatttgtttactaggtactgataatgtccttgaaacaatattaatgggaatcctttgaagactagacttctccaaagaggatttatgtctgatagcttcaggtgcctggaagtatcagcaatacactctgacccacctccaaccaaattcagaagcttggggtcccatagaccacctagacaatgtaaaccaagcctgcaaatctgttttagaacagactatggctccaacttctcaggaaagtttttttccccctttttcttccctccaaccaactcaagacaaccctatccaaagataccaaagggtggaaatgggaattgagtattagggaggctgaagtgggtttagttgtatttagttttttctcacactgctaataatataaagaactgcctgagctgggtaatttataaaggaaagaggtttaattcacttacagttctacatggttggggagccctcaggaaacttacaatcatggcagaaggggaagcaaacccatccttcttcacaaggtggcaggagagagaagagtgaggagtgaagggagaagagcccttataaaaccatcagatctcatgcgaactcactatcacaagaacagcatgggggaaactgcccccatgatccaatcatctcccaccagatctctccctagatacttagggattacaattcggatgagatttgcgtggggacacagagtcaaaccatatcagttgtggacttttaccctggggatatctctgctctttaaggtctgatcttaatttggggagtctcctatttgactcttcttcttgggagatcccttcatttctgtacttgaagcccaacagaagtgaaccccagctgccccttacaggcagttccctcagaacagaaacagctttaggctctgcttacttctatgggttcgtttccctctctgtttctttattatgttgtcaggtgctctcaaggtatttttctattttaattttatccagctattttatttctttttactagaatcgttggtctgaataacatagcccacaaattatacttgaatctttcatttattcttatcaactttggtatttttctgatacaaaaagaatttccaaaattagatcacatttcatgattctaaactcataaaatagaaggatccttcttattataacgaaaagaacataactcttccaattatcatggaatttcagaataaagccccaaaccaaagacaagaggtgactgtttcctccacattctgaagaggaactgtggatccaccagacacctcccctcaagccttggtgagaattaactggttctttgaccctgcaagcccctccattcccatcctacctagcccttctaggcaaaataccaagtatgttttaagagggtcagggtggtactgacttccaggccttaggggcaagaattttggattttgtcctctctgctcatgaagaaagaaagtgctctcccttccagaccaaatgacagaggctcctagagaaattttaagaaactggaggttctagcaataaggtaccccagcaggatgagagtgagctgcagaagcttagggtggatccaaatagggtgttgtgagagaatttgagagagccttacatgagttccctggagtgcagagatcaacctgaatatagagaccagtgcctgcctctggcctaagtcagagcttctcacactttaaggtgcacatgaatcacctggggatcatggtaaaaagcagattctaattcagtggggcatgggtggagcctgaggttcttttgtatttctagtaaggttccacatgatgctgctggtccctagaccacactttaagtagccgtggcctacagaattctgaaagtgggaggctggctagaacaatcctccaaagcaaggtggaagaaataacagtagtgcccagtgaggagccacacttctagctcttggcatggccaagatgtgtggcattgcccttgtgcaaaatataggtcacagaagtaggtaggcttgagctggcttgaatgtgacacccagaaggatggcctgtaagaaacagaatcccagtagtaggaggtcatggagcttagggggtcttggaagaagttatctggagagcacagaacccacatcagaatggatttatgtccaattgaaccaaaacataacccacaaaacgtcagcccgaagacacctgccatatcaaagaacaacaataacgccagctaactaaaaatacttctgttccttttcctcatgtgttccatttcctctcatcttccctcctcttccaaccagggaaaaaagtgaaagggtgggatgtgtgaaacaagagaccacactgtctttcgcacgaaagctccctgagttaaagacctcaggttagggctgagcttcagaaaaaggacttaaactggctttggcactgaagctttcatctgtatcataatggactttttaatactttattctttatcattgaaaggacattttcttatccctgaaagtgaccagaaagttttgggctttgcccacgttggtgtttagggaccaggaaaagggatctgatgaccaaagagaaaagaatggtgagaagaaaatcctggacatagctgtatccttcatgaggttcagcccattccataaaccaattctataatacttcattggctcaatttataaccattgccttagccaatttgctcataaatcaaggattacctgtatttcaaataatcactgaatacctcaagagggaagcttctttctaaataatttcaggtttaaaagaatcagttcaaccattgtggaagtcagtgtggcgattcctcagggatctagaactagaaataccatttgacccagccattccattactgggtatatacccaaaggactataaatcatgctgctataaagacacatgcacacatatgtttattgcggcactattcacaatagcaaagacttggaaccaacccaaatgtccaacaatgatagactggattaagaaaatgtggcacatatacaccatggaatactatgcagccataaaaaaggatgagttcatgtcctttgtagggacatggatgaaattggaaatagtcattctcagtaaactatcacaaggacaaaaaccaaacactgcatgttctcacttataggtgggaattgaacaatgagaacacatggacacaggaaggggaacatcacactctggggactgttgtggggtggggggaggggggagggatagcattaggagatatacctgatgctaaatgacgagttaatgggtgcagcacaccagcatggcacatgtatacatatgtaactaacctgcacattgtgcacatgtaccctaaaacttaaagtataataataataaaataaaaaaaagaatcagatcttattaaaccaatcaacatgaccctaggtttttagtaaagtgatcaattgcttttattttatattttttattcctttgtatcaagtcacctataaatctaggcatgtaaaaatatgtagttctcttcatgttgtcagaagtgtccagatggtttgacgccttacatggaaagaaaatcagcagttaacttctaaagagggaaccctctgggagcagatcaaaaataagaatgttgtgttaaggggaatatttttggctaaggactagattgagaattagaagagtaaaagaaatttaaaggtgttttccccaaaataagctgcaaaggccaacatcctataaaaactagttccttacattacaaatatgtacattaatcaattgaaaaatgggtgaagatatgagcaggcagttcacagaagaggaactcactagcaatcaggggagtgcaaacttaaaaacacaaagcgatagcattttacactctttggacacgcaaaaacctaaaagttgacaatacaaaatgtttgagaaaatacggaaataagagaattcccatatactgttgtgggagtgcaaagtaaggcaaccacttaaaatttggcaaaaaatctaggtaaggatatacacaccctcctacataacaactccactttcagcatactgttgggcatctaagctttttacacatgtactccataaaataattttggaaaattacgcagtcacttgaaaatgtttaaattgagatgtaatttttaataataaatttaaatacttgcaaaatatataattttgaaattgttataaatactgacatttacaaaataaaactgtgatgccattctttcaaaagtggtatcagataaccattaccatctatttttttttaaaatacacaagcagtttttctttaacatttggaaaaatttaccttgtttccttttttgttttgacttgtatttccattccactttattactgaagtttatagtaacatttttatgcttgaatatcttttattgaccactgtaacatattgttacagaaatgtgtatataacgaaaaactgaaaaagtatttttcttatagctttaagatggtgaggattaaaacatttttcttgatttaaaaaattattaccactttaagtggtaatttaaatattagcaattcctctttaattactactaaattactgttgatcaaaagctaaatgtattacaaagtttcataagtaattattaaatgtaaaattttatcaagaatgcatcttttaattaatgagaatttttcattcatttagtttatatatccagagatgaacattgtttactgctaaaatgaaaccgggttcaccgtaaattcatagcaaaataaacagaaggaggctaccagtagtacaaggcttaccaacagtatattaatgatgaagtgtattttttacagtaaaatccatgacatatacctgttatgtaaatttaataagtacatgataagaatgaacaaatgagtgaagaattggttgatggataacagttagcagggacattgagtccaaataaaaagtgtatatagatttatagtatccaataattttgtcaaagggaatggaaatctttctcagcctgaataaatgtttaagaaaatataaaacactaatttatttttaacctaagtttactttacttaaaagtgtaatattgatctacaggagacaaacatggacgttcttacctcctcccttctcaaacttgcaaataatgcaggtgagcccagtaaatagaagcagtcaccaaagtctttctcctttctcagaatgagaaatccgggctgtgcttctcaacacactggtgtttcccagattgccttttgcaactcctgaatattcttacatgggtaaataccaaaactttgtcatgagttcactgtcccagtgaaatacaacaccaacaccctctgtatttcttacctgttttgctctcacaggactccccactcaggagtgatgtgtactttaacaatcaggagaagtaatagaagagatcattaaacaaaaattgtcctgccaacccactctacaatatatctgaattcagatcattccttcatgggtcaaaagaccatttctaattccactagctttgccagatttaacaaactcacacacacatacaaatgtacatgatgcccagttaaattaaaatttcagtaaatgacaaataattttctaatataagtatgggagaaaaagatggcgaataaggaagtgggaacttgcatgtggctctcaggctgtcaatattaggatctgaaaaccgattcctttaacaaccattcatactgaaaaagcctctgtttgtgtgtgcatgcacatgtataggtaggtgctctcatgtgtgtttttgagtgcatgcatgtgagtgtatgttggtaggggggcgttggttcagtgcatttaccctaatttgaagaccaatgtcctgggaggggcagggctccccagcaggtctgcattaaatggggacatgggttgtgatttatgccacaagatactgacctccttagcccttagggcagccgtggcttagaggcacagtaacatctggcagggcaatccaagggaaaaaggttgggaagccccatatggaagctattctcactaatgtgcaaggtgacacaaccataaatgctcacagcagcattctttataattccaaaaaaaaatctggaaataaaatgtccacgagagggaaaatggatgaatgaattgcagtgtattcaattaaccaaatattatcgtaaatgaaaattgatgaactttatctacatctcccaatataaagagatctcaaaatcctagcattgagaaaaaagcaggttgcaagagaatgcacgcaatatggcagtgtgtgtaatatttacacagttatataaggttttgaaagacaaaaatattgtatattaaaagcatttaagcatggattagaaggatgcacagtaacttcagagaagtgcctgccactgaaggaagaagggagattgagaaggaggagtaaacactggcagcacacatccttcagacatcagggcatcaggttttgttctcagttctttacatttttattcacttaatcctctcaacaactctatgaggtactggatagtattatctccattttgcagatgaagtatctgaagcccagaaacagggagattagaaaatttatccaaggtcacacagctttcataaagggcacaaaatgagttataaactgtacatttaaatttttcttttattaaaataatttgaagtaaatatgataaaatgataatgcaacagatgaatgggtcttagacacttcacctgttgccatttgtttgaaatattaaatttaaaactctgcttctttcatgagttcacatttgtctaataagatcattctaaaattctggttatggtttctttaaaaaatatacatcttttccttaacggtcctcactaatagcagacaaattaaatatattagtatcctttttaatgtttgctatggtgaaatggaaataaaaacattttatctgtctttattagacaattttgctgtaaaactgcatcccacactagaattcatgttataatatttaagaagtgtttcttgtccaaaaaatttgtactctgcatgatccaaatggatggatggaaattaggccaaattttcccttaattgattgaattaagtaaggtttttttacagagaaattaaatgccaatatgtaaaagcttgctgcaattaaaattttaagatccaagagaataagtaatttgaagagtaatctctgatttatgtgctcagaaaaaatttcaggtgttaattttatctccacactcaaaatatattctaatatttcatacaaagttgttgatgaggaaattgattgtcactagaattgctctctggggctggggagagccgccgaagttgccccacagaagcagatctccacaaagaccaggagctggaggcaactggtgaatacttcctgacaaatctcagctgttacctaattaccttcatttgttttgctttaaaaatatagggaattccctcagttctctgctctaatgttggcagaaaacagacctggcctaagtcatgtagatcagtttgggtaacagcaggcttccagcttctggggcccctgggaggtctgtaattaaacaactctaggatttacagaatcctagtcaaggaggcacacactttgagctgctttctccacaaccaacttgtcccattgtgagaagtttccatcaatactctttgggttcagacactgatcaaagaagttgcttgcctcaatgtaacgatatgccatgtaagaagaggatattgcacctgaacggattcgggtatttgattaattggcagttaagagacagcagaagacagaatggaacacagggcagatacgttttaatgaggaaagtatagaaaggtacacactatagggcaatagaagttagggcaggttattagggttttccagagaaacagaaccaatatatgagaagggaagagattgagagatttattttgaggcactggctcacatgattgtgaaagctaagaaatcccatgatctgcaatttgcaggcaggagacccaggaaatccagtggtgtagtacagtaggagaccaaaggcctaagaactggtgtgctgactgtccctgtcccagggcaggagaaacagtcagacacaaagcaaattttcccttcctccaccttttcgctctattcaggccccaacagattggatgattctcacccatacagaaatgggcaatccgctttaatgagtgaactgattgaaatgctaaccttacccagacacaccccatagacacatccggaaataatgtttagacaaatatatgggtaccccatgatccaatgaagatgatacataaaaggaactatcacaggcaggctgcaaaagaatgcataaccaggaaaaaccatcaggatacccaggaaattgaaaacctcaagaataggatgaggaggcaggaatcataatctttgtgcccttcacaatgatctagtatttgaccctgaacttgaggactctgtcatacttagtataataaagaagatatttgaacaccctagagtgagtctcctcagagttcagttgcagatttccaggtccacgaaaccagtcatcaaccactgagatgtattttgcaggaaggaagaatataatgaaaagtacaggctgggcatggtggctcacacctgcaatctcagtactttgggaggctgaagtgaaaggattgcttgaggccaggagtttgagaccaacctaggcaacgtggtgagacccaccccccatctctacaaaaatatttttaaaatattttaaataataaaaaatcataacaatgaaaagtacaagtcagctgagctcaatttttctacttacaagttaatgtcatgagctcctttagcctcagttccttcacccataaaatagagataacagtgtttaggattgttgtgaagactaacagaatgactgatgagtaataaacaattaaatgtgagatgctatcattgacatgatacacacacacacacacacacacataaaatggtaaaagtgtacaccttggccaatgtcaacagcttgcactcaatggctaatattcaacacatattttataaagatcttatctttgttttgttgacaaacatttgatcagcttcttggctataaggaatgtgatgtattgattctcatttgaccctgtgctggtgccaatattaattaattataagaggggttgattgatgaatacaaaaatacagttatatagtagaaataagatctagtgtttggtagcacaatagggtgactacaattaataattgtacatttcaaaataactagatgttattttgactagtcataacccgtcaccattggcctagtgaaaacttcccctccctttgtgaactgttgatcacacaaaacctaattgtcgacaccagagtaatataaataagttcccacaccccaatttttcagatgttttcttgaaactagccaatccacaatccccttgggaaagcctaagggacaaccatggaccttgataaggacaaagtccacaggtcctctctctgtctagctccccaactgctggttgagctccctgtgacctccagacttaccatgggcctcctgtcggcacccctaattctctgggtcctgtaataatttcttgcttcatgcattttggtttcacctcctcattgtgcctcacttgaccaacacactccaacctaactttcccctggtcaggtctcttctagagagtggctatcttggctgatggccactctcaagagaggccttaagaccaaatgagaaagaaaccataacaatagatgtcacttaaacatctatatgtctttaaatatcatatttgtaaactatctaaggtgatctgtggattattttcctctgcaagcttcctggatttttggtgccaacagtaagtactgagcactaaagggtatgtaagagagagcttgtgaacaaatggtgcatttctttggcaagattctataaccatatactaatgatttggatattatttcacactgagcatgcttttcctcactaacagcacacagaactggctaggtaattcagtctgccagcacgttgggaaaagcagtttttaacgtatggatcccagaccacctgtaccagaatcatgtgctaggctgctgaaaagccctcttcactctgcatcacctcacccccacccctgcaccagacacaacatacaagagtctcttgaagtggggcccaggaatctgcatgtttaacaagctccttggataattcttactcagagtgaagtttgaaaactgggcttaagatataaaatgatgtgattacttgatagtaacctctcaatatcacaaccttttgccttcaaactgttggggacattttgtcaaaatgtagtccttaagaaaaatttcattaatatgatcattctaaaaatcaaatacctttcaaagcattcagatcagcattatggatacaagttaattgtagataactaaagaggaaaaacataggaagaaaaagtttcagttgttcgcaggctctgcttcctgactgtttcagagcacatactgaagcaggcagcttctctgcgtcagtactccaggtgtagttctcaggcacaaggggttccttgtgggtcttcacccttcttgtcaggatgctctccctatactgcagtcatcacagtgagccttgcaacttagcgtcatgcacatgcaatgatcatgctacagtaatttctcatctaggtaactgctaggttttccctacttcagtaactgctcactttcagtgaacaatggtcacttttgttgttgttttttcttcgttatatttgttctgaatatatttattgaaatgtagttttatgtcttttaaatcttttgcatgtttttgcacttcattttttttgcctcaacatacttcaacaagattttttgcctcaatgcatttttcttataactcatttttattaatacctatgtaacagattttaaaaattatttcttcaccaaatattgtgtagagcaaagcactgctccataccatacttctttaaatgaattcagacaaaacacagctctagtgttttagtattttctcacctgcaaaagagtagagagttgtattagatcatccataagattctccagctctgtgattgtctgtggatatggttatagctcatttttcctacaactgattcatgtactttgtgaattatgcataacaaacttttatatgtacagccgactttctgctgcctctcatcatagctttgaaccacttctcctactgtgagattgtgtgggtttaaagaataaagagcattttaataatagcccaatcaaaatgtaattagaaaaaggtaatttggtaccaaaaatattacctaataccacatcaaagataaattccagatatttcttatcatctgctattttagattaccattttccccctccactagtacaggtataattctttcatcttggcttttttaatgtaccaaagactaaacagactgttagctgcaaatctacttctgatacttgtcaccctctctcactttgtttcatatcagccacagtaaattttattttacatttttattgatgaccacatcatatctgttaacatgtactgcataagcaggttttctttaaaaaaaaatgtatttaacccagcagcaacttaaaaaacaaagtattttaaattaagacattatattcctttttcagagaacatgtagacaaaacaagtctaaagggtgatccaattaaataaatttctgtctctgggggctaggacctctgagttggttctcaaagtctgcatgtttcacattcagtacctaacaagatattcctcactgtaagcttaaagtaagcaatgacatcacaatatgcattactctgagttgttttcaaaacgtgctgaccctctgaaagtttccaaatggcttctttgtgtgctgttacagaccatctggctagctgtagataaacaagtttcaacatatgggccatagcacatacatggctctgctccactagcgcagaaaattaagaaagggatgctctcatgatatgagtagctaactcatgcaagagaagcaggaccatgtagtggagggcctgacctaagtggcacacagaatagcttaattccagtttcttctcttccactcactgggcatgtcgctggatcacagcaagtcttctttgtttcctcatataaacatttttaaaaagtgccagtgaactcttgcctctctctccttccctccctccttctcattaaaacatacccattgttggcctaccatatatatgttcccagcatggtgctaggtaatgggcatattgttgagaaaaacagacatggcccctacccttgaagatttactggatgataatgaaggcatacatcaaataaatgagatcaggaggaatatcacaaaccaagagggaaagcatgtgtgaaggtcctgagatcagaaggagcatgaacaatttttcaagactccagtatttagcaacatttatagccattaaattgaaaactaaattgacaatgaaaatgctgaaagggaaattcccactatctccagatggtaattcaattattatattagcataaactatttgaaaaaattacctgcattttccattcatatttttgacccactgcctgcaatcaatgaacctaataaaactatatgaaaatatgatcatcaaatacatgcacaagcatatcaagtccatgacaacataatcaatgctttcagttatgaaacagttgctagaaaatcgaggaactctgagtgtctcctgtttaatatttacagaataaaactaaaagctaaggcaacagtgattcagttatctcttacaagtaagtgctttacttctcaagcatggtttcccagtactcagccttgccagaaaatgacagctgataccatagagtgagaagaggaatagtccttcttgcttgaacagtcattatatataaaatgttcatttcaatgattttcccaattcttagttaaaacaaaagctgtgtctttggcacaaattatgtcatatgtgaaactgtattaatgatttatttttctcatcccctttcgatttctaccttttccttttatttgctgctgtatatttaaagtacagtctacacatgaagctcagcctctatagccagaatgaagcagagaggtcaatagtcgggcattcaagtcaggcaggataaggagccaatatgaatcatgaaggtcttaataaaaaattaaacaacacatttgaaaacctgaatcaatccaactaaccatagtgccctgtcttacactacaggaaagaaaaagtcactccctaaaacctgttacagcacttactatactatattgtgacaaatcgagacatgtttgccttctacctgatggcaaactcttaaaagcaaggactgtgccatacccatctttgtccccttgatgccagcaatgctaatgtgccaggagcccaaacaatgctcattaatcagatcaagtaatgaacagtcattgttttataaaaataaagtcactaagtgaatgaatccacagtgaaatggaattgaaaccagagctgtcttagctacctgttaggattttagcaaacacgtaaaatgtctgcccttcagccattctacagacagcaacatgtatgacataagacctttaattaaaaattgttacttacgttgctttatttcagctacaaataaactttatttgatgtaatgtaataaaacattttcaagtttaacaatatgtatctgaccataaataatcatttaaattatgaatataatatatacggtcacttcagcaaatttgcggttcaggaatttgtacaagctttgtctgaaaggacagtgccctcctcccctttcaggaaaggtagcttttccccatgtctggtaagaagcaatgtcaatgggagttagaagaagtccataatccatgtcagaattccactttatcctgtgagaggacagcttgctttattgtaggaaaataatattctctttcagttcactcttatcaaataaagaattgcattcatttttccccttgtaggtacaggtactcttctattctcatctactgtctttctgtctccttagctcttaattactacatagtgccatttaaaaaatatatatctgcaaagagaccttttctgtttcctcacctgcctttcatgtctaccattttttggtgggtaggggtgggaatcagaggacagaattgcttaggcacacatttgatttaagatacatagaacacaaaaacaaattctctagaaggaacagactggtgttctgaagcatttcccaagagtggtccaggtgacctcgcttcacacaatttggtttaacacaatgcagctcaacaagaatgaacatgtttatgccccatctccagaagcatcacatttcatggaaaacccatcattcccacacttcttccacataacatacagttatgggccagcccatgggtgggcccactgcagccttgtagaaaatgagagtcaaaaacatgccaataatcatgttaattacaacgcagttgggtaccacttgagcttcactgcgataaaaatcctcacagaaggcatcccactcccctctcaagacccttcagagcacgagaaaaagctttgctcatgttgtatgcttctctccatcctgagacctgttcctgagttataccataataagtgagttaacacagaaaagtacataggtggggaaatcacagagaccctgcagaaaagccaaactatttgacagaagcttgaaacaaacactgctctgggaaatcatttgtattagctgatgactggattctgttttctaacatggacatgcaacatattcaacactacgctcaccgcagtttgcttggaaaagccttctgtcatacaacaaaatacattctgtctcatgaatgattcctgcatattcaccacaacgcctagactcagaagcatgggaagtgtgcactggaactttctcccacttgcatggatttggacatatgcaaagcaccagaaactgcttcctttctggaactcagttctgttggtgtgcttactgctgagatgatctgctatcttaaactgagaacacacaatagcactgatccacagaaaaaaggagaagtcaccatctccctcataagatagtgtgtacaacagatcaccctgtttgtcatgttttagacatcccaagaaaggacagaagctgcattccattctgcagactcagcaaatgacttccttctgtttccacctctattttgccttgtttatttcatctccattgttctgctttcaatcatgaatcatgacctttttttctacagtagtcagcattttgtctaaaaaaaagagagagaaaaatagaaaataatttagtagaactgtaaatgtgagttttcattttgtggtaggtggacttaatttttacagcagtcagtaatttgaatcatttgtggcttttaagggattatgagtatccttcaagggaaagaaaaagtgttgtgactcttttcataaatttcataacttccacaagttgccaaggctttaatatatttgcaaatcagccccaaataacccatttagaaattcacctttttaatacagctatagcaaaaaatgactttgctctcaaaaatccttgcaaaatactattgcacctgccccacttgaaaagaataatgactaaataatgattaccaatgagacgtgctctctccctcaaacctaggaaggtgtgttattgtaaggtatgtgtgtagggaccaagaaacttcacttctctccctcgttcctagatgctcagaagtggcattagtgatagagaagtgtcagccaagggctgagaaaaagtccctttctcctggtgtaaagccactcccctgactctgcacctccacaggcctcaacttaccacactacatcatgtgcctaagagctaggtctatgaggacccagagactgggactgtgcccctaatctccacctacccaccccatctaaagcaccccctaccctgccatttggctgtcttgcctgcagtcctgctcttccttctttgaggtccccctctcagcccagcccttcagatgggtgatcaatagatggattttgctggagacatggtttctagcttttcccctcagcctcacacaataacacctgaggacaagtactgcacttcagcccagactcagcactctaggctccacgtatctgaagaggggactggcaaccatctgtgctccacagacacattcctagcccagggccactgtctcttcccagcacaggagagacagtgctttctccagctcagcacggctctgctcacatagttcatgttctgaattcctccagaccacagcactatctccaaagtctccctttccttgctacccacctgctaaccaattgtgatggtctggagattgtagcacccacacagataccggtggcctcttttctggtctcaacagcaccctccttgtgcaggccctcctgcaatttatggcaattcaaagcaaatccataagtaaatcaaattttaaaagaaaaaaagaatccttgattatatttcattatcatatttggttttatattaccaatctgtgaatacttgtgaaaaggattaaaattgatagcagtaaattaaaattaccagtgcaaaagtattcacagcttttcctccatctattcacttcattaccccagggaaaattttcgagtgcctgatgaactcctgaggttctggttatgctgatcaagaaaatggggagaaatgggtaaatatttgggagtaggaacagtcttacaggtttgtacaggaaagaaagaaactattatgtaggagaatacgtagagccaagaaggcagagcaaggcgaaaaggtaagagagactagaagcccagaagctagatgggaggaaaagagctggagaaagccctgagtctggaggagtccagaatctgcacggtggccacaagatgagtgagagctagagagaggcagggggagcaaagggttctgattacaagtctcctactagccaccaccacctctgcagccaccccagcacactagattaaaagcttccagagacttcaactgtcccttactcatctttctaccctaccatgcctggttccatgctttgtacatagcagaccctcaaatgtttctgggaaaaacaagccaatgaagagactccttacatccattttctacatttggagttatccacacagtgctactgcatcagtcttgaccattttgatgactccattcccctacttgcagattcactgatcctacttgcagattcactgatggcttactactacagagtgtcccacatttagcattaaggattaggtacttctttgttggggggtgggcggggggttgctggcctgtatactgtaaaatccttaagagcagccctggcctctacccagtagatgccagtagtgtgccacccagacttgtgacaaccaaaaatccctccagaaatggccaaatggctacagagagttgggatgggaggcaaaattactcctgattaagaaccatttgtcaatattaaaagtccaaattcttggagctagcatagaagagcctttataatttcatctcaatctacttttctgctttgatctctaacagttcctgcacccaaatgcttagcttcagccagatggtcctttgtataagctcccacattggtgcctttacaaaaaaagtcctcttcacctagaataccatttctgctctcctttcactataaatgctttgaccaacttcatagacatgcttgagttcatatccttcaggaagtcttctctgattagggttagtgtaagctctgagttattttcctttcctttgaatcccatagtttttcctgtctccacctttccttattacagaaaggttgccatgtgcatatgtcttagcctagccaggctgctataacaaaatcccataaattggtagcttataaacaacagaaatttatttcttatagtttgagaggctgagaaatccaagattaagccaccaatagattccatgtctggtgagggctcgctgtctgcttcatagatggtaacttctagctgcttccttacatggtagaaggtatgaacaagctccctcaggcctcttttataagggcaataatcccattcatgagggccctgcccccatgacctaattacctcctaaagaatccacattttcatagtattgcattgggaatttggtttcaaaatatgaattttgcaggagacacaaacattcaggccatagcaacatatgtctgtttgtgtaaggtatatccaacaaaattatgtgcataaggacatgaaagatatcatctgttttctgtatcttcctcaatgcatggcagccatattagaaatttcctaaagttgatggatatttttaggctaatcgtccttaatgaagtagatattctgtaattataaattcaaactgagagaaatgcaaagaagatacagcagactatggcctgttggccaaatacaactggcagcccctttttgtaaataaagttttattggtacacgggcctatctgtttacttatgtcagtgacaaattactcatcagtgagatgagtagtttcaatagagaccatatggctagcaaagcttaaaatatttaccacttggcccttcacagttaaagtttgctgacctctgtcttaagcttacaggaaaacaacacccaagcctccagactagctaaagatacaaaggcaaatatctttagactttatgttagctgatttatttttataaaaggcacagtagcatagaagttaaaagcacttttgaacacagatgtcctgggctcaaatccagctctatcactctctatatgactgtgggggaaatcatttgacttctccacgcccttgttttgttattttcagaatggaaatgaagaaaactaacctatcataaacttttgaggattaattgatcaaattcacataaagtgctcagcaaagtgtctgagagtgaatcctcagcaaacgcatgttattattttaaactggaaaacctttttgtgctacattttaaagattaccattttatgatctatctgaattatctatgaatcattaactaaaataatcaataaaatgattctcaagttttttgaccctatggatgcatgcaaatatagcagtgtttccttgctcatgactttatctgttctttcctactttatacactggctgcttaactggatcccctgccacccatctttcccttgtctgccctcctcactattgccagagagaccttcccatgttactcctgagaactaaaaccaacacgctttccttttcctgtgctaaaaaatgctgcagccaggcaaaataacctagctatttgttctaggaaatagtcactttcagaagactatatgccaacaaaaatagcctacttatcaagactagtttgctcattaacactcacttcacagccctcatctagctgtacttaccagtctaaagctattatgtcataaactctgcctaatcctcaccagttccctaccttcaaatcacccagcccaagccccaaaaccctatcaatatccttgccttatttccttcatctgagaaactactaagactgtctaggagtggataccactcgtagtgcagtaagtctaataaactttacttacttagagtaacaattcattctcattgtcttcttagagagcttatggctagtctccagctcaaaaatattctgagactcttcactgcctatatactgaagtcacttgacaagtataactgcataacattcaatacaagcatcggggtgattcatatcacagctaccacttagggactgtgtgaacataggtcagttacttttgttcctgagccttaagttgttcttctgaaaagtggggatgctagaagcacctattttgcaggtagcatgctgcatagcatgtagcgggtgttcaataatggttagcagttattacttttatttatcatctattatgtgtcaagcactgtactagattctgcagaaagaaatctgattaagacattgttccttctctgaaggaattcaaaatcctaatggtcagttcaacgaactcttataggcatagtaagatctctgggtttgcttacagtacatgttctagaacttaaaattacattttttaatgctactttttatattgtgaacaatctcgtgtacaaaagagtatatagaagtaaacatgaatgcctgtgaagctacactcagcttaagaattagcatagctgtagtcttccaactttcagttgtaagataaaggcagtccagtataagaaaaatgagtagcactgggattcagatgatgtggaatctagacttagttgtgacactagctaagtgtgagacatctcacttttcaactcccagttagctcttctgttgaaagacaggggtggacaagatgaccaggaaggtccctctctgctagagtggtccctggttctctagtctactcctccctgccaggctcagtgaagaacgacacctccaacactaatctgctcattctctcaccagaaccttccaatttttcattccaagtttatttttcccctgactttcaaacgtgaagaaatctcctctacctcacatttaaaacaaagtcttcatcagacatgttgacacctctaactagtatactatctctttccttctttacaatgccaaatttttaacatgtgggtcacttctgaaatttccatttctctatcaccatcagatcctttttcagatcccaagaacctattgtaattgcttccttgaaagtcactaagacttcttagaccaattcttggttctcacctgccaagatgggcaggaacatttcctaaaagctcctgtggctctttttcttttattttttagaggcgagtcttgctctgtcaaccaggttggagtggcatgatcatagctcactgcataatccaacccctgggctcaagctatcctcctgcctcagcctcccaagtggctaggattacagaggcgctccaccatgtccggctcttgtagcttttaagaccttgcctcatcctggcatctccccacactaacaactcttctttttcctgggctgcctcctttcagcccaggtgaatgtaactgcatactaaaaagatcattgtgcctcctacctcaaaagaagaatttatctgtgaaggatgaggttatcaaaaaagctttactggacagaagaataataacaactaaaataataatgttacacaaattcagatgtaaggatatcatttggatgtcatttatggagaaagaagggaaaatatcacctgccttgttgtcaatcacatcaattgcaattcatcagcaaattagtctcatctaccaatccaactaagtacctatttttggcttttggaattttactgggtggaagactggagtctatactgttgtcaattcaaatctggtatgtttagtaaaaactaagctagctactcgttcaggaagctttctgtgatgtgcctcaaaaagctgcataaaagggtttgggggataaaaggaaaatagtgataaatgaccttacagcacaaactcaggtctctctggcctctcagcaagcttcagggcttcatgcatgcctgcagctgagagcttccggttgatattccggtactggcactggagcaggctgcgataggtggtcctcaggtcccggttgaagaaggcatatataaaagggttaatgagagagtttgcatagcctagccacagaaatgtcctctccacccacagtgggatgcagctgcaggaagtgccacagatgaagggtctggctgtcgagaggaggaaaaatggcagccagcacacggtaaaggccccgacgatgatccccagggtggtggctgctttctgttctcgcttaaagatggagatgtttttcctttcatgcttgaggagtctcgaaaggtttgcacactcttccacctccttctggagcttcactatgccattcagggcgatgacgctgtctggctccactcgagggaagccaggaaacttgtgtttggcagcactcttcctggcagccttgtaaatctggtagtacatgaaaagcatgacggacatggggatataaaatgccactgcggtagagtaaatcgtatagccaaagtcctggctgatcaagcacaccttatcatcatttacattctgagcccatccaaagagtggaggtaaggtgatggaggcggagagaagccagacggagagaatcatcttcgccatgcatttcccattctgcctcacagggtatgtgaggggccttgtgatcccaaggtacctagtggagagatggaaagataacagatgaacaccgtgatcataactggtcaaccaagcaagtcctgccagccaggtaccagcgccagtcctcgcaacagcccttctaggtaggcatcattactcccattttgcagaaaggtaaactaaggctctgagatgttacctattttattccgggtcacacagaggcattgccagattgtagcctgagagccctctgactctaaagtcagtccatgctttgtgcatgccttatagtttttcacaatccacgaagtcaacaaagtttaaaaagctctccgtccccatgaccacagccaccaaaatcaaccaggacaacatatcaactctgatgtaggatgttgtgacacattctcaaaacttaaccaaggtctaccacactctggtattatacacccagtgatcaccccagctgtcttaatttaggccagcttttaattcattttagctttccctttgcattacagcaaaagcatttctttaagatcacacagattcgtgagataatttgggaatcctagagtgttgaaatggttagcaaaaaatgatcattattattatcattattattgttattattttgcccacagaaaattctcacacaacagcaatgtcagaggaacaatctaagaaataaaagcagcctgacttctctctccagttcttaggagaatcacaaaacaagggtgcaattctgaaaaatgttagggaaatccaacattttctctgtgcttagttctatagagggaataaatattactccaagtctgtgatcaaggatttgtaatgcaaacaagtctgtgcacacagagaaaacatatacagaaaagatgttctgccaaatgcttaatatttttcagcttttcaaacctgtgttttcctcatatttaatagtcgtagagtcttttttggaaagctaggagcacttgagaagcaaagacagaaaaaaaactggtcattttgttgttgtttttacttcctttatgtgtataaaagatacattcttgaaacataaaaaggaaagatacagagagtccctaacttaccaacaggttattttctgaaagttagtcagttagtaggttagaactcaaaaaacaatttctgctagaaatatcctttaatacttaaattatcccacaaaagtccaaaatcatactttcacaatgaaaattagcatcactataacacttacaggaagacaacactgaaatatagtaaaaaataatgagccagatgttcttacttctctagaattctttccttcaataagtattaatggagctcattttactggacaggttctgttccaggtgttggggataggacagtgagtagaagagacgaaaatcctgcgtgcaggcaaatggggaaatcatgtcagatgaaggggaaaacctgaggccatggtaatgttgaagggaacttctgatcccttccaaggagccaggcgttcatgacgctggttcttcatttgcaaacttccgcctccccttttccttaataaagctgacctacaagcactacccttagatttatcagctgtagttaggattatgatgtggctcccaaacagaatgagggaagagaaagagggaggctttcctgagaatgcaagaataagagctaagaaaaaggcgggcagtgcgggggaaagtaactcagaagaagagagggagtgaaggagtaaggaagagggaaaagggaagagggagggaaaagaaaaatctagtccttgttctcaaccagctcctgtgaatgtggccttttgggcaccttccttatttccccagcagcctttcccagacatggattttgatttctcgtctttctttgtctacagccccagcataaatgcctgctctcaagcctcaatgtggcatccaagacatgagcccaggatggtgcctcaggttcaccaaggagtgaagtccagcaggtagaggttactttacacaattccccaggaggccaccagatggcattgtcagatcattttacacctacttactgggaaggggggtgtttcaatagggtaggtggttgaagtaacaggtattatgttggaaaaattatgacaaaaaaggttgtattttatttgtggagcatttaaaaaattagcatgcctggaattcacaacctagtaaactcctattttgaggaaatctgttttctctcccatttcttcacactttccttactagaactatgccttcccacttaaataacaatcccatctttttcctggctaagtaaataatacagaattcacaaagattaatccggagagattaatagagtacaaagaacatttcagaattttagataatctcatttaaatggtatgtttattcattctagtacacttaggctgacacattatatttcaatcatgattagtccatattcagtctgccctggatgtacaaattatatttcataaactctgttctacattaggcaccattctctaatgatttcaagacatcctacaataaggtagttatatttacttcttaggctcctcacttccacctggtgagacatcataaggctaaaatcaactgaaatattactagaaaaaaaatgagtgcttactaacgtgtctggatataaaataaataaacaaaagttaatattttgttttaaccattaacaatcagaaaatagtgtggagatgatgcaattaacaacaactaaaaacacctaggaaaaagctttttaaaaataatacctacagtctatatgaagaaaatacaaaatgctactgaggtacattttttaaaatacttaaatccatgggggaaaaaacttgttttttcaataagaaattctagtattataaaagtacctatttcccctcaatctataaataccatataacccccaatgaataaactggcatggcttttgttaacgattttaaagctcaccaagtcaacatgcaaaaatgtacagataatctgaaaaagaataatgaagggatacttatcccattaaaaaaaagtataaagccacagaaataaaagccccaaaataattattcaaaaagatatcaataaaacaagataggttcaaattgattcaaatatataagggaattcaatataaaaggagtcactttaaatcactagtaaaaaattggatattcttgaagtctcacaactggccagcaattgaggtaaaagtattactggcttcttatcgtttgattaaatataaatctcacatggatcaaagattatcatgtaaaaaaattaaaccctaagaaaatattggcaagtatttccacaattctgagatgacaaaggccattcttaactataatacaaaagcttgaaagtacaaaatgaaacatcaataaatgtttgtaacaaacaaaataaataagtgacatttataagcaacatttagtttaattcaaaaatcattctgtgaagagttaaaagtcaaatcataaactagaaatctaaatggcaatatcacaatattcacagatttcctacaggtcaatacaaaacacagccatcccatagtaagaacttcagagtttgtaaaagaaaaaacaaaaagccaaccatcccaataaaaatatttaagcaattgatcaaagaagaaaaactaatggacaaagccaggcgcagtggctcatgcctataatcccagcactttgggaggccaaggtggaaggatcacttgaggccaggagtttcagaccagcctgagcaacatagcaagaccctatctctattttaaagagagagagagagagagagaaagaaactaatgaccaataagcacttaaaaatattcagaacttcattaataaagagatgcacattttaaaatgacacatttttatcatttgcaaatatttaagaaagacaaaatccaatattagaaaactgaaaaagcaatcattctattacgttgctattgggaatgtcaactgaaataattttggaagacagtttggcaattatcacacatctaggattttgtcttaagaagataattgtacaaatgcaaaatgactaatgtgcagacatgttactaaacacataatagaggaaaaagaatgcaatctaagtattatcaataggagattagatatgatatatatatatactgtatataatatgtataatgcagccattaaaaatgatgatgtacgtctgtatttactaacacagaaacaacagaagagtggattaaaaacacatagctcttaaagataagtaatagaatatcatataacatatattattaacctttctatataaaactgggtgtatgcttgtgtgagcatgtctgtgtatgctcagatgtctacaagaatatcaactaaaatatcaatagtagttttacctgagatgaagaaattttaatgattttaaatttcctctatattttctatgcttgatatttttgtagtgagcatgtaaaaaaaacactattttaagaacaaaataaaagatttaagaggattctgagattcctaatttatatgattctggcaatagaaacaatctggttcataaaatctttagaaagctgataattaaatcttacattgttttatttgattagcttgtcaaaagtactttattagaatacattcataagtttatacaaaagaaaaagaactcattggcctttaaaatcccataattactacataaagtaatattggtattcagggaagtgtttctctaaattatacattcattcttccaaaccttgtataggataaatcttaccttcaagggtgagaaagaaaaaaagaaaaaaaaaactagactgatttttaacattccttaagtatgcatgtttaatatttaatcacactaacattttatcctcactgttaattagaaagcaggatgcttataaagccttcaaaattttactgtaaaatgcatacgaatgttaaagtacagtaaatctcagagacgaaagcactgaagtattatataattgaggaatatatgcaactcacaataggggtgccattgaagtacaggttcagagaaaaagaggattagggagttataatctgcatagagagggatcggaagtaaattaactctgctgcctgtcttccattctaactgtatagaaatggtagataatggttctttaattaaatggcttcttctgagtttcactgctatagaatgataatttagggagtaaaagaaactaggtagaattattctgaaatatggtggttttttagagcgttcagcttaaaaagcgttcacacacttagaacacctcctccaggagattcctcccttgcagttggcaaaatccactagaatctccggctgatgtcagtggctgctgaaactgccagattataagaatcactcaggagctttagaaacatgcagattcccaagccactattctcattcaaggattggagacctagaactttgtgtttaggattgactgttctgggtctttatcccccacactgctgtcaaagcagccttctcccattcaattacaaggactttatacttaccacatgaagggctttactttactgtatatttcatctgaacagtttgcttccagtttagcctaacaaaatcattatgaatcatgtttccattatctcagctattagatttcccagtcctgtgctaaatgagatatgtgtggtctttatattttaatcaagttgtagatttttcttaaatgcataatacacaacaaggttttttaaaacctttttgaccatggttcacaaaaagaaatataacattttatataataaactgatatgtgtgtatatttatatttaggaaattaaacaaaagtttcacaaatctgtatttaccattataaaccattatctactctcttctattctatttcagactttttaaatgctggccttaactcactaaattgatttcataacccattaatggatcaaggcctaaagtttgaaaattactcaccttcaccaaacatatcaaaaggtgtttaacatcacgagtcatgacaaaaatgcagattagcacaatgaaatgtcactaacagccatcagagtggttaaaattaatgatgatgatgataaaaactataatgccaagtgttctgtgaagatatgaaacaattgtgattctcacacattactggtgggaatgtaaactgatgcagtaactttgggaaactatttgtaatatctattaaagctaaataatacacactctatgatctagcaattccaagtatataatgaacattaaccaaaatacacatacaaaagtttatagcagcactgttggtaatagctccaaatgaaactaatccactctacagaagtaaaattagtataactctataatagtagaataagtacataaactgtggcatatttatgcaatggaattctataaaacaatgagaatgaacccactactgcttgtcaacatggatgattttcacaaacataagctcgagctaaagaagctaaaaaacaaaaaagaacatactattcaaaaccaggcaaaactagctgctggtgacagaagccagaatggcagttacctccggggaagaggaagtcctaagcaatgagggtgcaggaggaaagcttggagttctgaaaatgttctttctcttcctctgggtgtgttacataggtatgctcaccttgtagaaagtaagtgagctattcagttatgatttgtgcagtgttccggatgtatgtaaatcaggtttttttaaatactaaaagtaaatttttaacaatacactgaacttatcatttgccattaacctagatgctaacctgttctctaaaaccaatgttacagtggggttccaatacacttttaaaccatttccatcagtgtttctaagctacacttacagttaggaacaataaacaacttaaattccttattctgccctcagcattgagggagagaagtagataaaagagagaggggggaagaaagcaacaaaattcaaccaagtttggaaacacagtagcaaagcctcctctttgagaaaggatattattattaaacaaaaaagagagtttcccttaagagagaaaatcagatttaattaaaataaaataagtcacttaattctaaaagtgcctgtaaaaattcatatattatatttgttaactgttgctacataactaattaccacactttagtggcttaaaacaccaccaaggaaaaccctgtcataaaaaaaaagaaaagaaaagaaaaagaaaaatacatgtctattaaaggatttttagacaattatacaaagtcatgaaaatgaatagtgtgagaaatagtaatgacccctgaattatacttgttaattacttcagttgtatatggattcacaataaactaaattttccaaagaatttggccttttattcctcagaaaaagggggcggggatggcagcaaagaaagaaccaaaatttatcagcaataataaaagaaatgaatggcataaaaccttagctaaaaactttttaaaggttagaggcaggaaaagaaaggaaaatattctgttttatgatggttctgtgtggctttcaaccccatcccatagaagcagtactcaagaaacagggtgagtaaatccttaaaattccaaataacaccttcatactggggagaagcaaatcaagagggtgagaagacaacctaaagaaaagtactgaaaagccatgaagagcagaagccccacataccattttagcagagttaagggccaacagaacttgtcatctttcaggacactgagctcaaccaggggagtatgccaacttccagaagactggtaaatcctgagcttagcgggatgttgtctggtccaggacatctaatgagtattcagagtaaagagtaatcctccttaacaaacttcactcagctgcggtagaatctactcccttcctttccccgcaaccctacacttccgggcaactgaaaagtagatgcactaaatactagcctaaaaagagaaaaatagcatatcaaataaggcagaatatcgatgaaaattcaaccacagtatgtgagaacaaacattagggtttaaataaacaactcatattaagaatgagcaagattaaactgttacagcaactacagaaacatgctccaacaataacaacaatgaaaggaaaaaagaaagaaagagaacatggctaagacttgaagaaccaagtcaaaaggcaaacataacattcagaatagaagttgttttcctaaaagtacttttcactgtaagagaccttaataaatatatgtgatcactgaagtagaggctcaaagatgttaaaacagcagaatgagataaaaagagactgctaagttaagaaaataaattgaggccagaacatcatcagggcagatctaatggatgaatgagcaggagctgagaatagaaacagacagacacacctggccaggtgcagtggctcacacctgtaatcccagtactttgggaggccaaggagggcggatcacgaggttaggagttcgaaaccaccctgccaatacggtgaaaccctgtctctactaaaaatacaaaaattagctgggcgtggtggcgctggcctgtagtcccagctactcaggaggcagaggcagaagaatcgcttgaacccaggaggcggaggttgcagtgagcagagatcgtgccactgcactccagcctgggcgacaaagcaaggctctgtctcaaaaaaaaaaaaaaggaaaggaaagaaaagaaacagacacacctgaaaagcaaatcaatggcatgaagtaaaaaggcttgaggtaatcatatcaatgcatatggaaaaatttattcaaaatttattcaagcaattagaaggtgacaggtaaggagaacacacaaagataagacataataataacatctccctgaagaaaagtacctaacaagtaggggggaaattgtttaagtaaatagagctgcaacatgtaaaaagtatacagtgatataatttaggacattttccttgaatcagtgaaagagctgaatcttaccagcaaaaggacacataacatagttgggaaaaagcgatatagaattattatccatgatacttatcctagtaaagttattgaacttcaagacatggaaagaccactgcaggcatttgggaaagaaaaaaaaatcagaaaatatgcaaggtagaaaaaaaatcaggctgattctcaacagcagaattccatgccaaaatataatagaaaatgtctagaaagattgagtgtataaaatgtgaaatagcggccgggcgtggtggctcatgcctgtaatcccagcactttgggaggctgaggtgggcagatcacctgaggtcgggagttggagaccagcctgaccaacatggagaaaccctgtctctactaaaaatacaaaattagctgggcgtggtggcacatgcctgtcatcccagctactcgggaggctgaggcaggagaattgcttgaacccgggaggtggaggttgcggtgagccgagatcgtgccattgcactccagcctgggcaacaagagtgaaactctgtctcaaaaaaaaaaaaaaaaaagtgaaatagcattatgcctgttatctaagattataaagctaagaagtagacattctcaaacatgaaagaacttgaagagtaaagtgcccataaaccctattttgggggaggaaataaaatccatccaactaaaaatgaatcaaaatgaagaatttaaaaccagggaaaggccgggcgcggtggctcacgcctgtaatcccagcactttgggaggccgaggcaggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactctgtctcaaaaaaaaaaaaaaaaaaaaaaaaccagggaaacaatggctattactgaacttgtttaaatgcaacagtaacacctatgggaattatattagcataacagaatgtaaattttacaaagtaaaaataatataagccacaagaatcaggagctggggggaagcaaggtaggatacagtgttagagcactaatcaattcaactttcaaagtagagatcaactgatactgcctaaagttgtaacattttaaaattgtaacatatagtttatacaaatccaacctcctgatggctttcatattttcccataatctttacacaatctttcaggaacagatacctcttaaaattagtgctgtacaaaggaaaggaaatcagtatatcaaagggacatctgcatccccacgtttattgtagcactattcacaatagccaagatattgaatcaacctaggtgtccaacaacagtttaatggagacagaaagtgtggtgtatatacacaattaaatactattcagccataaaaagagggaaagcctgttgttcacagaaacatgaatgaaactggaagacattaagtgaaataagccaggtacagaaagttaaacaccacatgttctcactctaaaattagttgatctcataggagtaaaaaggaggacagaggataacagaggctgggaagggtaggaggaaagaacgatatacaaagatttgttaaaggatacaaaattaaagctagataagaggaacaagttctagtgttctatagcattgtaggatgactatagttaacaatgcatatatagattcaaatagctagaaggagggtatcgaaaatattcccaatgcaaagaaatgataagtgtttgagattatggatatgttaattaccctgatctgatcactatacattatatgtatcaaaacatcaatatgggctggacgcactggctcacacctgtaatccccgcaatttgggaggccaaggcaagtggatcagctgaggtcaggagtttgagaccaacctggccaacatggtgaaaccccatctgtactaaaaatacaggagattagccaggcgtggtggtgggcatctgtaatcccagctacttgggaggctgaggagggagaattgcttgaacccgggaagtgtaagttgcagtgagccgagattgcgccactgaactgcagcctgcgcaacagagtgagactctgtctcaaaaaaataaaataaaataaacacgtaccctataaatatgtacaattattatgtgtcaaaaaaattaaatgaaaaaatagtagctctgactgaaagttctacttcagtttatttttcttgttttaaattcaagtaaacttagttttaatattttgttaaaataacatgtatagtgtgatatcatttttataaattttttaatcaatcaactttctatctacctgtcattgaatcaactaaccagctagccagccatcctcctaagtggacataagcataaagaaacatctaaaatgatacttactacatgttatttattttatttttctgcctaacagtttagatgatttgttttcttcttcatattttttataattgaattttcataatgagcacagacagttttcaaaaaattaaagaattactctaaaatactgcaaagctttattttttctttttggactgtttctaccttatcactttctcttttttaatatacatatatattgtgaaatgattaccacagtaaagttaggtacagaatggaactctgatggactcttccaggattttaactcaagtgtttcagttagtgaaggaggcttctggatctttccaggcatgtagatgtctttaaggatgcaatcaggcctcctcgtcacaagcgtgtggccatctatgggccacatagatgtgttactatgtgaggtaacacatctattacctcacatagttaccattttgtgtgtatgcgtgtgtgtgtgtgtgtgtgtgtgtgtgtgtggtgaggtttactctcttagcaaatttcaagtatacaatacactattgttaactatagtcaccatgctgtacattagattcccataccttatcctacaactaaaagtttggaccaacatatccccatttcccacatccccatccccctgccaacaaccatgctactctctctttctgagtttgactttttagattccacaaacaaatgagattatgcagtatttgtctttctctatctgacttatttcacttagcataatgccctgaaggttcatctatgttattgcaaatggcaggattgccttcttttgtagctgaaaaatattctattgtgtatatataccacattttctttatccactcatcccttgacagacacttagattgcttccatagcttggctatagtaaatagtgggctattaacatgggagtgcagatatctcttcaacatactagcttcatttcctttggacatatacccagaagtagaagcactggatcatatggcagttagttgtatttttattttttaaggaacctccatactgttttccataaaggctgtactaacttacattctcaccaacaagtgcataggggttcccttttctcagcatcctcacgaacactcgttatttcttgtctttttgataacagctatcccaaaaagtgtgaggtgatcgctcattgtggttctgtttatgtttccctgatgataagtgatgttgagcaccttttcatgtacctgttgtccatatgtatgtcttctttggaaaaatgtctattcaggtccttttcccatttttaatggaattatatgggtttttgttgttgagtgatatgggttctttaaatattttgagtattaacctctcataagatacatggtttctgaatattttctcccattctgtacatggccttttcatgttgttaactgtttccttttatgtgaagaaggtttttattttaatgtagtcccatttgtttatttttgcttttgttgcttgtcctttggtgttatgttcaaaaatatcactgccaatatcgatataaaggagcttttacccggtgttttcttcttggagttttatggtgtcagatactacatttaaatcgttaagcaatttcaagttaatttttgggagtggtgtaagataaggattggatttcattcttttacatgtggatatagttttttcagcatcatttattgaatagactattctttccccattgtgcactcttggcatccttgtccattataagttgaccgtgtatgtggaggtttccatggattccatgctgtcaattctgttacattgatctatgtgtctgtttttatgccagtaccatattgttttcagtaccattttgtaatatagttttaaatgaggaaatgtgatgcctcgagctttattcttctttctcatgattgctttgtctgtctggggtcttttctgattccatatgaattttaggattgttttctgtttctgtgaaaaatgccattggaattttgataggagttgcattgaatttgtagattgtgctggattttatgggcattttaacaatatgaattcttctactccatgaacatggggtatctagacatttatttgtgtcttcttcaatttccttcatcaatgtcttatagatttcagtacctaacatctttcaccttcttggttagatttattcctaaggattttattggttttgatgctactataattggaattgttttatttctttttttataagatgcatagataaaacttagtcatttttaaattttactttgagttctgggatacgtgtgcagaacatgaaggtttgttacatacgtatacatgtgccatggtggtttgctgcacctatcaacccatcatctaggttttaaggcccacatgcattaggtatttctcctaatgctctccctcctcttgccccccatcccccaacaggctccagtgtgtgttgttcccttccctgtgtccatgagttctcactgttcaactcctacttatgagtgagaacatgcagtgtttggttttctttcctgtgttagtttgctgaggatgatggcttccagcttcacccatgtccctgcaaaggacatgatctcattcttttttatggctgcatagtattccatggtgtatatgtaccacgttttctttatccggtctatcattgacgagcatttgggttggtctttactaatgtaaatagtgttgcagtaaacatatgtgtgcatgtgtctttatagtagaataatttatattcctttgggtatatacccagtaatgggattgctgggtcaaatggtatttctgcttctaggtccttgaggaatcgccacactgtcttccacaatggttgaactaatttacattcccaccaacagtgtgaaagcattcctatttctccacaggctcaccagaatctattgtttttggactttttaataattgccattctgactggctggagatggtatctcattgtggttttgatttgcatttctctaatgatcagtgatgtgcagcttttcttcctatgtttgttggccacataatgtcttcttttgagaagtatctgttcatatcctttgcccattttttgatggggttgcttgtttttttcttgtaaatttgtttaagttccttgtagattctggatattagacccttgtcagatgggtagattgcaaaaattttctcccattctgtaagttgtctgatcactctgtggctttctttttcagatagtttgttattactctatggaaatgcaactaatttgtatgtgttgcttttgtatctcacaactttactaaattcacttattagttcttagtttttggcagagttttggtacagttttttttcagtggagtctttagagttttctacatataagatcatcatgtcacctgaaaacagaaacaattttacttcttcttttctaatttgaatgctttttatttctttttcttgcctaattagtatggctaggacttccagcactatgttgaacagaagtggtgcgagtggacaaccctgtcttattcccaatattaaagaaaacaatttcagctttacaccactgagtatgatgttaactaaaaggatgttgaattgtgtcaaatgctttttattcatctgctgacataattatattatttttatctttcctcctgctaatgtggtgtatcatatttattgatttgcatatattggaccatcttttgctagtattaatattatgctgaggattgttgcatctatgttcatcagagatattggcctataattttattttctcatacagtcctcatccaactatggtatcaaggtaatgttagcctcataaaatggatttggaagtgttccttcctgttcaactttttggaagagtttgagaataattcacattaactcttccttaaatgttgggtagattccccagtgaagtcatctggctctggactttagtttgttgggaggttttttattattgattcaattgacttactagttattggtctgttcagattttctctttcttcctaattcagttttgatagcttgtatgtttctagcaatttacccatttcttctaggctacccctagaagtatccctattagttactttataattattcatcatagtctcttatgatcctttgtatttctgtgacatcagttttaatgtatcctctttcatttctgatttatttaattattccctctcattcttagtctagttaatggtttgttgatttatcttttccaaaaaaaactagctctggtttgttagtctttactactgttcatctagtctatttcatttttttttttgctctgatctttattatgtccttcctcctgctaaatttggcctttttctatttcataattccttgacatataaagttgcattgtttatttaggttctttctttttttcttaacatgtaggtgtttattcctatcctttctcttagaaatactttcatggcatcctgttagttttggtatgttgtgtttccatttttgtttgtttcagaattttcaattactctttacatttcttctttgacccattggttgttcagaactatgttgtttaatttccacatagctgtgaattttccacttttactattgtgattgatttccagtttcataccactgtgttcagaaaagatacttgatatgatattaatcttcttgaatttgtgaagcatattttgtggcctaacatatgatctatcctggaaaatgttctgtgtgtgcttgagaagaatgtatattctgctgctgccaggtggaatgttctgtatatgtctgttaggtccatttggcctacagttctgctcatatctggggttccttattgatattatgcttggatgatttattcattgttgagagtaggatatttaagtcccctactattattgtattgctgtttatttctcccttctattctattagtatttgctttatatacttaggtgttccaatgttaaatgcataaatatttaaattgttgtatcttcctgattaattgacctctttatcattgcataatgaccttctttgtctcttgtgattgttttggcataaagtctattttgtttgatataagtggatccactgctactctcttttggtactacttgcatgaaatatctttttccatcccattttccatcccactttcagcccatgtgtctccttaaagctcaagtgagtctcttgtaggcagcatgttattggctcttattttttatccattcagccattctatgtcttttgtgtgtggagaatttaatccatgtacattgaaattacatattgataggtaaacattcaccactgccattttgttcgctgttttctgcctgttttgtagttcctttattccattcttcctctcttgctgtcttcctttgtaacctgaagattttttgtagtggtggtatactttcttttctctttatcttgtgtgtatctactacaggtctttcctttgtgtttaccataaggattacataaaatatcttatagttatagcatcaccctaatttaagctgataacaacttaacttccactgcacataaaactctacagtcatctcttcaaacctttataggttcactttggcagggaaagaacttcactactcagtccagcctatggttcttgacaggccaactggtagcattgacagacagacagagcttcctgttgcgatctctagttgagtggggccactgcaggtactctaaagctggctgggtttcctgcctgggatccgaagtcaagcagggccactggctgggctccctggtctggcggggctactagctggactctacccacaagctgtgctcagcaattgggaagagccttaggctggactccatggccaggcagggtgggatgaggtcacgggctttgttcctcaattgaatagggctactggattggctctctgctcagtggggtcataggctgggttccacagatgggtggggttgctggctgagctccctggttaggtggggcctaggggtaaaccctactttaaaattataatttcagccattaatttcatttgtctgccaattagtccttctttatataaatctcttcatgaacttggcaagtttggaattaacagctgattcaaccatattcaatttctctgaaatttttgcaaattatctttgcactatgaattctcgttagcttcttagtttattaagtaaatgttgggagaaagttctatgcatcctaacggtataatctcccaatgagctgtggtggactaaatatggccatatattctttgccatccctctttgatagataaatttttctccttctctttattctgggctggccttgtgacttgtttttaccaacagagagtacagcaagtgatgccatgtgacttctgaggctgacccttaagagatgtgcagcttccacctttactgcttggaaaattccccctgcatttagctggtatttggttgggctgtaggatgcttcactcacattctcagtgcttccccaattatgctttccttcttagcatagttagcctaggcttcctcagagcacgacagacttcttatgtatcagctggcttcccagggggagttttccaagcagtaaaggtggaagcttcttagattatcccaaaatttggatcccagccaagacttccccttggagctccagacccatgaatcgactgcctccttcacatctctacttgggtatctttaaagtgtcttattcactccttcctctaacaagtttttattaaacacttctataagtctggcaccatctcgacatgtccaaatatatcatctccacaaaactgaacatccttccatttccccaacttagtgagtctgtcccagaaatctaagagtccttctcattcaccatcttaacccagctctgcctatgttacctcctcaatatctctaaaacctatctacttttctgtctccattgccatcatttaagaatcattctctgtccgcaagtattgcaatagcctctaaattggttccctcgcaactactattctccttcctaacccattatcctcaggtatccagggtgatctttcttttaatgttatttatttcatcaaatatgaaacattttcacacacttcgaagatatataaggcatatattgagaaaccttgcttcaaattctgtttccatcctcttcatcccccacctccaatatgtatcacttttattaaaatcttgtgtgcccttcatcttttctttgtccaaatgcaagcaaatacaaatatgttcttatctccctctttcttaaatgtaagatagcatactggatactctcttctgcatgttgcttttttcacttaatatatcctcaagatacttccatactagtgcatcaagagctccctcatgcttttttaaaactgcaagtattaaattgtgggactttgccatcattcatttatccagtaataaataagcaatgggataaatgaattcaaatgatattcacatcattcttattctcatgtccaccaatcaaggacaaaatgaaatccacacttcagatgagaaagatcaaacataaagaataaaacaactccaacttcttcctcggtaatgtgaaccctaaaacttagtggctgtcagtccttcagttggcctttgaagaaaaggaagaatgttgttggccaaggctcgtgttcagttacagaaggtaccactgaaacagcacagtactgatgattcctcccactagccaagaacactttgattactacagcccacagcactacgttccaaaaaaaatcctgcaattactaagggtgtgtgtcccagagccatctttgcagaaaagaagagcttcctcaaatttcctcaattgctgaattatttgaatgtaaacattttacttctaactgtaaggataccatgcatagtaatctaaatccatccatattcaagtttttaaaagcatataaaactgtggcacctgggtaagctttgagtaagacatttgtctccatatttcatactttgataagaccatttctctttcttaaggaagtcgtatggaaagtttgggattaaatttactctatactctctttcctattcattacttttgataattgttaattaatttgcccatttccattaatcttcccccaaagcaatcaactaacaaacgtgtttaatatttaaatgcatgttatatgtgcatatgtatgcatattttcaatgtgttttctttctgaattaaattgcttatctgatcgaggcctatcacaaatgttcatatatttccactaaaatagagtaaaatacaaatccttatatacttatcaaaattattttctggtttaaagtttaaataataagctttagactttacaactataaccaaatatgcactttaaaatagccatgaggataaatgaacaaaagaatttttagaattagaaaatcaattatatattccaacctagaaaaggaatttaaaaaattagattccaaaatccaaagcaaaaactttaacagcaaaaccagttgccaaaataacaaacattattgacaaaaataaaactattattatttaaattactgacaaaaataaataaaactgaaaatcccttttacaggcaacaaaattgacagcagcagcaggcagtccagagcagccgctgccatcacgctggctgcagcaaggaggtgcgagtggtggcagcaggagccgctgcgggagcagcagtggcagtggctggacccctgtgccccgcatccccaaggcagctgactgctctgcacccacccttgcgcagccagacggaacctgcccccaggcccacagcctccaggactctgaagccctggcccagcatgaccattctagcataccgcacctgcggggagggcacctgcagggagggcacgggaaggaggcagagctgggcccaggatggtgctgcgctccatggagctggagggagccagggataagagggaccctctgagagcctgctgccctgggggccactgcgacagggctgagccgagctacctgccagcactggagcagcacagttgggcacggaggggcaggcagagaggagcccagagaggacctggaggccccaccccaggctgcaaggaggcatagcctgggctgcctgcaggctccatggagagggcggggctcccaccctcccaggcacaggacctggggtctctgactctgtatcctcaggggcccagaaggcccaccaaccccttgggttgtctgctcctgctgcctggcctctccccactcccagtgcctgctcccatctcagagcgggattggggccgagcccgggcactgtcacagcccagccaggtgtgctcacactcaggacagcactgacatgccagccccctgtcgccctggccctctctagacattgggcaccaacaagcactgcagggaagccaaggtgggtgctgagggcagctcggcactggcctgcaggtgccccttggcccaagcagcctgggtgccatggaccctagcaggaggcagaaaggctcctgggcagaaggcggtgggttcccagtgaggccccaccttcgggccagggagggcctgaagactggggctcacgctgccagtcccacacggactgagatgggaacttgtggtgcctttttcagacccacccatggccacccatggactaatgggcacacacttcctcccatctgaggcccataaaagccccaggctcagccagagcagaagggatggcaggaccacaagctgcagaaaggagctaccctctctgctgagaactgaacactcatcgggatgaccagctgcagacaggagctaccctctctgctgggagccaaacacttgttgggaagacctgcctgcaaagaggagctaccctctctgctaggagctgaacactcaatgggacaccctggccttagaaaggagctgcaccctgtgggtctctgctggttgttctattgctcagtaaagctcctcttcgtcttgctcacccttcacttgtccgcatacctcattcttcctgtttgcagaacaataactcaggacccaccaaatggcgaggctaaaagagctgctataacacaaacagggctgaaacatacccactgctcaccaggttgcaggcaaagagaaggagagaagagctgtggccctttggggagaccagacctgaggagctccctgagccagggctgtgactccctctttgagacctgtgattcctggtgtcctcaagcttctgggtgccaccacattccccaatgccagccagggaagctgcttgcagtgtgcctggtccagccacagcctcccagagagctgacgcccatgccagcacctggagctgcctgccccatggcagcagccagcatgtctgactgtgcagtggccagaccccacattcactcacacacccctcaccactccacacctgactcacaatctcccttgaaggtgtgggatccaggctggtagcacaagccaagtgcagcctgccaggccgagtgggcagaacaagaacagcagccccaagcaaaactcaggcaaacgcaccaccagacagaggtttccagccagagaaatgacaacccaaaaatcctataacaaaatgagagattaaaagggaaaggaaatagagggaaaaaaaagtaaaagatacctaactttcaaggtaaattttttaaaataactttttttttaggaaaaaaatcccttttggtcagaactataagccatttatgtatacaagtatttaggaagttagttgaagtagaaaatcaatgacaaaattaccataaaatttattaagcgtactatattcagacagtagtcaaatttctaaaaataaaaccctaggtcatagcagcataatttttactcttacttaatactttcaaaaaagcaaatagtcattagatatagagtttattatttattatcatctttcattctaatcctttatcctcatatccttttgatgtttttcttttaaaatggaatcattataatagatgtaaataatattcaatagtagtagcctatatgagccattagttatagtctaataatttcaatgtcttacttttcttctaggaaataaaaaatttatcaataagagtggagatttttcttctcttctacctctcccatttaacatattagccattaaaaaaccacacaagttcggttcaaaggatgctgctatttatctcctatttccttgtagtcccttttcacatgacgtatctttaaaataaagcaaaaatcttccagaatttaaaattgtagctaataaacttaccgtccatttctaagtgtgtgtgtgtggtgagggcgtcatattattttacacatgtatctacccagaaacccaactgctttgtctaagtttaatgaaacatggtatatattttccttttatgcccagaataagtattactaaaagcagaacaagaacaaaattaattctgcctcatgtttttattaaatactagctaactgagcatatgtaacatgccagggtctgggataaaagtttatctacagcactggattcagtctttacaaccctctagatattattatcatccctattttacaaatgaggaaactgaggctcagaaaggtttactctcccaacatcacataataaagctcaaaactaggtttcaacatgagttttctcactccagagcttcctcttaaccaatacacacacacataatcatttacaaagtatatccatacacatgctcttctcatataatcccaattttccatttccagttgaagaataactgaaatttctagttgggaaaaactcagaaaccctgacagtaactcagtatagaaatacccatttaaagcatcccttgctttcggtcaaactcatacattgacagagaagtcgcagctgcttgaagcaaccagctacactgtgggatagtcacaagtgtttaaaagttctacattaagtcaagaaaaaatgctccttttaatgaattttcctctataggtgtcattctttttttttattattgtgggtacataataggtgtatatatttatgaggtacataggatattctaatacagacatgcaatgtataataatcacatcatggacaatgaagtgtccatcctctcaagcatttatcttttgtgttacaaacaatctactgatactttttaagttatttttaaatgtacaattaagtttctattgactatactcaccctgttgtactatcgaataggatgccttattcattctttttttttgtacccattaatcatcctcacctgctctccaacccccactactcttcccagctgctggtaaccatccttctactctctatgttcaattgctttgatttttagatcccacaggtgaaaacatgtgatgtttgcctttttgtgcctggcttatttcacttaacataataacctcgaattccactcatattgttacaaaggacagaatctccttctttttttatggttgaatagtactgcattgcgtatatgtaccacatttcctttatccatttgtcaggtgatagacccttaggttgcttccaaatcttggttattgtgaataacaacagcaacaaacatgggagtgcagaggtgttcttcttttacagcaattgaaaataaggctatttttttttccgatctgccaactatatgactgctgacatttgtgatacattcctttcacatcctctgttcagttaggtcctttccattagcgatgatataaccctaagctcaagcaggaataagcaagatggcaaacataatggctcactgaataaaaaaaaaagctcaggttatcttcaggcccatcttgatccaggagctcaaatgataccatcagaattttccacagaagatggcatcaattttttacagaattgaactccagactccaaatgtgtctgaatcagcacagattacatgaaaaggggagcagctttctactttttccacttttctgttatatttatcaatcaagttttatataaatatattgatcattcaaagtatttcttctttattggagttgtcagttcccttagtactcagtactcattttgtgttaattacgtcaccagcttgttccttggggagaaattctacaatagtacctcttattatgacttctgcagttttatctgacaggtttataatttggaggctgcttcatgtgaattttgttatgacatagcatcagtcagatatatagttactttgctggaaaaatttttcagaaaactcaactcaaaatggcccaaataagaatgatttattaagtaggacagatctgaaatagttaatttggcagcccaatgacacggtgagggacttggtttccttccatctttttactctgccatcctcagtgcatgggccccacagccccaggaccacaatatggctgctgcagttgcaaacatcacatacaaaccaagaccagcaaaactctgacaaactttcttcataagcatcgctttttaagaaatgaaacctttccaagatggccttttcagccctccactcatagcgcagtggtaagaaatacatcacatacccattcttaaacgaatcacaggtagaaatataaaatatacaaaatataaaacaatcctgagtggtttagtgaaacatgactgcgtgcagcagagggactgcctaaagaaaataaagctctctaaataacgaagaagatgagatatgccgttgggtagaaaacagaagaaaattaaagttacccatactctcatcactcagaaataggtcttactaatattttgatgtatatccttctaataattttccctttttgtttgcttcacttaaacttatttcatccatgtattcattgatgtgtttattgaagtcgagggcctactacattccactgctcttcgaggcaatagtgataggatggtgataaaggcaaggaaacaaatcatcatccttggtgatttcaggccgtgctcggtgctgtgtagacaattacagggatagagggagggggtaaggtgtgatggcgagttgagaggtctctgtcccagcagagtcctgcaagaggtgaaagagggagctgtgtgaagatgttgaggaagagaatcctacatgcaaaggcccacagggaacaccatgtggccatgatcatgaaacagcaaaagtgccagtgtggccagcatcacacacgcaaggggaaagggaagtgatacattccaaagtggtcagaagccaaacctcacagggcccagcaggcaactatgaggccttttgttttattctaagaaagccctggagggttgagcaggggaagacttggcctgacatattttttagtgctcactcaggctgttctgtagataacagactctatagagacaaaattctagaaagtagattcttgaagaatttgtgacagcttttctcagttcaatttttcttcagttacaagaacagtgctttctattcactgactttcttctgtatctctgagaatgtttcaattacttggttgagaccagcactgcccaagagaaacacaacataaaccacaaatgagagccatatgtgtattttgaagtttctagtaaaagaaagaagtaaaaataaacaagtgaaattaattttaataatatattttttcatacaacatatcctaaatataatttccacatataaaattattagagagatagtttgcattctatttcttgcataaattcttttaaatctagtgaatattttacactgacagcacatcataattctcatgggtcacatttccaatttttaaaagccccacatggctattgcctaccatataggatatggcaggtgtagacaatagggtctacctgctctttgttcccccagtctgttctcagtactatttcatgtctgtaatagttgactacttaaattcgtaaatactttaatcatgaaaggtctggctaatttccatatccaatatcactcaggtctgttggatggacactgtttccttcttctgctgtctctaacttttcattttcaaatgttttaattcagatacaccctcatatgtatgtatgctgaccaactctaattcacagatatttatttgagaaagcagcaggtaggtaatctttatatcctttaataagtgaataaattctataaaccttagacaagatgcgaagcttctaaccttttcttctttctctgaagtttataatttaaatttgatttagtcatacaggtaatttcctaaacttcatacctcacatgtcacataggttgaaagaacatgagtttgttctgttttttaaattttaaaaccaatatttatgtggaaaatatcagattaagagtaatacttagggagtaagatcattttcttttttgaatcctaagattcatgttttgctccttaatgtgaaaaatctttctaaaatatattaggtagatatccacttagataagtatggtatacagactataatagaattttctttgctgattacaaaggctacacggtctcagtgttgttattccataatagctgtccacatacagagaggcaaaggaaagaaaatctaattaattgaaggtcttagttagctgaggactggcaagaattcattatggcatggcaaatgagagcaattaattctgtagaataagtgagtatatatcagataggaatgtttttgggctgaatataatagcctcactaactggcttaaataaataaggttttcctctgagggtcagcaggccaggacaggtatagtcacttactctacaatactgtcaacgacccaaaggacccaacatccttctaaattcccatttttaaaagacttacctgtggccttaagatgcctcctacaggccgggcgtggtggctcacacctataatcccagcactttgggaggctgaggcgggtggatcacgaggtcaggggtttgagaccagcctgaccaacatggtgaaaccctgtctctactaaaaatacaaaaattagctgggtgtggtggtgggcgcctgtaatcccagctactaaggatgctgaggcaggagaattgcttgaacctgggaggcggaggttgcagtgagccaagatgacgccactgcactccagcctgggtgacagagagagactccgtctcaaaaaaaaaaaaaaaaaaaagatgcctcctacaaaaagaggtacaccatccatgttccaggcaagaagacaggcaaaaggccaaaaggcaaaagataatgccaaccaagtctgtccatttttaagaacttttccaggtgccacctgcaagaaatttcattttggtctcactggccagggctgtgtaacctgaccatcatagcacgaagagaggctgggaggcaactatctcaactgaaagcattgctatcctaaacaaaaccagataaccagcagttgtgaacaatgaggttattgcacaattcagggaaacaaggagttgggtccttaattgctgtgtcctgtgacagctgatgggaagtgaaagcacatagggtcagtatgagagatcaaaatctgtagcaagatgtaacaatgccacttccttatccaccacccccaaatcccacacaccccttcatctcttcctcttctgtccatgctgaaaattcctctatgaacacttccaaggctacaatttcctacagttcttcaatcttccatttcccctaaagttgattctaactagctgaaccatggattccaaaggacaaggatgttgacattactctatccacccagccatttcagcatagcagagtagaccactggacataatgagctcttgattatcctcctgtgctatggtttgaatgtctgtcccttcagaaactcatgttgaaatttaatccccagtgtggcagtattgaaaggtccggcctttaagagaagactgggtcaggagggctctgccctgatgaatggattaatccattcatggattaatggattagtggggtaatgggttaatggattcatagattattatgggagtggaagtggtagctttataagaaaaggaagagagacttgagctagcatgctcagcccctcaccgagtgatgctctgcaccacctggggactctgcagagtccctaccagcaagaaggccttcaccagatgtgacccctcaaccttggacttctcagcctccataattgtaggtaatacattccttttcctcataaattacccagttttaggtattatgttacaaacaacagaaaataagctaagacatcctaaaacagagactgtactaaacgaaaagtcccactgctatgactgctcaaacgtggctcctttaaatgaagtggggtctcccacagaaacatacactatatactcaccctctacctctgtacttaatttaggtggctttccacttgcccacactcactgttttcctgtctcttccactgtctaaatgtgtctccattcctggatactattttccatgtgatctgcttctacctctactcttcccaactcaagtctgaacttgaattttttagctttgatcccaacactctccagatacaacttcaaaacagtcttccttggcctcaggcaccctgacctttgccttgttcctgcataacccccagctggtgtacccccatcaggagaagagatcaggcactccaaactttctgcacagtgtgctagattgagggagtcaaccaccatgaagggagagaactgctgccctgattctcactgatgaaaggccaggaggaaggattttaaacatgccacttcatagtgttgtttccttgcacagcccccaggagccatccctgaagaaacatagtgcctcttgaagattttttaaaagatttttccagtttgtccttctccccctttggagcagagaatgttagaacagaggaaaagttaggacaaatagagaaagagggaccaacatcaccaggaatgacaaaatagaattctctgtacttctaaatctgctaagaaataaaacctgatgtgattgtgagaagtgggcaatgttctgtcccaagaaggaagacaaggccttccctgctctgaccctgcgttttgctccagcctcattgctgactccctgcctccacctgctttttgtttctcgtatactgcactggtccaaagaagctaggttatgggctggtcacaaacaactccaaaatcacaacaaatgtacatttttcactcgtcacctcttctctgagtccaggcaactctttaggccagctctcctccatactatggctaagtaatacctctctgtgtcaagatactcctacaatgcccaggccaggggaagagtgctctggagaacttgacacccatagttaaatgatctcacccagaaaaaacatttgtcatttctcctcacattgcataaccttgatgaaccacaaggaggcagggaagtgcaatttgtcacgtgtccagatggaggacaaatggaaatatttgtgagcgacacaaatgcctaacacacattccatgttattttttacctccatactttagggtagtgtggcccctgtgcttaggacaccccatccccaacccttttcttggttaatctgtattcccatcagtcatccttcaccctccagccctgcatgcaggctaggttagaactctgtccatatcattgcactggtcacatcatgttattgtctatcttactcaaaattacaagcttctataagtgtatcacttgtcctttaaaatttcaagtatgaggccaggtgtcgtggctcacacctgaaatcccagcacattgagaggctgaggccaaaggatcacttgaggtcaagggttcaagaccagcctgggtgacatagcaagaccctgtctctacaaaaatacataagtaaacagtaagaaaataaaattcggccgggcgcggtggctcatgcctgtaatcccagtattttgggaggccaaggcaggcggatcacctgaggtcaggagttcgagaccagcctggccaatgtggtgaaaccccatctctactaaaaatgcgtaaaattatctgggcgtggtggcgggcacttgtaatcccagctactcgggaggctgaggtaggagaattgcttgaacccaggagacggaggttgcagtgagccgagatcgtggcactgcactctagcctgggcgacagagtgagactccatctcaaaaaaaaaaaaaaaaaaattcaagaatgaagcacagtatgtgccacatggaaagtgattcgtaaataaatgataaatgattaaatgaatacacaaatagcaacccagagagtgccaagaaacagtgagaggcacaacaccacagggcagtggaacagacccacactcacacacactcaggacaaaggtcaaccaatatcatcaagaatgacaaaatcaaactctccacatgtataaatctgctaagaagtaaaatccaacgggattgttggaagtggtctgtttctttatcccagaaagagacagacataacccctagtgcctggaatgttgtgggaccacatgctttagtttcctacccttcctaagagttccattggtttgaagaagaaaacatatacaaaactcccgtgcaaggaataaacgtttacatctatgacagatatggcttgaaatttaatattctgaaacttttcttaatttttagattagaaaacaatatatgaccacagcaaaatttcaaataatgcaaaatagtatgaattgaaaagtggaagtcctctcccccatttctaccctagatccccaatactgctcttagaagtaatcattgttaagtgtattcctccagaaattctctatgcataatttatttatgtatgttgatatgtaatcttttcctaaaaatgagatcatattttgcatattctaaaacttgctcttttctccacagtatatatatatggcatctccctattagtatatataaacacatcctatcaattttaaagctgaattatgagaataaggaatttaagccgaacccctaacaaatgagcaacaactttttaaagttttacttttaaataactctttcgaagagaaaaaaagtctttcagacattctcctctggaaacaactagaaaactaacttcatattccccacaagatccagaagacatcagaagggtaatacatggtcaacacaatgctattatttatcttctaattgaagataagaactgattttttaaaaaatccttttcctagaaaatactgtgtgttattctaccaggaaataaaaaatctgatttcaaatgtccttatttcaaacattttatcttgttatataataaagcttcttcgtttatttatcttaggcagagaatcagaactaaagtccttccccatcaacttaaagaaatattcatgcttcagattttctacatcaaaatctagatttagctggaaaaagccctctagccactgttctttgcccattacaatttagttaacggcataaccctgcctgtggccatagtaagcacaggcagcagtcaaaccacaattggtaccttactcaaggctttctccaagcccccagcctttcttccttgctttgggcactttctcctttgactgcagaccttgactctctcacttctctgcctgggttggatcaggctggactccaggaccaagcattggcctctggctctgctggctcctgccttgggaggcctgtcatgcatgggacatcacaaatacaggtgagagagctccactccttgataccaccctagcagagttcatggcacctccaattccacagacatgggcgagagactgcactcaatgccccagactcctcaggatacgacactggctgctctgcttcaaagagaggacactgagcagcttccagaggcaacaacattcagaaatgtgtgctcagaaggcttaatcttgagcaaaccattgacccccgctaaggcttaattatcgcacttgtaacatagggctactaatagtaattatgtaataagattataataagtttaagtaaaataatccatattatattttcaatacaatgcatgatacatagtatgcccctaataagtataaatggggatgatgatgatgatgatgatggcaatgatgaagttaaatctcttcaaaacatctttggaattcctgacttccttgagcaatcaaacctgctagaatcatgccccatcacctttcctatacttcaaggaatgagatcacctagattcttccagaggaaaggcattctgataaataaataaataaataattgtgctcttaaatggtgcaaaagactcaacaaagatcttccaaaacaaggtaaacccctgatccatggagatgcttctgaggctccgcaagtgttcattgacatgtacaattttctaatattttctaatgccactcattctggggcctttttctcctttcccacaaatccgcttcatttttgaggtgttttttgtttgtttgcttctttcttgctcataccattgattccatcttttatatatttaaaacagtgaacatggctattttatgtttggtatttgataattctaacctgtcaagtctgcagatccattgtgctgtgtatagtttttggtggaagtgccttgtttcctgataagttttatgatttggtgactaggagcttactgggactggaactgtgggaattctctaaggcctgtaataagggtctgtttctccaattaccatttgcatctacttctgtcaggccagcagtgctgtcagtccaggacccctttaaattaaattccagtttgaagtgtttttatttctctatttttttctggacctcaggagaaggatgaacttagcccctagccccatgagtgcctgctataattacagattctcaagaaagacttcccactaccagtgcccaagttgaaaaggcaaatttccctggcaaattttcctcccctgggtcatgtttttaaaagccctagatttggtggcagcttcagtcttactccccactttgtaaaagccctgtgtttatttcctgcctccagaatgcagcctttatattcaaagttctgggtcgccagaaatcagcacctatccccaatggaagctaatagcttctatactggtttacctcttgggccccttgctttctctccatttcatatctctaaggattcctcttactttcttgccagctcagccatgcaattaaaatggtatgtatttttaaaattttatccaggctttttagtgttttgctttttagagataggctttttagaatatttgatccatccataatgctactagaaataaactggattttaatttcatgttaaaattttactcagtattttctccaccccattacttgaatggtttatgtttgcctctccttgtcacctgcttcaattactgtgatgtttctgctgtactttggagtccccactaatacacagttcacctctgcctgggtcttcttttctcatgctccactcatggtgtagctatggctcttcaccattactttttccaactaggttggtccaccggggaaaggttactatataattatcctttttattctatgacttcaagcaaaatttctagaacatttagttcttgacagctacaatacaattatacaaagaaagatggggattaattacattcttactaaaacaagtcatattaagtagatgatgtggaatagtataacattttatacattatctgtcacaaaatacaccacatacaaaactctctaatcatgatgccagccagctgccagccagctgaggagatttaaccatttatctcttaaaatcctttcgttatcttaaaattaattatataggactctgaaaagatccattaataactctcctttcatcatgtgctaaatacctctgtgttctttctctgaagctcaagtattggggttctgtgcctatcctcttagcctaggtttgaaccctgctctaatccttcttaggcaagcatcccagagcaggccacttcatctcttggactgtctggccctcatctgcacaatggaaatataataattcctcccctacaggactatgtcagggtttaaatatgaacccttttaaaaaccttggtacaatgccagcacataggtcatcctcaataaatggaagccataaaaacaaattctactactatctagtttttttaaaaacattcacccaatattatcataaatgcagtagtatatataataaatgaattacaactgagccaatatcagtataatgtcaggaagccaagaggtttgcttaaggaatggggattaatgtgaattgactttactaccttctttcactttatcctatgtggagccaacacactctctaagacaggcagtcgggagaaagcctaatgattctcaccttgatccagaacaatgtgtaatagctgaccacatgacttggcatcattagttccagaacatacagttctatattacttcccagtttcttaactcctattcacgttgtcaaccactctggaaaaggctcaagcttccaccattgcacaggctgctcctctgctgagaacattccatagacttcttcaggctaagacttactcattttttagatatcagctaggatgccgtgtcctccagaaagactctctgatctcactgagctccctgctctgagttctcagggaatcacctcatcatccgctgcaggaggctataagtgacctgctgatttgtctggattcccagtaatataagacgcattagcacaagaactgtgtttttcattgttcaggtcagcaataaacccaaaccctggtacaatggttgatatgacataagcattaaataaatattggttggatgaataaatgaatgaatgaaacatgcagaaaaccgtagcaaaaactgtacctgtcccataaacatcagaggcagctagaaacatcaaaagtgtttgatcactcagaaaggcctaaatatctaattgacaatctaattaaagaagtggcagagacatgtattttgaactctgtcttctcggtgaaagcgaagtagagtctaggggattttcaaaccctatatgtaaattcctttgataccttcgtaatgtctgtctatctgcctcctcacctccactgcccccagacacacacacttctccatataacacatgactcagtacctggtgcacaggcactaaatacatatgaataaccaactgcacttctgcattcccccaccaatcttaacactgcctgtggcaatagccatttcagccaagaaccagtactgagcgtccagaactccaaccttgattttgtgatgtattttaagaaatactatggttcattcttatactttactttagtcctcaaaactatgctgatttttttccccaacaattcttactccttctcagaacgcaccacaacacctgatgacaagaattgggccaagaatacagcaatccacaaagtcttgtggccttgacgccccttcttgggagagctggaaagcagccatggtactgccagctgagcaacccgacctgggaatgtatctgcccctgaagtgtgatttctcacctgtgttcatgtgaccactgggatgtggcctttctacaaggtgctttcataccacctggcttccttcttaaatactgctcattccaagcatttcttgggatggaacttcctcagcacatatgtcgggtttatctctaacctgggccaacctgtgttttcattaaaaacacataatttagaagagcaggcagattaacacctgatctttactcaatattataaacctcacacatcccaacacagaggataaccatcggggtgccctaacactcagtaaatgccaagtggcccacggcaggccttggctaaggatggttcatccacttcattatcaggaaaatgctgtggttctcccctgctgctaggtatgtgttcatggttctctatgcaggccactgattttttttcccacatatgtattttggggaatttgaagctaacgaggaagccagatgtggtgcctgagctaacacttccacgtgtatttgttcctaatatctaagaaccaacataagaataggctatgaaatgcttaaatagatggaaaagtcatgagaccagggaagagtaagaaaacctgacagagtttaacttctcttattcttggttattacctgaatttttatttttaaactacaaagcttaaaattcatgaataatacaggaaatctgtaaaatgccatttttcaggaataagcaggacattaaaatgcaaattgcagttctacacacagcggtactcaacgtgacaaattaagctcttcctattccttgtcttgacatttgccttcaagatgtttgttcaatgtagagagaaagcaagagggcaagagggagaatcagacaggatgagtggtgatacctccaggagaccagccccatgtaagaggtgcccaaggcatgaaaggtcttcatggacgccttcctctctggcacaatacgtgggaaaaaatcatcgtctgcgttactgcattttctcaggaagatcttcttaggaaaatggcatactttaataataagatacctctttagaatgagtaggacagaaatctagaagaaagtgagtaaactagaaagcttctgagctcctgttagacccttacttccacacatcactcactcaggtagattcacaaagccatcctctaaccgtgccttattcattcaacatatttactaaagaggagggcctactatgtgccagacacactggggatacatcagtaaataataagacaaaccgctgggcacagtgggtcacgcctgtaatcccagcactttgggaggccaaggtgggtggatcacaaggtcaggagttcaagaccatcctgggcaatatggtgaaaccccgtctctattaaaaatacaaaaattagctgtgtgtggtggcacgcacctgtactcccagctactcgggagacagagacaggagaatcacttgaacccaggaggcagaggttgcagtgagggagatgggatcacgccactgcactccagcctgggttatggagcaagactccatctcaaaaaaaataaaaataaaaaaaataataagacaaagctcactaccttcactggacttacgtgctggtagctgtgggtggggatttacgtcagctatagtgctaagtgctttacatatttaactcatgtaatcctcacaccagccatatgaaggaggtaatattatcattcatattttagagatgagaaattgtaaatgaatgaggaattgtaaatgaaatgtgaatattactattcacattttacagatgacaaagctgaggcacaaagaagtgaagtaatttagctagtaaactagcaaatgaacaagctgggatgtgaaaccagggactctgtctccagaatgcgcatgttaaaccactttattagactgcctctcttatgacctcttccgcttgctcccttgctatttctgtataacaataagagtatattctcccaaagtcaggatctgaggcctagttgtcttcgtaacccactactcacaacccctgtagggtccggttcgtaagtgttaaatagatattaaataaatgatttgcctttgattattaaattacccttaccctgagccggagctgcaacagtgggtgttagcaccatctagtggagaaaggcctggcaaggaagactgccattatggaatggttgacagccagcaagggattatagcaattacctgggtaactcaggtaaacatcttcatgtaggtgctttgccatcattctgcagacctctgacagctgatctgataaccccccagatttaccaaaaacgaaacacctagtacataaacagtattccaagcccaaaatagatccagctttggtatttttaaggaattaccaaagaacactttaaacggagctcttctggaaaatccatgattatggtcacaatacaatagggatgatctcaacttcttacaggaaaggcctacatatatacatctacaaataactgcactaaacttgttaaagcaaataagatcaatcattcggagaccaagaattagaatggatccagatataaagcttaaaagaaaatggttattcctaatccctacagctactggaactcaactctctttgcacattcttttactaaatattagctaattgtgatatcaatgtatcagtatgacataagattaaacaatggctctacctatactttgtttagagtaaaacaaaacaaaaattttgaatgtacttcatataagacctcttagaaaaacaagaaaaataaaggagcattttatttcagttagtcatgtttagttacttttcccctttgacaaaaagcaaagaaaaacagaagagaggaggttgatgaaaaaattcagggaaatagagtaacaggccaaagtggagaagacagaaagtgtctgcacttctagtccccacttcatagcctagcaaactcctatttatcccttaagaccttgctcaagtgtcacctctactgtaaggtccttcctatctgcaccccaccccagctacttactcccattatcgcgatcccctagcacttgatccataacactatgatgcaatataatgttatattgtcatcgtgcaccaacttatccttcttcaacagagatgatggggactttcttaagtttctcagtatatctactggctaactgactactgaaaccagaagtaaataatgatcctttgaaacaaataccatttccttcctccttctatgctctgcattgttataccacaaaaagctcctgaaagtagcataaattctcaagcaattctcaaggcctctgctttgactcttttgtgattttttttgcctacatggtcttcacaactagtcttctcaagacacaaaatcaacaatcattgaagtgtaaagaagaaaaaataacaaggtctctggttttaaatgctatttttttctcttctgcccacaataaaactgtgtcaggagggatatgccacacacacatcagtgcatctgcctgaactgaaaagaaggtggaaaggttcactgggaaaatcaaatgttctttataaatccaagtgccgagacatgatctgtttctttaaatgctgttagcaaatgtactgctgaaggttaacagacaattaagaatcatcatagttctatgaaaatgataaacaaaacagaaagatcagcctttcgtgattgcataaaatcagccacaatcaaacaaaaaaaaatcactagggaaagcactgcacttgctgaatgcattatgatggtatactgtctgtggtggctaaacatttggatttggggaggtccagagcgccagatttcaaatccatgttctgcagtggataagctgggtgaccttgaacatattatgtaatctctttatgcctcagttttcttatctgtaaaatggaaataataatagtaccatcctgggtttgttatgagcagagtgcctagcatgcaaaaagcgttccataaagattcattcatttcattatttcatttcattttttcaagaaaatatctacttagtgcacaccctacacattgtactggaaactttcatatacatcatcgcagttcaaatctagaaaaatgaaagagttagacacaatgtaccttcccagtgctaacatccttttatcctagtcatgtggaatgaaaatgtgtttccagggttcagcaaacatttgattcaagtttcattgctaaacatattaatcatttttaaaactggaataaaaagtattacccacacttgagttctttatcaaattttaatacaagggagaccccaaatgacttaatttgtgctgcctggttaactttgcttttttctggagccctcaaaataaaactttgcagtggatatatttgaactccttaaaaatgtgacaccgattaacaagactgcaggtctttttctgttttgatttgttcttttaattcagacctgtatatgtctattcacataaaatcatacaagtgaatacaatcctctggcatttgtgtgttccactcaattaagtgacaggatacattcatatggtattttctgccaaacggtgacaaattaaactagctgatgaatccgttaattgactctctaaactgaacatttaacaattaataactgcatgcacttgttacttgctgtgattttaatttgaaacaagcatttcctagccttttgagctactgtttcagttaaattgaagaagaagctatttaaaaatactgtatcagttacactaaagagcaagctattttaaaaaatactgccatttgtaactactcatccatgtaaatctagattttctcaatattatgcagagagagagagagaaagggagattgagggagaggaaaagacagaaaaagagagtaagagagagagaaaattacattggatgcttagactgatgtgactacaactgtcttccataaacaacaatttcacaggaagtttgttaaatcagcctcattgctcttttgaatggcagtaagaatcaaatctcacaaatttgaactaataaattcatacaaataaaacactccccttcatctcttccatatatttttatcaatcctacatatatatttcattttgaaaaggggcagggttcagaaaactttgtcctaagcccttctctattgtgagaaattaccatgggccagtaactgttataatttctaggtgggacacaaactcaaaaaaattatcaaatacctgaacacaagaaggtttacatttagagaatacagatatatatatatatttagaatgagacaaatgtggaaagtgccatcaaagtgtatgtgtgtatgtacacataaataatgtatattatacacaatacctaaagcagtgagggggagttagattgggggtgagtaatttcaactgggaagttaaagaaaggttatatggataacctaatactgaagttgcacattgaacactgaacagaattcaacaagaggactaagtgtaaaagaccacagaaagattcagaggtaggagattgaaaatgttcaaaaaagatgagtgccccaggtgtatgtaagcattttagtttgtgtgcattgaagggggaagaggagcgggcaatggcaaggctagcctaaattaaaatgtcatagcccccaaaattgcacttagaataaacacatatactatgtcaaatgagcccagagaagaatttttaaggttaattgtgtttatgatccctccaagtgttttatttcacttggatacgattacaatttctagtaagttgaagctgaataattttccattttatcactatcatctttcttaacaatttctcacaaacatgaaaattattccattatttgacaggggttttggctcctcaagtatgaaatatctaggcacagctgtttcttacagttctttgggatttacctgggaaatctccaaatctgttttcagtatactacaaaaagacatcaggaaattaaagagcagtaaaaagagcagaaaatcttgtggctcaaactcctcgttttcagaagcatttaccacgcagaaagattaggtgactctgttgcaaggatgaaataaaacagagtatgaagccactttatcaaaaacatgaaaaattttaaaaactgttcacacaagttcattatacaatctctgaatgacaaaaacataattatgaatccatgaatcaaattttcaaatttcttgccttccagtccaacatcacccatgtataaggcaaagtagtgcgagttaaaaataagataacaacaagtttatagttctaaagccttcagcgtctaattgggtaaatgaagaatacagcctgtaataggactcttttgggtttgtttgtgggttttcattgttttgttggggtttttttgttttgtttttggtttggttttttttggctgcagctataccagcaggaattaatcataattcttgatttatagcatattataaacatatctttttcataggatttttcaatggttacacttttaaatatatatatttcaactgtacattatatatatacacaagagagcttttttataagttgtaaagagattatggatggtccctaactaactacggcttgacttaccatttttcaactttaccattcggtatgctcctcaacttacaatggggttacatgtggataaaactatcataagttgaaaatatcattacattgaaaatatactttcagctttccatttttacatctaaaatggaaaggcttatctaataagggttctgataaacccttaaaatggatttatcagaacttatcagaatggagaaagaacagtatttcaacaactggtgctgagaaaaccatatatccacatgcaaaagaatacagttggagccttaccttataccacatgtgaaaattaacgacaaaaaaaatgaactgaagacctaaatataagccctaaaactataaaactcctaaaagaaaacataaagaaaagcttcataacattggatttgacaatgacttcttggatatgacaccaaagcacaggcagcaaaagcaaaaaattaacaaatgtgaagaaacagaactttaaaacatctgtgaatcaaagaaaacaatcaagagggtgcaaaggcaacccatggaatgagagaaaatattttcaaatcatttattcaatagaattaatatccagaatatattccggataagaacttctacaactcaacaagaaaaaagcaaataacccaatttaaaaatgggcaaagggcttacatagacatttctgaaaagaagatacacaaatctccaataatcataattatgatagggtagagaggtgaaaatcacaataacatacgggcagaacttgaaaatcaactaaaggaatcattaataaccatagaagaggataattccaggaatgcaagaagagtttaatattgggaaattacttatagtagtacatcaatatttctaattatatatatatatatttagtatagatagtgaaaataaatttaatattatttttaaaaaaacaatttttaagaaagctcaaaaaaaaaaaaaaagatcaccttggaattacagacaagtgtacaatgtacctcaactaagacactgtattagtcagggttctctagaggggcagaactaataggatggctgtatatatgaaggggagtttattaaggagtattgacacacacgatcacaaggcgaaatcccacaataggctatctgcaaggtgaggagcaaggaagccagtctgagtccccaaacctcaaaaatagggaagctcgacagtgcagctttcagtctgtggctgaaggcccaagagcccctgacaaatcactggtgtccaaaagctgaagaacttggagtctgatgttcaagggcaagaagcatgaggcatgggagaaagatgaaggctggaagactcagcaagtctagtccttccaacttcttctgcctgctttattctagccacactggcagctgattagatggtgcccagccagttgagggtgggtctgcctctcccagtccactgactcaaatgttaatctcctttggcaacacagatacacccaggaaaaaatactttgcatccttcaatccaatcaaattgacactcaatattaaccatatttaaaccatataaccaatattaacagacacaaacacacacattagcctcggcctacacagggtcaggatcatcaatatcactgtcttccacttccacatcttgtcccactggaaggtaggtgttcggggcaccaacatacaaggagccgtcatctcttgcgataaaaaatagctccttcttgaatacctccttaaggacctgcctgagattattttacagttaacttgttttctataagtagaaggagtacactctaaaataacaattagaagtatagtatagtaaacatacaaaccagcaacataattgtttatcattatcaagtactatgtactatacataatttttatttttgttttctgcttttttaaatttttttgagacaggatcttgctcaatcacacaggctggagtgcagtggtgcagtcatggctcactacagcctcaaccttctgggctcaagaatcaagcaagtctctcacctcagcctcccaagtaactgggactaaaggtgcacaccaccacacctggctatttttttattattatttgtagggatagggtctccctgtgttgcctaagctgatctcaaactcctgggctcaagcaatcctcctacctcagcctcccaaagttctgagaacaggcatgaaccactgcacccagcctatacataattgtatgtgttatacttttacacaactggcagtgaagtaggttaatttacaccggcatcaccacaaacacgtgagtaaggcattgtgctatgacgtaaagatggctacaacatcagaaatcactaggaacttttcagctccatcataatcttatggaaccactgttatacatgtggtctgtcattgaccgaaaaagcattactcagcagcgcatgacagtatatacattttctttatccattcatctgttgtggggcatttaggttgtttctatgtcttggctattgtggataatgctgcaatgaacatgagattgcagatatctcatcaacatactgatttaccttcctttgggtatataccagtagtaggattgctggatcatatggtagttctatttttaattttttgagaaacccccatacttttttccataataactgtatcaatttacaaaccaacaacaatgcacaaggattctcttttctcctaaataaaaaacaagataggaaactataactacagcacaaactcacttttcataaacatttatacgtacggaaaaaaattagcacctccttctaccatgtccaccaccactttctaaggagagtaatgacagaagtacaaaaatttagaggctctctgaatgataacaatgaaacaaatgataaaggtagaagacattatcagtttaggtgtgaaactagaagtaagaagacaggagatggcaagataggagtctacaaaagcaagaggaagatttaaagaaaaatgctctgaattagcataaagttgtaaacccaaaagttatctgaaacaggtctcaatcaatttagaaggtttgctttgccaaggttaaaaatacatccatgacacagcctcaggaggtcctaatgacatgtgcccagggtgtttggggtacagcttgcctttatacattaaggaagacataacacatcaatcaatacatgtaagatttacattggtacattggaagggcgggacaacttgaagcttgcagggatctgtgggggttgaggggtgtttccacgtcatagacagattttaacatgttctgattggcaattggttgaaagggttattatcaatagaaaggaacgtctgggttatcataaggagttatagagagcaaggttttatcacgcagatgaagcctccaggtagcaggcttcagagacaatagattgtataaatgtttctaatcagacttattatctgtgttgacgttaatgctggtcagcttttcctgaattccaaaagggaggaaggtataatgaggcatgtccaacctcccccttcctatcatggcctgaactggtttttcaggttaactttggatgcacttggccaaggagggagggttccattcagatggctgggggaatctcaggattttatttttggctgacaagcaataaatagatgcaagatactgtcacaactaactgaattattctatcaaggaacagaagtcccacaaaacaatgaggaatgtatcagggaaactgttccacaacacaaatgttccaacctatggatgtttaaataacaaaaggttgaaaagagtgaaatctttcaaaagtaatttgtgtgctttcctgaattctgaaacagcacttacaaaacaaattttagaccaggtgtggtggctcaaacctgtaatctcagcactttgaggccaggagttccagaacaccctgagcaatatagccagaccctgtctctaaataagccaggtgtcgtgacaagtgcctgtaggtcccagctactagggaggctaatgtggaaggatcacttgagcctaggagtttgaggttacagtgagctatgattgtgccactagagtccagcctgcgtgacacagcaagaccctgtctctaaaatgattaaaaaacagacaaggctaggctcacggctgtaatcccatcagtatgggaggccgaggcaggcagatcacaaagtcaggagattgagactatcccggctaacacagtgaaaccccatctctactaaaaatacaaaaataaaattagccggatgtggtggcaggcgcctgtagtcccagttactcgggaggctgaggcaggagaatggcgtaaacctgcaaggcggagcttgcagtgagccgagatcatgccactgcactccagcctgggcgacaaagcaagactccgtctcaaaaaaaaaaaaaaaccgacaaattttaatcttctcctgatgattcagtgccataatcacaaacatcaagtactgcactgtctatgataaaggtatgtcctcaaaagcagccaaattttctaggattatttctccaacactgggtccaaatttctaggtttttttcatttttatgtgtttttctgaagctttttatagcttttatcttaaacacactgagttttagagctggaaggggcctcagagaccagttcaacccacacattttacggagaaggaaactattttcttcctccaccatgaagctctggctccaatgtattcctgttttaatatgtctattgtgagcaactcatctcccttttctaattttctgcttctaatctgacaactgggaaaccagataagcaaacttgttagaattgtatcaaaaatagccataatctaaatgaaaaactattctaagaacaaaaagtaagagtttcaatgttattctgtagggtcatacattgtggtaacttgaaggcctcttttccattctttgcattttgggaaggtgtttacaagacaatactaaaggtttccaggactttcacataaatgatgctaattctctgaaaagaaactcttccccttatggactatgtgatcttgagtaaactgttcaatggctctgagtctctgtctcctcacatgtaaaaaagaaatgaattatcagggtagataactgtttaattcaatgaggtcacatgctgtctttgttcattttgtgttgctataacagaataccacagactggatcatttataaagaaaatacatttatttcttaacaattctggaggctaggaagtccaaggctgagggactcatatctggcaagagcctttctgctgcaccatttcatggcagtagacaaaagggcaagagagcataagagggtaaaagagggcaagacagggtggaactcacttttatcaggaggccactctttctataatggtattaattcactgatgagggtagatccctcatggcctaatcacctcttagtggtcccacctcttaataccatcaaaatggcaaataaatttcaacagagttttggagggaacattcaaaccacagcatatgctttaaagaaggctaaaaaaatgggagttgttgttttatctccacttcttctcaagcagcagaagaagccatgtttgcaaaagctaatactatcttcatgttatgtagctcattcaggactgggtacaatcctactcaaagcaatattgggttttccacaggaattctcaaaagtagatgtcattagaatcacctaggagctttaaaaactcctatagcctaagccccacttgcagatagtctggttaaattggactgggttgggtcccaggtataggtactttttaatatatccccaggctggacacactgactcatgcctggtgctgggaggccaaggagggaggatcacttgagcccaagagttcaaggccaacctgggcaacatactgaaacccccatctctacaaaactaaaaaaatttagccaagtgtggtggcacatgcctgagtcccagcaactcagggaccaaggtgggaggatctctttagcccaggaggttgaggctgtagtgagctgtgatcatacatgcactccagcctgggtgacagagtaagactgaaactaccactgcaaaattataactgagaaagtgacagagatctgacctaaccaactccatcctgcttctaacctccaagctgtccttgctcattcctgggtgtaggctgaatcaactttgggaggaacttagttatagtttatactttgaaacaaagataataacagccctttcccaaaacaaaccgccttcttgcccgagaactagaccgcctttgtagagctaacaaattagtcaaaagattagaaattatggtttaggagtcatgtagctggaagctacaagattctgaccctccccaaattgctcctggggataacatcactattgtaaaacctaagattagtgcctgagatattttgcaaaccctgcacttaatggatcagctggcaccatatagattgataaactggctcatctgatcttgtagcccctatccaggaactaacagtgcaagaagacggcttcaactccctgtgatttcatctctggcccaaccaatcagacctcctttgactcactgctccccaccctgacacccaccaaattttccttaaaaactctgatccctgaatgctccaggagactgatttgagtaataaaactcatgtttcccgcacagccggctctgcatgaatgaatgaatgaatgaatgaatgaatgaatgaatgaatgaagagatccccaggtgattctcataaaagcctggggtgagagccaatgctcctgagaaatacattgagcctgctgggtgtcggtatctgtctgcattagatcaaaacccctaacagccccagctgtccactggtgagattctaggctggtttcttctttgtgcttccacactgatacttctaggactccccgcaaatcatctcctgtacccctcaaattgcttgacaaagatttaagtctgatctcataccaggtatatacactggtataatggtaccagttgtttaaatataatatttccaaacttgctggcaaacagctgctgttccaagctcctgagggtcccccacctttccatcatccaccctatgacccaaatccattctgactggtcagtggtgatagttaaacattgtattatccctagctttgatgacctggtgctttgccccaccacactaaaacttagaggttgaaagtattttaagtaatgatttttaaaaaataacagatgggagaaaaaatacctccaaatcatatatctgataaagaggttgtatccagaatatataaagaactgctacaattcaataatagagccacaaacaatccaattaaaaagtggaggtaaactgtgtatggatatctcatcaaagaaattacacaattggctaagataacaccattaataagaagaaaaatacaaatttaaatgacaacagaaattctacacactcactagagtggctataatgaaaacatctaacatgacaaagtgtggtgtgaatgtgaaaacaaaactggaattcccatacattgatttgagaatgtacaaccacttacaaaagtttggccgttttcttagaaagtcaaacacacatctattagcaattctgctcatggtaatctacccaagaaaaataaaacaatgtcctaagaaatgaaaataaaattctaagcccccaactgactgaatagaacccctcttggccaaagaaaccctagagaaaccttggaagctgagtcacagtgacaagggatagattagccacgccttactatactcccaccctcccaccctcctaacagccatcaggctttcttccccaagggctaaatagaaactagtcctttcaaaagactactaccttatcttcacatgtacagaacaaatacaacatgagattaatcattccttcaccccccgagatgaaattaaccctttcttcactcctccttgagacgtgttttctctattctctttttcttcaaacattcaccttatcttacgtaaaatgtagatttactgggcactaactaaactctcacaagtatgtaatcatttgtctcactgctgtcccaccctttcccctttataaggaaaaatatataaatactaaatatcctgagaacctctttgtgaaaaacaaccatagaagcttctgttttttctgggcatgccctcagggtggctcaataaagctccatgatttgagacttatgcctcacactcatgttagcagtcatttcattaactctgacgggatctcagggaagagatcagcccctttgacccgcagcaattctcctatcagtgctggcaagagattctctctgacagattgtgcacatcaccaatgctcaaaagctgctctcttctcctgaggttccctgatctgaaatttttgatttcagatcccaaggttcattttgccacagaactcctctaaaaagggagtttgctcacttccaatggagagcagtcttcagcgtgggccccatctccaggtaaggagctggtttggggttttattttgggatttggtagctgaaggtcaaggtttattgccagctggctgtaatttctccttaagctcagagatctcaactatatgtaaattatgaaatcactttttctgttttttggttttagtctatcttccattagatttgaccaactcttcctcccagccacaatgttgactaaaactccatagttgcagaaagtcaagctccaaccccggaaacaccagctggttaaaagaaatcaatattttaccccccaaaatatatttatttgacatattataaagtggcccagccagaccttccctaatttggatctaggaaagattagctaagagtcttcattctgaaggttcccatgtaaacatgattaaataaattgtatactttttctcccattaatctgccttttgtgagttaatttttcagcaaaacttcagagggtcaaggggaaagctcctccttggcccccacaatttggcatagccagtaggatccccaaaatcactcttctcttttggaagtcagaatgaagagaactcaggaaacttacaagccagcaaataggtaagaaattcttatcagtgagcctcctggcctccttgtgcaatctgattgaacagatggttaaaaatcaccgttttgtctcaaagttttgattattgggaaaaaagggatttgtgtgactagtcttggggtgtagtgactctggtgtatttttggtactttatggtgtgaatgttcatattgtttgaccccttgcctctcagaaatagccttttttgttgccattttcctttgtctttctgtgttgttctctcataaagagcagtgtcatagggtagagaacatgggcctagaatccctataagcctgctgttcaagccagccctgcagatgagtccattttatggttctgactagaccggtgtctgtttagacaaacttcgctgtgggctcctgagagggaaactggatgagttttccctcttgtcttgttttatgtgcttgggttacttttctagtctctgccatccagatggcatgatttttcagggtcaggccagccagccaatctgaaaagactaggagtccaagacacataatattttaagtaacacactgttctgaatgtgtcaagctcttgagaggagttttgacttaaaagttccatccctccggggcttttgcagtctttcgctggcttaagtctatttctgagagagaattttggaggatcacggggattgcttcctctatgccctctccaggaatatatggtaaaaacctggaaaattaccacctgggctttaaatgaagaggcttttgaattgagtcactactggaactaagtacactattggaaataaaaaagattttagagatctcttattctaagcaattgatggaaaggttaaatttttaaaagaatccgtaatagcgttatagctagccttaaaaattctctttaaagagcaaaatctgacctaaaacaaagttaaaatcccttgtacactcaaactgcctgcttttgattccatgtgggattaacaacggaagctgctccactttgtagtctggtagttaaaattcatgatcatggaatcagtccttttggtttgatatttgtatgacttttgccacttattgatccttttcccttccatggacagcttttgatttcctgtcttccatctgtgggggcatatggtggttttgggcctttgtgtgtagatgaccagctgagaaactgagaccatagagtatatggccagacagacaaaaatgagttgtaccccatttgtggccttttttttttttttttttttttgctgtctttggtgtcattctgttaccagcagcagatccatatgggcctaaagcaacctcagttcttgcctcctcagaagaaagaatttgtctgaggggtataaaggagaagaagataccaaagcaagtcttagagtaagactaaaagtttatttaaaagctttagagcaggaataaaaggaagtaaagtacacttggaagagggccaagcaggtgacttgagagatcaagtgtgccattcgacctttgacttggggtttgatatgttggcatatgagggtcttgtgtcccttctcccctgatctttcccttggggtagggtattcacatgcgcagtagcctgccagcgcttgggaagggtgtatgcacagtacgtttactggagttgtacacatctcacttgaggtgtttttcccttactagttgaatatccctaggaggtcaaatatcacttaaactccactatttgccatttgatgcacaaggttgaacccactcgccccactcctgagatcttatcaggaagctgctgatcaccagtttcaggtgtttctgtttatcgggagaccgccttttcctgagtctggctatgaccaattattattttggagagagagttaacaactgcctgaccatcatctgatggttgcctgacattcctggtgttggggagaggagccctatcctgccctggtcatgtctgactacctacctactgtaacaattctggatcttaagaggactgctttgcactgctttggagatactttgtgtgttcttggctaagccataatggtacgaacaggaggcaggaaaatactgggtaggagagggcagagtccctggcaagggttccacctgcaagcctgtgcctgtggccctaaatgagaacttcacatccctgtttctcccaccgagtgttgctttttccaaaaccacctgggcctgctatgcccccaacctataaccataaaaaccccaagctccactggcagaggagcagagcagtgtggcagagaaggagaaaagagaacaagcaactgaatgttgagatgagaaggagcaactgagcatcagagactaggaaaagatgcagcttaacttcagaagacaagacttcagagaggagcccagacatagatggctgggcttcagggaaagatcaccttcttcccgcaccatcccctttccagctccccttcagctcagagccacctccatcactcaacaaaacctccacgttcaccatccttcgagtctgtgtgacatgattcttcctggacaccagacaagaacctgggtaccaagagggcagggtatatgtctccccactgagctagttaacacttagccatctttggacagcaaataccaaaagagcattgtttgtaacacatgccctctggggttccagaggttgtgggcaactgctagaatgtgccatgggctggtacgggttcattcctgccagcgcctaaaggcactccccccagctcctgcacctgctcacctgcatgctccccctcccacaagaggtttgagctcagcagctgagcaaaacgagccaccacccctccccactccttcaggtttggtaaaggagttcaaaggccagaaatatcagctgtttatcccaggtaataagagatctgaaagaatttttttcttttaaagacttctatggttagcagtcagcttcattaaaagctgatatctaagctataattacaatttttttttaaaagagctttatgctgtttctctttttggatcctgtcttggggatttttatttatttattttttctgaatcctgtctgttcctccttcctcttgcaacctccaatgtcatagaagggaccaaaagaaggggaggaatttctgacaatctaagatcttttggggaaaacataaaagttgacaaagactcctctgttgggaggaaaattttgtttttccttatgaaaacccaagagttgtaagcagacagatgcctctcaggtctaaaactctgcactgttttatattgcattacctggtctctagcttttgcagggtaccagatattactttgtactatgaaaggtcttgacattggtgtgtgcactggctggtgagttgggcaatagctacaatgttaggggtggctgaagacagttatttacaggaaatggtcattactatagggggctactcatttctttgcatgtttggatgagaaaagcatggtttgggccctaaaaaccacatgctttattgtccctgttccttaaaggactccaccctgaagccagttatctaaataacacacaagctaagttgaaaaagaacacctattaaattaaatcagtctttgaatctctttgtgaaagaaatttacatctttaaaggaaatcatcatttgtaaatgcacctctgtctctgcacctaaaccgctaggaagtttaactacagggaagacagtgtcttaaagttaacataacaaaccttgcttgcctttgttttgttctaagttctgtgcctttgaggtatgcattttctactttctctcccctaagagtcatgtgtttggagatgcaaatgtagagttgcctagctaataattgttttaaggtatgaaacaggtaataaagagattgatactctaaattaggggagagaaattttttgaaacctgacaaatgaaaaatcttataactctgtaagatctgcttctatgtgtctatatgtttctatgtggcatgtgtatgtgatgtttcactaccaaattttatgaaagcactctaatcaataggcttaaaggaaattaagtgcttaaatcaaatatcagaacaacatgctagcccaaatgcctgttagctcatgagactttaggaatctttgataagtaaaactagttgtaaaatttctttagtaatttaaaatctagagatcatgttatattaggtaatcccaggtttttcactgtaaattagggttacttagttagaatagttgttaataaatataattaaaactactagatataagagaattctacatgcagagttcataaagaaactaagatgcgttttggtaaaggttataaataacatgaggatgtggttttttgctaaagaaaaagtaaatttgtctagtttggaggctacataaagatttcttcaaaatgaagaaaaaatgagacagataaaattaaatggatagaaagagaaaggataaaagggtagggaatgaggaacccttgacggggtcatccatggtatggagctgcagctgtgctgtattaagttcctaaaggtaggctgggcgcggtggctcacgcctgtaatcccaacactttgggaggctgaggtgggcggatcacgaggtcaggagatcgagaccgtcctggccaacacggtgaaaccccgtctctactaaaaaatacaaaaaattagccgggcgtggtggcgggcgcctgtagtctcagctacttgggaggctgaggcaggagaatggcgtgaacccgggaggcggagcttgtagtgagccgagatcacgcctctgcactccagcctgggcgacagagcgagactccatctcaaaaaaaacaaaataaaaaaatttaaaaaataaaaaaataaaaaaaaagttcctaaaggtaaaagttaccagtggagtttagcaatggatccagctcctggggaactggttcacaagatacatgaggaaatgcaaactaataaggaaaaagagaaacattcaatcccttggttattgttatctataatagctaaaacaaaagtaaaagagtgtgctgggctgggccttggccaaaccaagttctgatgagggactgtctgatctcagatcaccagcctcaaagccacctgcaaaggggaaagatagactggggcaacaaaaagtacctctgagacctgtgattaccaagaaggtagctaatgtgagggaagggtaaaaccaattaactactgaaaccagagggcataatgtaaaggaactgttccattttgcacatcagtatcatcagcttcctaaaaaacctttactaaaacggattgtaacagtgactgattttggagtagtatcttgcattttaaatacgacagagtggaaaaaagatgtgtaggttgatgcaggacacacagctcactactgaaaaatcacagatgggcaaatgtgatacagactgacaggagggtattcttagagaacagctgatatagaagttagaaagaaattattgggctgggcacggtggatcacacctattgtcaggcctctgagcccaagccaagccatcgcatcccctgtcacttgcacgtacacacccagatggcctgaagtaactgaagaatcacaaaagaagtgaatatgccctgcctcacctcaactgatgacattccaccacaaaagaagtgaaaatggcctgttcctgccttaactgatgacattgtcttgtgaaattccttttcctggctcatcctggctcaaaaacctcccccactgagcaccttgcaacccctacgcctgctcgccagagaacaaaacccctttgactgtaattttcctttacctacccaaatattataaaacggccccacccctatctccctttgctgactctcttttcggactcagcccgcaggcacccaggtgattaaaagctgtattgctcacacaaagcctgtttggtggtctcttcacacggacgcgcatgaaatttggtgccgtgactcagatcgggggacctcccttgggagatcaatcccctgtcctcctgttctttgctccgtgaaaaagatccacctacgacctcaggtcctcagacccaccagcccaaggaacatctcaccaattttaaatcgagtaagcggcctcttcttactctcttcttcaacctctctcactatccctcaaccactttctcctttccactcttcaatctctcccttctttcaatttcaattcctttcattttctggtagagacaaaggagacatgttttatccgtggacccaaaaccccggcgccggtcacagactgggaaggcagccttcccttggtgtttaataattgcagatacgcctctctgattattcacccacgtttcagaggtgtcagatcacgcagggacgcctgccttggtccttcacccttagcggcaagtcccacttttctggggggggcaagtaccccaaccccttctctctgtgtctctaccccgtctccacctttctggggggcaagaaacccctaacccttctccttcactcttagcagcaagtcccgcttttctagaggaggggcaagtaccccaaccccttctctccatgtctctacctcttctccgcctttctggggggcaagaaactcccaaccccttctccttcatccttagcggcaagtcctgcttttctgggggaggggcaagtaccccaaccttgtatctctgcgccccgatcccttatgtccatgccccgacctcttatatctctgtgctccgatcccttatttccacgccccaacctgttatatctctgcgccctgatcccttatttccatgccccgaccttgtatctctgcgccccgacccctttcccacttttctggagggtaagaacccctgaaccccttccctcctgtctctatcttttctctgggcttgcttccttcactatgggcaaccttccaccctccattcctccttcttctcccttagcctgtgttctcaaaaacttaaaacctcttcaactcacatctgacctaaaacctaaatgccttactttcttctgcaatgccacttgaccccaatacaaactcaacagtggtaccaaatagccagaaaatggcactttcaatttttccatcctacaagatataaataattcttgtcgtaaaataggcaaacggtctgaggtgcctgacgtccaggcattcttttacacatcagtcccttcctagtctctgttcccaatgcaactcgtcccaaatcttccttctttccctcccgcctgtcccctcagtcccaaccccaagcatcactgagtctccaatcttccttttctacagatctatctgacctctcccctcctcgccaggccgagctaagtcccaattcttcctcagccccctcttctccaccctataatccttttatcacctcccctcctgacacccggtctggcttacagtttcattccgtaactagccctctgccacctgcctagcaatttactcttaaaaaggtggctggagctaaagacatagtcaaggttaatgctcctttttctttatcccaaatcagatagcgtttaggctctttttcatcaaatataaaaatccagcccagttcatgactcgtttggcagcaaccctgagactctttacagccctagaccctaaaacatcaaaaggctgtcttattctcaaaatacattttattacccaatctgctcccaacattaaataaaactccaaaaattaaattctggccctcaaaccccacaacgggattaattaacctcgccttcaaggtgtacaataatagaaaaaagttgcaattccttgcctccactgtgagacaaaccccagccacaactccagcacacaagaacttccaaatgcctgaaccgcagcggccaggcgttcctccagaacctcctctgccaggagcttgctacaagtgccagaaatctggccaccaggccaaggaatgcctgcagcccaggattcctcctaagtcacgtcccatctgtgcaggaccccactggaaatcggactgtccaactcacctggcagccactcccagagcccctggaactctggcccaaggctctctgactgcttcccagatcttcttggcttagcggctgaagactgacactgcctgatcacctcggaagccccctagaccatcacggactccgagcttcgggtaaccttcacagtggaaggtaagtccgtccccttcttaatgaatacggaggctacccactccacattacctccttttcaagggcctgtttcccttgcctccataactgttgtgggtattgacggccaggtttctaaacctcttaaaactccccaactctggtgccaccttagacaatactcttttaagcactcctttttagttatccccacctgcccagttcccttattaggccaagacactttaactaaattatctgcttccctgactattcctgggctacagccacatctcattgccaccttttcccccacttcaaagcctccttcacatcctcctcttgtatccccccaccttaacccacaagtataggatacttctactcccttcttggtgaccgatcatgcaacccttaccatctcattaaaatctaatcacccttaccccactcaacgccagtatcccatcccacagcacgctttaaaaagattaaagcctgttatcactcgcctgctacagcatggccttttaaagcctataaactctccttacaattcccccattttacctgtcctaaaaccagacaagccttacaagttagttcaggatctgtgccttatcaaccaaattgttttgcctatccaccccatggtgctgaacccatatactctcctatcctcaatacctccctctacaacccattattctgttctagatctcaaacacgctttctttactattcctttgcacccttcatcccagcctctcttcgctttcacttggactgaccctgacacccatcacgctcagcaaattacctgggctgtactgccgcaaggcttaacagacatcccccattacttcagtcaagcccaaatttcttcctcatctgttacctgtctcggcgtaattcttagaaaaacacatgtgctctctctgccgatcgtgtctgactgatctctcaaaccccaacaccttctacatcctaggcatggttagatactttcgactttagatacctggttttgccatcctaacaaaaccattatataaactcacaaaaagaaacctagctgaccccatagatcctaaatcctttccccactcctttttccgttccttgaagacagctttagagactgccccaacccgagcgctccctgactcatcccaacccttttcattacacagagctgaagtgcagggctgtgcagtcggaattcttacacaaggaccgggatcgcgtcctgtagcctttttgtccaaacaacttgaccttactgttttaggctggccatcatgtctccgtgcagtggctgctgccaccccaatactttcagaggcccttaaaatcacaaactatgctcaactcactctctacagctctcataatttccaaaatctattttcttcctcacacctgatgcctatactttctgctccccagctccttcatctctctgatccacctgacgttcaccccatttccccacatttccttctcccctgtttctcaccctgatcacacttagtttattgatggcagttccaccaggcgtaatcgccacacaccagcaaaggcaggctatgctatagtacaagccactagcccgcctcttagaacctctcatttcctttccattgtggaaatctatcctcgaggaaataacttctcagtattccatctgctatgctactactcctcagggattattcaggccccctctcttccctacacatcaagttcagggatttgcccccgcccaggactggcaaattagctttactcaacatgccccgagtcaggaaactaaaatacctcttattctaagtagacactttcactgaataagtaaaggcctttcctacagggtctgagaaggccaccgtagtcatttcctcccttctgtcagacataattccttagtttagccttcccacctctatacagtctgataacagaccagcctttattagtcaaatcagccaagtagtttttcaggctcttagtattcagtgaaacctttacatcccttacagtcctctgtcttcaggaaaagtagaacagactaaaggtcttttaaaaacacacctcaccaagctcagccaccaacttaaaaaggactggacaatacttttaccactttcccttctcagaagtcagacctgtcctcagaatgctacagggtacagcccatttgagctcctgtatagacgctcctttttattaggccccagtctcattccagacaccagaccaacttagactgtgccccaaaaaaacttgtcatccctactatcttctgtctagtcatactcctattcaccattctcagctactcatacatgccctgctcttgtttacactgccggtttacactgtttctccaagccatcacagctgatatctcctggtgctatccccaaactgccactcttaactcttgaagtaaataaataatctttgctggcaggactatgctgaatctccttaggcactctctaatcagatgtcctgggtcctcccaattcttagaccttttatacctgtttttctccttctcttattccatttagtttttcaattcatacaaaaccatatccaggccatcaccaatcattctatacaacaaatgtttcttctaacaaccccacaatatcaccccttaccacaaaatcttccttcagcttaatctctcccactctaggttcccaagccaccccaatcctgctcgaagcagccctgagaaacatcgcccattctctctctccataccaccccccaaaaattttcgccaccccaacacttcaacactattttgttttatttttcttattaatataagaaggcaggaatgtcaggcctctgagcccaagccaagccatcgcatcccctgtgacttgcacatattcgcccagatggcctgaagtaactgaagaatcacaaaagaagtgaatatgccctgccccgccttaactgatgacattccaccacaaaagaagtgaaaatggcctgttcctgccttaactgatgacattgtcttgtgaaattccttttcctggctcatcctggctcaaaaacctcccccactgagcaccttgcaacccccactcctgcccgccagagaacaaaccccctttgactgtcattttcctttacctacccaaatcttataaaacggccccacccctatctccctttgctgactctcttttcagacttagcccgcctgcacccaggtgattaaaagctgtattgctcacacaaagcctgtttggtggtctcttcacacggacgcgcatgaaacctataataccagcactttgggaggccgaggcgggccgatcacctgaggtcaggaggtcaagaccagcctggccaacatggtgaaaccccatctctaccaaaaatataaaaattagccaagcatggtagcacacgcctgtagtcccagctactggggaggctgaggccacagggtcgcttgaacgcgggtggcagaggttgcagtgagcaaagatcatgccactgcaccccagcctgggtcatggagtgagactccgtgtcaaaaaaaaaaaaaagaaattatttagatagtgagggttcgggagtccttggtaaggttttcctttcaatgaaaagcagccccaaaatcatttcttttctaacaaagagcaacctgtaaaatcaagctgcagacatagacacacaagctagaagcttgcaagggtgaatgccagcagctgtgccaataggaaatggctacctggggctaggcaggttcaaaatggcatctccatcttcccttctccttgccaaaccacatgtacagtaaggaaaagacagcatggcgctggccaggcaaagactccatttgcctaataagattagggtgggacgaccagcttcctcaccagctatgtaaacatcgcacctggtccaaccaatctatgggccctatgtaaatcagtcatagcctcctcaagcctgtctataaaatccggtacactccacagtgggccagaagtcccattcaggtgcccctctctttcgcaagagagagagctgttctcctttctctttctttagcctattaaacctccgctcctaaacccacttcttgtgaccacttaattgatttccttggcatgagatgacaaacctcaggtatttactccagacaatggtgctgtttcatagctagcctagtggactggataaaagccctaagaaggggaactatccaactctacttagtaatgccaagtggagcacgccagatgcagctgctgatgtgcttcatctacaagccatgagggactcactttatgatgataggaatattcacccactaaatatgcccattacctagttcatgataaatgctgtggttataggggctaaaggggctccttccaaatgggcaccctatgtaatgctactcctactgttgtccagaacaacacgagaagccgtagcaaattggctgtttcagcttcccctcatgggtcttacagatgctaataatacattaaagtaattaagaagagcatggggaaaagcaaaagggagagtcaaaggactcattccaggaaggtggaaatttttaaatggttattctaaaaaataaggtgaagaaagaaaacaatgatagaaaaacaatgaaactcagagaagaaatgagagagaaacatgggattcatcccatcagggtagtagaagtctttagatggttattaagaaattaaacgaataaaatagaaactgatggggttaaaacaaaggtcttagtacaacattaccaagggctggatggaccaaagggattttgctagttccccagcattaaagggccccaaacctttttattccctttaccctagattggagaaatttttttaaaaagtcaaaagacaaagattacaatgagaaagctggccaataattgcctggggcatagtgaggcaggtgaaccaagatatggattgacaaaagggcctaagtcccttggctcaacctcctgctgggaacccaggtccttttcaaaagaaagggtaaaacggtcataaaagaagtttctgggaccagaatgtaaaaatgcaggattgcaaaagttggattttttttttgtttttttttttgttttgttttttttgagatgtagtctcactctgttgcccaggctgaagtgcggtggtgcgatctcggctcaccgcaacctctgcctcttaggttcaaccaattctcctgcctcagcctcatgagtagctgggagtacaggcgcccaccacctcacctagctaatttttgtatttttagtagagacagggtttcaccgtgttggccaggctggtcttgaactcctgacctcaggcgatccacctgcctcagcctcccaaagtgcttggattacaggcaaaagttggaatgtttaaacaggcattttctaaagtgattgtgtcttctttacctaaatgtttataaaaatggatcttgtatctgactgggagaggtttcccctacctagtactataaaacagaaaggatgtaaatgcgcccctcaggcaatattaaatggacatgtgcgggcaggagaacaacacatgctggggccttttgtggggggcctgagggagagcattgggaagaatagctaatgaacactgggcttgacacctgggtgacgggatgatatgtgcaactggccatcatggcacacgtttacctacgtaacaaacctgcacatcctgcatatgtactcctgaacttaaaagttgaagaaaaaaaaaatggacatgctaaatgagaaccagtaagattgcccaagcccacagagtggagagtaaaagctagaatgctggtgggaacaaattctgtactttgatagccctttgtagagcatttattgcaggttttggcaaaagtctgtgagcacttcccaatgatgattactgagactttaagagaatttccacttgaggagcatttactgccttgctaagggacattaagtgaagctatccctatgctaacagggatagcagtgccccattgaagtgcccagggttccctaataaaatggaaatggtttatataggatgatgccatctggagtgtacaacgaggagatactcatgagcaaagagctactttctccctaggactgcgtctgaagctatgcgaggagctcctggattttacattacccaataaatagctctcacctgactgataaagagctgcttggtttgtggatggtagctccaagatgaaaggacaatgtcctgcttggaaggctgctactctgattgtaaagcatacttttgtgagcagaatatacctctctgagttctccaaaatttggaaactatctgtgagtattcctgaaacttattttgcacataaattggccatactatcatttctttttagtaaaaaaggagagattagagagagagaaattctatttcaaaggaaaactataacacaattattattggattccagctgtgacttttgttttgaattattatttttctgcagtgggtctctaaaaaagaacctagttataattttcttcatgatgtttttagttagctctctcatggaataagttcctcttccattctgacatataaattctcttttgtcaaatgattaatgttatttatttccccattgtttcacttcgtctgagaaaactgaagttgcggtgttttgaaaactacagatgatttaagagcctatgaatctccctaatttgatatcccaccgggcctgatctgtttctccttgccaatcccctgctgctaaaactatacaagcaccctccctctaagcccggggactatcatggaagaagcgggcacatgaaactgttaggtctggttttcagggatataattaattcagaccctacaaataacctggccttttggctttggtttttagctcttttattgcataaaaggttttaaacattgatgagtgcctgccctctatgccatctggcctagaacacttaaattggctgttaagttttttggctctatgtctcttggccacaagggccccaccaagggacaggacggacctgaagcagatagccataccacctcagcaacaacatgggacaaaatgaaagtgtggccactgatgctgcctctggccaatcttagccaaaagggggaaaaatgagaaataaaaacaattctaaacatccaacagactgaacacacctcctcttggccaaggaaaccccagagaaacctgaaaagctgagttcacagccatggtgaaatgggaagttggacacacttcctgatactcccaccttcaggggagccatcaggctttcctccctaagagctaaaaagaaactagtcctttcaaaagactactagcttatcttcacagggacacaacaaagacaagattaaacatgctttcacccctccctaaggtaagatgagattaatcattccttcacccttccctgagacatatgtttcctctattcccattttcttcaaatgttcaccttatcttatgtaagatgtagatttactgggcactaactaaactctcataagtatgtaataatttgtctcactgctgccccatcccccaccctttttaaggaaaatgtaaaacactaaacttcctgagaacctctttggaaaaagtcataggtgcttctgtgactcaagattttcctgggcaagcccttaaggtggctcaataaacctcaatgatttgagacttgtgccttaatcactcatttcggttgtcagtccacagaaaaaccggtatataaatgttcataatataactagtcataatagcaagaaagtggaaacatttcaaaatgtctttcaactgttgaaagaataaacaaaatatgctatactcataaaacaatctattcagaaaacaaaatgagctactgatatacactgcaatatccatgaacctcaaaactatgtaaagtgaaagaagatatacacaaaagaatacatattttatgagtctatttatagaaaaggcaaatctatagacagaaagtgaatggttgcctggaactagaggacagaagtgggtatagactataaaagagcactgggaacttttgggggttgctgtggtttaaatgtgttcatatgttggaatcttaatccccaacgcaaccatggtgggaggtggggccaaatgggaggtgtttgggtcattgagggccctgcctttattaacgtaacattgttctgcactcattaatgtaacactgttatcacaagagtggtcttgatataaaagtgagtttgcaactggtgcagtggctcaggcctgtaattccagcactttgggatgctgatgctgaggtcaggagttcaaggccagcctggccaacatggtgaaatcctgtctctactgaaaacacaaaaattagctgggcatgatagtgcacacctgtaatgccagctgcttgggaagctgaggcagaagaattgcttgaacccaggaggtggaggttgcagtgagccgagatcgcaccattgcactccagcctgagcaacacagtgagactccatctcaaaaaaagaaaaaaagtgagtttggcccctgcttcctctcatgttctcacactctcttggcctcacactctcttattcttccaccatctgccatggaatgattcagcacaaaggcccccactagatgctggcaccatgttcttcaacttcccagcctccagaaccatgaactaaataaacttctagagtttaaaaggtatagattggatttgtgttcccacccaaatctcaggtcaaattataatccccagtgttggagaaaaggcctggtggaaggtaactggatcatggaggcagacttcctcccttgctgttctcatgatagtcagtgaattctcatgagatctggttgtttaaaggtatgcagcacttcccccatctctctcttcctcctgctccagccgtgttaagacatgcctacttcaccttctaccatgattgaaagtttcctgaggcctccccagccatgcatcctgtacagcctgtggacccatgagccaattaaacttgctttctttataaattacccagcctcaggtaattctttatagcagtgtgagaatagactaatacacataaattagccagtctcaggtactgttacagcaacccaaaatgaagtaagagatattaaaaaatgttctaaaactgaattgtgttgatagatacaaaactctaaaaattcactcaaaataaatgacctatatacttatctatacccacttaccctgggtaattttatgatcttgaaattataccttactgaagctgctaaacaataaaaactttttaaaaatatatataaatataagtctacacttctaccccttcttagaaattctctcctcctcccttatcactaagctgcctctttaaacagagatgcctagggctggggatgcaaagcccacaggaatctgctgggtttcaaaccttttttttgaacagagtacatcatccctttttaatttctcctaaaatatccattgatttgtaggtaatgtagtgttacaaccccaaattgcctcacgaaggctttgcctgatagttggtttctatttctggggccaactcacttctaattgtcctcttggtttctgagatcactttttctctgacactggatttagttcagcctcattccttagaacaaaaccttgcaataagaaacacaaataccaccacagaccccagaccaggaatcattcagattggcatcagctagcttcccactagctttgaggaagggtggagtttaagaagtgtttcacaaactaaaaggcttatcccagagattcccatcttaaaaaaaaaaaaagaacatcttttaaatgtcaaaacatttttgtaacccacatttagtagtgattttattttagtatcagttgattgaaaaaaatacagaatgacaaaaagctactataatagcttaaatgctcttaagtaaatttgcattttattaatcataaccatatctacatttatcaggaaggaaaatctatttaaaaaaagaaagaaattcttgcacaagctgcttctgcattctggggaagcacagaattcacccctgggggaataagtcagtcttttgtttggtatggcacagtctttaggctgtgaaagggatggctctaggctagtctgacagttgagtcaggctgaaaagagataaactgttctgcataatgaaataataaagatttttaggtggtcccctggtaatttaaaggagtgatggctttttgattttctttttatttagttgttgttggcagggaagtagggacgagaaagaagaatctgaacacggtgttcagaagttttggggagaaaagttttcatgggaagagttgttgaacataacttcagaccaccattagtgcttagtgcaaagatctggacactcccagacatcctgatttacaaagggggatacctgctgtaagaaatgtgccttctagtaattttcttgagttaaccctttggaatcaaaagaactaaaaatgagttttatacatacaggaagaagatcccaagcagctgaactagtactgtacacagaacaaaacgtcaacataggtcctacaagacagtcccactgagtctgtccattgaaaggacaattgtaacatcctagcactacagtaaaggcaacacagatgttccttggcttatgatgggcttacaaagcatttacccagacagaaccccatcataagatgaggaggtactaaatgtatattgcttttgaaccactaaaaagttgaaaaatagtaagtggaaccatcctaagttggggactgtctataatctctttacaacttatttttaaaaagctctctagcatatacatttttaaaaacttaaccatcaaaaaaccctatgaggaaggtattatcaacccagttttacaatgtggaaattgaggctcatgtggaataaaattatgtgttatatctcataagaaagtcacagagtagcaggaggtggaacaaaatggatgaatacaagcttccaccaatcatcctccctgaagaaatatcaagtttaacagctatctacacactcacacaaacacacacacacatgcacacacacacacacacacaagcaccttcataagaaccaaacattaagtgagtaatcacagtgcctgattttaacttcatatcactgaaagaggcactgaagagggtaggaaagacaatcttgaattgctgatgccatcccttccccaacccccagcagcagccccaaagcatagagaatccgtgcacttgggggagaaagagcacagtgattgtgggactttgcattggaactcagtgctgtctgtcacagtgaaaagcaaccctggccagaactcagctgaaataaatggagggagcatttaaaccaaccctagccaaaggggaattgtccctgccagcagttagaacttgagttccagcaagccttgccactgcaggctaaggtgctctggggtcttaaacaaattagaaaggcagtctaggtcacaaggactgcaactccaaggcaattcctagtgctgtgctgggttcaaggccagtggacttcggggacacatgacctagtgagacaccaaccagtacagccaagggaattgacgtggtttgatgttaggtgtccccacccaaatctcatgttgaattgtaatcttcagtgttggagaaagggcctggtgggaggtgactgaatcatgagggtggacttccccgttgctattcttgtggtagggttctcatgagatctggttgtttgaaagtatatagcacctcccccttcactctctctctctctcctgctggcaatgggaaagacatgcttgattccctttatttctgccatgattttaagtttcctgaggcctccccagccatgcctcctgtacagcctttggaactgtgagtcaattaaacctcttttctgcataaattaccgagtctcaggtagttctttatagcagtgtaatcacaaactaatacataaaattggtaccaggagtggggcattgctataaatatacctgaaaatgtggaagcagctttggaactgggtaataggcagagtttagaacagtttgaagggatcagaagaagacagaaagatggtaggaaagtttggaacttcctagagacttgttaaattgttgtgaccaaaatgctgaaagtgatataaagaataaagtccaggctgaagtctcagatggagatgaggaacttattaggaactgaagtaaaggtcacacttgccatgctttagaaaagagactggcagcattgtgcctacccctgccctagagatctgtggaactttgagcttgagaaagatgattgagggtatctggcagaagaaatttctaagcagcaaagcattcaagacatggcctggctgcttctaacagcatatgcttgtattcataagcaaagagatgatctgaaactggaacttatgtttaaaagggaagcagagcataaaagtttggaaaatttgtagtctggccatatggcagaaaagaaaagcccattttcagggaaggaatttgagttggttgcagcaatttgcataagtaaagaagagcctgatgttaatagccaagacaatggggaatatgcccctagggcatttcagagactttaacagcagcccctcccatcacaggcctggaggctgggagggaagaatggtttcatgggccaggaccaggaacctgctgctctgtgcagcctcgagacatgtcacctggtgtcctagctactctgctccagccatggagccacatctaaaagaggccaaggtacagttcaggccactgttccagagggtgcaagccagaagccaccaaggcttccatgtggtattaagcctgtgggtgcacagaaggcaagagatgaggcttgggagcctccacctagatctcagatgatgtatggaaatgcctggatgtgcaggcagaagtctactgcaggggcaaagccctcatggagaaccccttctagggcagtgtgtatggggaaatgtggagttagagtacctacacagaatccccactggggcactgcctcgtggagctgttagaagagggccactgtcctccagaccccagaatctaccaacagcttgcaccatgcacctggaaaagctgcaggctctcaacaccagcccataaaagcagccgagggggctataccctgcagatacacaggggtggagctgcccaaggccttgggagcccatcccttgtgtcagtatggcctacaaatgagacatggagtcaaagaatattattttggagctttaagatgtaatgactgccctgctgggtttcagacttgcatagagcctatttgtttcggctgatttctcccgcttggaatgggagcatttacccattgtctgtactatcacagtatcttagaagtaactaatttgttcttaattttacaggctcatagtggaagggacttgccttgtttcacatgagactttggacttggacttttgagttgatgctggaatgagttaagactctgggggactgttgggaaggcatgattgttttgaaatgtgagaaggacatgagatttggaaggggccaggagcagaatgatagagtttggctctgtgtccccacccaaatctcataatgacctacaatcttcaatgctggaagagaagcctggtgggagttgattcaattatgggggtgaaaatcccccttgctgttctcatgatagagttctcatgagatccagttgtttgaaagtgtgtagcacctcccctttcactctctttttcctgctggccatggggaagacatgcttgcttcccctttgtcttctgccatgattttaagtttcctgaggtctcccaagccatgcctcctgtagagccttcagaattgtgagtcaattaaaccccttttcttcataaattactgagtctcaggtagttctttatagcagtgtgatcacagagtaacacaggagggcttgtactaaccatcccccaatcccaggcagtgcagcttgcagctctgaacaagattccttccttccacttaaggagaggagagcgaagagcaaagagttgtcttgcaatttggatatcagctgagccacaacaggatagggtaccaaacagagttctgaggtccccattccatttcctagtgcccagatgacatttccagacacacattgggtcagaagggaaaacactgtcttgaaggaaaggatgtagtccttgcaggattaataacctcctgactaaagagcctttgagccctgaataatcagcagtggtatctaggtagtacacactgtgagccttggatgagactctgagatgtactggcttcaggtgtgacccagcacattcccagctgtggtagccaaggggagggattccttcttgggaaaagcagaaaaaagagtaaaggggacttagtcttgcagcttagataccagtttggccacagctgggtagagcaccaagcaggcccttggtgttccctaattccaggccttggctcttggatttctggacctgtcctgggccagaggggaacatatttccctgaagggtgagtcccaatcctggaaacattcaccacaagctgactgaaaagctcctgggccttaagtgaacatcagtggtagcctggcagtattcctcatgggcctggggtaatggtggctatggggagagacccctcttcttgtggaagggggagggactattgggaaagacattgccttgtggcaccagcacagatttctttggtttctgacttcaggtcctggctcctgggtggcttttctgggcccatctggggccctggggaactccactccctgaaggggaaggctggctggctttaccacctgctggctgtagagccctagggccttgagtgaatacaggcagtagccaggtagtggttacagtgggccttgggcaagactcagtgttttgacccagggcagtcccagtggtggtgaatacagggctacttatataacccctttcccagctccaggcaactcaacacagagagagaagctccatttgtttaggagaaagtaaggcaagaatatgacagtctctgcctggcaatccagagaattcttcaggatctcatccacaaccaccaaggcagtacctctatgagtctgcaggcttgtacctctatgagtctgcaggcttatacctctacaaggctgccgcctaatgcagacatggcggcagtgaccaaaaacttagatcacaacatccaagtcccttcaaatacctgaaaaaccttcctaagaaggatgggtacaaacaagcccagcctgagaagactacaataaatacctaactcttcaatgcacaaacaccaacaaatatccacaagcatcaagatcacccaggaaaatatgatctcaaaaataaactaaataagtcaccaggagccaatcccagagagatggagatatgtgacctttcagacagagaattcaaaatagcagttttgagaaaactcaatgaaatttaagataacacagagaaggaatttgggatcttatcagataaatataacaaaggaattcataatttgaaaaaatcaaacaaattctagagttgaaaaatgaaattgacatactgaagaatgcatcaaagtctcttaatagcagaactgaccaagtatcagaaagaattagtgagcttgaagacaggctatttggaaatacacagtcagagaagacaaaatgaaaaaagaatttaaaaaatgaagcacacctacaagactagaaaatagcatgaaaggggcaagtttaagagtcactggccttaaagaggaagtggagagagagatagggattgaaagtttattcaaagggataacagagaacttgacaaacctagagaaagctatcaatatccaagtaaaagaagattaaagaatgccaagcagatttaacccaaagaagactacatcaaagcatttaataaactcccaaaggtcgaagataaagaaaagatcctgaaagtagcaagagaaaagaaacaacatactatgagctctaatatgtctggcagcagacttttcagtggaaaccttacaggccaggaaagagtggcatacatatttaaaatactaaagaaaaaaaaacttttaccctagaataatatatctggtgaaaatatccttcaaacatgaaggagaaataaagacttgcccagacaaacaaatgctgaggtattttatcaacagcagacctgtcctacaagtaaacggaattttttcagtctgaaagtaaaggaagtaaatgagcaataagaaatcatctgaaggtataaaactcactgataataataagtaaacagaaaaacacaaaatataataacactgtaattgtggtatgttaactactcacctcttgagtggaaagactaaaagatgaactgataaaaataataattttaaggcacagacagtactataagatataaatagaaacaacaaaaagtttaaaagcaagaggatgaaggtgaagtgtagagtttttattacttattgcttgtttatgcaatcagtgttaagttgtcataagtttaaaatactggggtaatcccagcactttgggaggctgaggcgggcggatcacgagctcaggagatcgagaccatcctggctaacatggtgaaaccccatctctactaaaaatacaaaaaattagccaggtgtggtggcgggtgcctgtggtcccagctgctcgggaggctgaggcaggagaatggcatgaacccaggaggcggagcttgcagtgagtcaagatcatgccactgcactccagcctgggtgacacagcgagactccatctcaaaaaataaaaataataataataataaaataaataaatgaataaaatactgggctataaattattatttgcaagcctcatagtaacttcaaaacaaaacaaaacaaaacataccacaaatatgcaaaaaataaaaagaaacaaattcaaccataccactagagaaaataacctttactaaaaggaagacagaaaggaaggaaagaaggaagagaagaacacaaaacaaccagaaaataaataaaaaatggctgaagtaagtccttacttattaataacaacaatgaatgtaaatggactaaactctccaatgaaaagacacagagtaggctgggtatgttggctcacacttggaatctcagcactttgggaggccaagggtggaggattgctagagcacaggaatttgagaccagcctgggcaacaaagtgagaccatgtctctactaaaaataaaaattaaaccaaaaattagtcaaaaaagacaaagtggctgaatggatttttaaaaaacagacccagtgttctgttgcctactaaaaacacactaacatacttcacctataaagacacacataaactgaaaaaaaagaatggaaaaagactttctaagcaagtgaaaaccaaaaagaggaagagtagctatacttttatcagacaaaatagaattcaagacaaaaatcataaaaagagacaaagaaggtcattgtataatgataaaagggtcaattctgcaagaggatataacaattgtaaatacatatctacccaacaccggagtacccagatatataaagaaaatgttagcgctaaacagagagataaaccccaatacaatgatagcaggagacctcaacaccccactttcagcattggacagatcacccagaaagaaaaccaacaaagaacttaatctgcaccatggaccaaattgacctaacagatatttacagaatatttcatccaatggctggagaacacaatcttctcagcacatggatcattctcaaggatagaccatatattaggacacaaaacaagtcttaacacattcaaaaaaactgaaagaataagtatcttctctgaccacaatggaataaaacaagaaatgaataacaagcaaaatcttggaaaccacacaaacacacggaaattaaataatacactcctgaatgaccagttgtcaatgaagaaattaagaagcaaatcaaaaaatttatcgaaacaaatgataatggaaacacaacatatcaaaacctgtgggatatagtgaaagcagtaataagagagaagtttatagttataagtgcctacataaaaaaagtagaaagacatcaagtaatcaacctaacaatacatcttaaagaactggaaaatcaagagcaaacagaacctaaaatcagtagacaaataataaatatcagagcagaaataaatgaaattgaaatgaagaaaaccatgcaaaagaccaacaaaatgaaatcttggttttctgaaaacataaacaaacttgacaaacctttagccaaactaaggaaaaatagagaagacccaaataaataaaatcagagatgaaaaagaaaggcattataactgatactgcagaaactcaaaggattatgagaggcttaatatgccactaaattggaaaacctagaagaaatggataaattcttagacacatacaacttaccaagattgaaccataaagaaatccaaaatttgaacataccgataacaagtaatgagatagaagctgtaataaagaatctcccagcaaagaaaagcccaggacccaatggcttcactgcttcatttcacaaaacatttttaaaaaaatcaatcctactaaaactattctgaaaaatagaatacttctaaactcattttatgaggacagtattaccctgatgccaacaccagatgaaaacgcatccaaaaaataagaaaactagataggatgtagaagtctcagggggttgaaaatttaaaaaaaagaaagaaagaaagaaaaaaaaagtacaggctaatatccctgatgaatattgaagcaaaaatcctcaaaaaaatcttgcaaaccaaattcaacaacatactaaaaagatcgttcatcatgaccaagtgggatttatcccaggtatgcaagcatagttcaacatatgtaaatcaaccaatgtgatacattatattaacagaatgaaggacaaaacccatatatcatttcagctgatgctgaaaaagacatttgataaaattcaggatccctcagcatgataaaaaccctcaaaaaactgagtgtagaaggaacatacctaaataataaaaacaatatatgacagacccacagctagtatgatactgaatggggaacaagtgaaaaccttttctctaagatctagaacacgataaggatccccacttttctttttttggggttgtcaaatcattttttttttatactttaagttctgggatacatgtgaaaaacatgcagttttgttacataggtatacacgtgccatggtggtttgctgcacccttcaacctgtcacctacattagtctcctaatgctatccctcccctagccccccaccctgacaggccctggtgtgtgatgttcccctccctgtgaaggatccccactttttgccactgttattcaacacagtactggaagtcctagctagagcaatcagacaagagaaagatataagaggcattcaaattgcaaagaagtcaaactgtccttgtttgcagatgatatgaacttacatttggaaaaacctgaaaactccacacgcaaaacaaaaaactatctgaactgataaactcagtaatgtttcaacatacaaaatcaatatacagaaatcagtagcatttctatatgccaacagaaaacaacctgaaaaagaaatcaagtaatcccatttacaatagctacaaataaaattaaatacctaggaattaaccaaagaagtgaaagaaattgaagagaacacatacaaaaaaagttaaaatgtttcatgttcatggattggaagaatcaatattgttaaaatgtccatattaaccaaagaaatctacagattcaatgcaatccatatcaaaacaccaatgacatttctcacagtaatagagaaaacaatcctaaaatttgacaaatatttattgactgtttatcttgtgccagtatacccaccaatagcgaacctcagtaatccaaacttgaataccattcaataattgttaccaataaactgtaacaacagtcttcctttgaagaagatcctgattcactgccattttggttcatgggtgttattaaactgatgaatactctgcaattattaaagaacaaaaaccatttacctgaaggcattaattacactcacacacaaaccacttgcttacacagcttctaaatttgtaaccagatgaaacacagaagcccattcatggaattttttattctggaacacctaagaaaaggcaaaagtcatagctgaaaagttgcctaagtacagctgagcaataacgtgagcaaaagtcactatagaaagatttggccagccaggcgcagtggctcacgcctgtaattctagcactttgggaggccgatgtagcagatagcttgtgcccaggagtttgagaccagcctgggcaacatgatgaaaccccatctctacaaaaaatacaaaaatatttaccaggtgtggtggtgcgtgcttgtagtcccaggtacttggagggctgaggtgggaggatcgcttaagcccgggagatggaggcagcagtaagccaagatggcaccactgcactccagcctgggtgacaaagtgagaccctgtctcagaaaaaaaaaaaaaaaaaggcaagcaaacaagctttggcccagttacgatgctccacaaaaaagttaaaaataaaataaatgcctactccaactaatgttgtgccactcactagtctttccacactagggttatgttggaggatctccagacaagaggtcagtccggtgcaccttcagagttcaggctctgccacttagcagttgcttcaagcaggcacttactctctataccgtggttttctcttcataaaatgtgaaggttgtactacataatctctaaaattctgtatcaatcagggtctcagcaagaaatagattgcacattccaattagggtagttcaagaagactatttgcagacccatgggctggaggtagtgtgtccggaattggtaggctcttggtctcactgacttcaagaatgaagccgcagaccctcgccgtgagtgttacagttcttaaaggcagcgtgtccggagtttgttccttctgatgttcggctgtgttcggagtttcttccttctggtgggttcatggtctcgctgactcaggagtgaagctgcagaccttggcggtgagtgttacagctcaagccggcacatctggagttgtttgttcctcccggtgggttcgtggtctcggtgacttcaggagtgaagctgcaaatcttcgctgtgagtgttacagctcataaaagcagtgtggacccaaaaagtgggcagtagcaagatctattgcaaaaagcaaaacacattgcttccaaactgtggaaagggaccccagcgggttgccactgctggctcgcgcagcctgcttttattctcttatctggctccacccacaacctgcggattggtccattttacagagagccgattggtctgttttacagagagttgattggtccgttttgacagggtgctgattggtgcgtttacaatccctgagctagacacaaaagttatccacgtccccactagattagctagatacagagtgtcgactggtgtatttacaaaccctgagctaggcacagagtgctgattggtgtatttacaatcccttgagttagatacagagtgtcgattggtgcattcacaatcccttagctagacataaatgttctgcgagtccccaccagattaactagatacagagtgccgattggcgcattcacaaaccctgagctagacatagggtgctgattggtgtgtttacaaaccttgagctagatacagagtgttgattggtgtatttacaatcccttagctagacataaagattctccaagtccccatcagactcaggagcccagctggcttcacccagtggatctggcactggggctgcaggtggagctgtctgcaagtcccacgccatgcgggtgcactcctcagcccttgggtggtggatgggaccaggcgccgtggagcagggggtggcactcgtcggagaggctcaggcagtgcaggaggccacggtgggtgtaggggagacccaggcatggtgggatgcaggtcccaagccctgccccgaggagaggcagctaaggcccggctagaaatctagcacagcgcaggtgggccagcactgctgggggacccggcacaccctctgcagctgctggcccaggtgctaagcccctcactgcttggggtggcagggccagccggctgctccgagtgcgggcccgccaagcccacgcccacccggaactccagctggccctcaagctccatgcacagccccggttcccgctcgtgcctctctctccacaccttcccacaagctgagggagctggctccagcctcagccagcccagagaagggctcccacagtgcagcagtgggctgaagggctcctcaagcatggccagaatgggcaccgaggccaaggaggcaccgagagtgagcgagggctgtgagagctgccagcacgctgtcacctctcagtaggaaaaccataagagttcagcaacagaacattcgccatcccaggcccacagggaggagggaagaggacaaaacatggtccagaaggaaggagtcacgcagaaaaggccctctgaaaaagaccagtgacttccagacaagggcacagccagtgcaaggtgggcctacaagcagggagtccactctccaccttcccactccctctgatatccttccctggactctccactggctgaacccattgaagccaaacagcatgtcagtttcccagggaagaggatggggtggaggaaggtggagtagacttggagacatgaactagcacaggtcccttccagttttaacattctctggtagttgtgaggatagctcgacctcaactgaccttgggcatgccaagcctgaaactcctaggccattagaaatggatatgaaccaaagtatacaccaaggtcagcccctactccaccactgtagagaatattccagagtgtcgagatcatgcctctaggggaccttccaagctctagatatgttatttgatttttatctttttaaaagaggatacatgatttaccatgaatagaccatattttacattcccttctctgtgaagcttaagagttaaggcaccagctctgaaagcagacccatgctggtttgattccaggttctgactctgggtaacctgattaaattatctaagcctttccttatttgtaaaaggagggtaatagaacgtaccgcatggggttgttgtaaagattaaaagagatattcagcatgtaacacagggcctgactaataaatagtaacatttattattaatcttacattgaggatttatttgacaaaaatttcttggggagttgttaatggcttttatctgagttatcttccttttccttcattttgtctctgggggcctccttcacatgacttcctggggttcccaaaatgccagtaataatcatggattttagtgaagagacacaggaaatgatttatcaccttagacaagatgaaattaatagctttcattgggaagattgttcattttgaaaatatgaaacttacacattgaaaataaaattaaatctaaatgaaataaaaatcaatcatcacataatgctatttgaaagatgtaatttagaaaaaggaaacttggattattatcaaaaggctttattttggctggtgtcttttatgactacataatcctattttgaaaaaacttgggggcactttgctgttgtctatctataggtacactaagaaattacaaggataggtaaaaggcacgcttactgcaaaagagaatgcgaaaacagaaaatttcaagaatatagcaaacatcaggttttatatacccagctgaggagtaggagggaaataaataaaggagctactggtgcacacacacattcatggagtccatccacatttccagagcacattcttagtccctggcactgggctaggccttaggtgtgcaaatcctactagtcctccaaatagtgctcctacccttggagtatccaaagtctactggggaggcagactcatgaacaaccatccaaagaacatgatggagatgaacattgtgttataatctgaatacataaatatgggaacataaattcggggggtgggggaaatcactaaaggcctgctacatcagttagctttttctgtataacaaactactgcaaaaccttgcggcttaaaccacagccttttattcagcttgctcttctgtgagtcagctgggctgttccagtccaggcaggttcagatcatctcagttgggttttctctgtgtctgtggtcaggtgatagatctgctcatgtctggacaatctataataacttcattcattcacttgactggcgactggcagccaaggaaatagaatgagtaggccatgggtctctcattgtccaatgagggcttcttcacatggtagctagcagtcacagggtccccaaaagaagcaaaaggccaactccaatgaaccccccttttcacgtctctgcctgtgtcatgtttgctaagatcccattaggtaaagcaagttataaggccaatcctaaattctgtgtaggaaggggtgcaaagtcacccttgagaggggtgtgcatgtaggaacaggaagaattgggggcagtttttacagtctatcacaaggctgcatacaagtgatatcttgggacagggaatgttatcgtctcctaggaattttccaggaaaaatttgctattccctggaagaagaatcaagacaagaaccactgtggaaatgtaaaaatgcgtctgactcacccaagatgtagtaatgtgtatgttttgggaggttctggagataaggttagagttcatcttatgatttcccattctgtataggtatatttgaaatcactatagctatcatactatttccagtgtctagtcttgcctctagggcttggaaagtaacccaataagctaaaccatccccatgctggagatgttcatataatgagctatgcaggtaaaatcccattgtactgaccacccttacaggaagaccttaatgacagaacatcctgggaatgaaattggcagtgtcctcataaatcacataaagcagggctaagccttcaaagtcacagaacaaatggtcctggcagctatgatgaggtctccacttagggaagaaaaaaacacaacccaccaaggcagaactgggtcatcagtggtgcagcttctatgtctctctttcatattcctctgcctacctgttttataccaagacctgattaaacagtcaactattgcttgttttcttgtttcattcattcattcactcaaccactaatccaccaaacatttattgagcaccttccacatactaataggagctggaagaaaacacagataaataagatgccctgtcccaaaggacctcagcatttggtgtgcaagggacccagaaatataaacaattacaattcagcatgatgagagtagagaaggaagctcaggggactaagggagagcttgagagggacacctaacccagacctcagtgtcagacacagctttccaaaggctgtggcactttagctgaatctcaaagaatgtttaggaaataggcagacaagggtagagcactccaagcagaggaaacaacttgtactggggtatggaagcacaggagaacatatgacaggaagtacacaaggaaagggcaagaacaacttggatgctatctgaggtgtgatgatgcacccaaaccctccccattcgctaaaacattatataagacacaaattacgtatccttcccgaccgacctactgatcccacctcagcgtgaatgaattcaagccactgacttaccttgagcagcatctgaactcgattattggatacactttggcccccattgctgacatcaataaacacatagggtgctttggagggcaggatggcattccctgaagcctcatcaagccccaatacaggtttttcccaaaggtaaacttgatttatttattgcttttaggatgaaaacggagagtcagaaagaacatcagcaagccctcccattcaaataactccttaatcccagaaagctgccctaactgactggtggtataacctaagtccctggtacaggtcagtatcgaacaatattaccaatagtattaataacaatgctgcctgtcagtgggtgtttatatgagtcaagccattgactaaaccctttgtgaatatatattgttaattaaaatttttttaaaatttgagacagggtcttgctctgttgctcacgctggagtacagtggtatgacacacctcactgtagcctcgacctctggggcccaagcaatcctttcacctcagcctcctgagtggctaggacttacaggcgtgtaccaccacaccagaatttttttttttttttgtagagatggtgtcttgctatattgcccaggccagtcttgaactcctgagctggactaattctcccgccttggcttcccaaagtgctgtgatcacaggcatgagccaccatgttcagctgtgaatgtaatctcattaaatcctcacattaactctacagtgatatttctatcatcatgaggaatatggtttagagataagacataacaacttatgtaaggtcatagttagggagtcagagacaaattcagaagaacctgtatcctatcccctgtcttctactacaacagctttctatgcccttaaacctcagtcccaggtcttacccagtcctgtgagaaccttggtctaaacagctcccatctctggactttcctggccccagcttccctactatacccctcagttcattagagtcatttattcatttagaaatatttttgcatcctgactagtttgcacggcctgtagaagattaatcagacgtggtcttgagcctaaagtgtttctactctagtagaatattcattaatttatccatccattcattcaactaaaatgtgtttaagtatttaccatgtgccaagaactttttaagtattaggaagttgaagtgaataaggacctcaaagtttttgtgcatcctagtggaatataagacacttacataaacaatgatatggttgaatgtgttgcctaaaagttcatgtgttggaaacttaatccctctgccttcatgaatggattaatgtcactaccatgggagtgggctcattatctccagagtggctttgttataaagtgaactctctctctagctctctggctcttgccctctcaacatgctatgatgcagcaagaaggctgtcaccagatgttggcactaagctcttgaacttcccagcttccagaacactgtgctaaataaaattattttcttcataagctacccaatctgtggtattctgttataacaacagaaaatgactaacacaaacaattatcatcagactacagtgcggcacatctgggctggaatccaggtcctttgacttccaggtgagtgcctatcagcaaaacttcttggaagagttgcttctagctgccatctctcctttcctctcatcttctctttacctgactcttgctggcttccatctgactgcttcactaaaactactcaagatcaccaatgacttcaaggtcaccaatttgattatattccatctttgtcaaaacactttccccttaatttccatgacaggtgttcctcatatcgcactgactaaccatccctttttaagcattgctgggtccttctcttaacctccaaacattttatccctcaaagcttggtgtttaaaccccttttcctatctgctctctcccacaccattgcctgaagtatcatttacaatcacaaccaattttttacctctagtcctgacttctctctggaattctagactcatattcaaatgtctattgatataaaatttatcaatcaaaatagaactcttgatttttaccaccaattctactaccatcatgtcttggtaaacagtatcaccatctactgaattgcttgagccaaaagcacaagagtcatccttcatgcctgtctccctcagcgcctacatccagtccatcagcaaggcctgccgatacacctccaagacagatccggaatttctccagttgtctctgtctccactactccaacccagtccaagctacgattacctcttgccttgactaacgtagaagccttcccattggtctccaagttttcattctcaccctcctccatttcattctccacaaagtaaccacaatgaaccattaaaattaaaagccagaccatttcaccctatgtttcaaagtctccagtggttctgccgcacttagaataaagtccaaactctttacctggtctgaatcccaatataatttgcaacacttctctaatctcatctccttccaggttttccttttgtctctctcctccaatcacactggcccagggcctttctgccagctgctgcctttgcctagaaagttctttttcctgatcttcacacagctggctccttcatgtcatttacatctcagttacatgtcacctcctcagaaaggccctccatgatcacccactcttacacattgccctattttaattgtgcgtgatacttattactaacaaattaatgtgtgtgtgtgtgttttaacttatctgtttcttatctacctgtttattcttactagaatataagatcctagagagcaaaggtgttatttgccttgcttatgataaggaagactaaccaacatagattaggtagtcaataaatattaaaaaagcaaaaagataaatcctgtataactcacataataagaaaaggcaattttattatgctaaggagttgctaataaagggctatcacctttgtggcccagaaaagaagctcaattagtaggggcctgtggaactcagaaaactatcaaatgaaaaattgtaagacaatcctttcatcagtatgaaagaattttcaaagacttctactgaaaatagcagagacttttcaatccaaacatacagaatatacatttcccggaatataattctgaaatattcaggcaactggaccagattgattatggatggattggagcatgccttttaagtctccccatgtttgaccataaatattgatagcccctttttggtagatggttctgcctcatgttccagatgaaaaaaaaaccatttaaaaggaagaaagctatgtagctgcctctcttttagagaatggaatatgttataagcatgcccagaaaaacagaatactcagggatttgaatcagaacagaggccatgatgaaagtgataatacaaactggataaatgggtgaaataaagctccccaaacagatgcactagagatagtccccaatcccagatttactttaacacgcaacatcagaagagtgagcacttaggtttgatctaggagccatcattttgcaggggtccttaagaagtcttcaggcacaaaaaggctgttggaaaacagaccagagaataccagggtttttattgacagaagtgctaataaaacaacacaattgtttgcaaccagaagctaaatgactcatatctctttcaagaaaggtcctatcacacaggaattgactgtaaagcagtatctataacctaactttcaaaagctctaaattttctgacatgaatgaaatagtcttaatttaccctcaactagataacatgttaaggatgggaatgtgtctttatccacttttgtatcctcatagttcttaaatatctagtaggcaagcagtaacagtttgcttattaaataaatctcaccaccaccatcttctctaacttggtttgcatgcaatcatcttttcctctctcctctccatctctccatctgtctgtctctccatctgtttctctctctctctctcacacacacacacacacacacacacacacacacacacatctggcctctctgttagagctcactgcttagattctatcttaaatctgtgaaggactagatctgatagtccataataccttaattgtcatcgtaacccaaaatctaactgatggcagggagtgacagcagctttctcatctgtaaaatggggataataaaagtgcctggaatgacactggaaaggagtaaagccaagtgatcagataggctgcttcattctcctaccccaaacatgcagaaaacttagctgcagtatgcaatgcaagtgtcctcaacacccaacacttacagcagccaccgcaaccaagagaagggaatcctgtgtgacacaggcatggagtttgtcttgttctttcaactccttcaacttttaagaactgttcaaatttttcttagagacctgactcctctattcacaacaatatgttccttactagagaagcataatattaacacaacaacactactaataagtgtaacagctcacatttatcagcacaattggtgttagccaggcatgcaacaaaagacttcacctacaccaacccaattaactatcacaaacctatgaggaaggcattagtattacctatgtcatagatgactatcctgaaactcaaagaagttaaataatgtctacatggccacagaactacaaatgtcaaatttgggacctgaactcaggtctgttgactccaaggcctgggcagtattcatctttaacttgttcatccttatccccagcattaagtacagtccctgacactggtcaaagctttaagcctcaaatctaggcaccaacaattgcttagaagcaagcagtctaagagcacagaccatgaaacagaaaaagagccatggcttcaagtcccagactggtcacttattagttctgcaaccttaggcatatttgtcaacctctcggagcctcagctttctcatctgtaaaacagcgataataaaagtgccttcaataggacacttagtatcttgagtaatgcacagttaagactacttacaggtccacaatttcttaaccataaatctaaagcctgaaaagctctgaaatcagaccttgttcttaaaactggttgtattaatttctattggtactataacaagttcccacaaactcagtggcttaaaacaacaaaaattttttatcccgcagttctgtaggtcagaagtcaaatgtgggtccctggactaaaatcaaggtgtctacaggctgtgttcctttctggagactctagagaggattcatttcatcaccttttccgtcttttagaggcttctcccattctttggctcatggcccccttccattctgaaatacctctgatcctaagggttttagatgagactataaatttatattctaataattattattaacatcatcttcttctctgaaaggcaagagaaaatggtccatggtcgacatggttcataaatcatgttcacaaagccagtgcccccttgagccttggaagaccctgctggccgggcgtgatggctcacacctgtaatctcagcaatttgggaggccaaagttggctgatcacttgaagctaggagctcaagaccagcctggccatcatggtgaaaactcatctctactaaaaatacaaaaattagccaggcgtgatggtgcacgactgtaatcgcagctacttggaaggctgaggcagaagaatcatttgaacccaggagacagaggttgcagtgagccgagatcatgccacttcacttcagcctgggcatagagcaagactctgtctcaaagaaaaacaaaaacaaaaacaacaacaacaacaacaaaaaagatcctgttatggtttgaatgtatatgtccctcaaaaattcatatattggaacttgaacctcaatgtgatagtattaagaggcagacttttgggaggtgattaagtcatgaggttagagccctcatggatgggattagcaacctcataaaagggctggagtaaatttgctaggcccttttgccctctgttctttttgccacatgacgatgcagcaacaaggcaccatcttgcaagcagtctttaccagacatggaacttgactgtgccttgatcttggacttcccagcctctagaactgtgagaaacaaatttctgttgtttataaattacccagtcttgggtattttgttatagcagcatgaaggggtaagacagatctggagtcagacattcctcatggccaaacctgataccactcctttcttgctgtgtactcctaacctctatcagcctccctgtcctcatcacccaggagtaggggtgggggtgtgagtgtgcccacagagtggtcatggggattaaatgagatgaatcatgcatagcccttggcacccaacaatgggattgctactgtcagttcctatgctcctctacttgggtattgccttcatggctgacacccatggctttctttctgggatgtgtggccttcatcaaaaatgtgtttatttagtgaaaaaaaaaaaaggaccctgagattttcatttaattttgcctatgttctcacactgctccatagcacagcactgatgatactaaaaagctaactcctggatctaagctgctaagaccttcacatcactggcagctttgctaatgtcggtgttctgcagaacaggaagtaactcaccagcctactatgttctcatgaggccatcccttgggactgtcccactgcctctacactgcttctgttttcaccagacatctcctgatcctaacttggtttctcaagtaaacttctccactgccaccaagaggaatgtcttataggaagctgcagaataagaagtcaaggccacatgtgtggatttgagaatcagaggcaccattcccttttttcttccctttcttccctccttccctccttttttttccttccttcctacttccttccctcctttttttttcttttgttccttcttccttccctccctcccttccttccgcagtcaatccacaaagattaactgaacacctaccaagtacaaagtactatgccaacaggctggcaatacagtcttcaagataagcctgggtcatgctatgcagagtgtacagatgatcccataaatcatgactttattacagttaattttacaaaccattaattacaaattgaggtgagaattaggaagaaaaagtgcaaggtgttaaaagactgtttaagatagtcaggggattctagaaatgtgtcatgacctagtaatatctaatcaaggacctgcctgaagagtgataaaaattacccagctaaagagctagaagaatattccaggggagacatgaatagatgtgtgaagacccagtgtcaaggaactgaaagaagaccagaattgccaaaatacggggaggagaggcagtatggtacatgactggttagttggtggtaggtaggaagaaaggaaggaaaggtgggagaaaagaaagggggaaagaaggaaaggtggaagaaaagaaagggggaaagaaggaaaggagggaaagaattaaatgggaccaaatcaaatctggagcagaagctggcaagctccagtaagaccaaatctggtcccagtctgtttttgtatggcccccagctaagaatggtctttgtatttttaagtagttgaaaaaaatcaaagagaagaatgctattttatgacatgttaaaattatatcaaattcagttttctgtatccataaataaagctttattggaacacagccacacccacacatttgcatattatctatggctgctttcatgctacagtggcagagttgaggagttgcaacagagaccttacagtccacaagcttaaaatatttactgtctatacctttacagaaaaaaagtgtttgccaacccctgatttagtgagattggcagaggccagatcatataatattttaggtcacattaaagatttactatcttatcccaagaccaggagaacccaataaatagtttgaactggagaacagcatgacccagtagtgcccaaacctatctgcacattagactagggagcttcaaaaaatatggatgcatgagtcccacttccagatattatgaattaattagtcttggtatggccagtgctttggaattttgaggggattcctaggtgactctggtatgcagatgagtttgggaaccatggatataatcacatttttatgttttaaagatcagtctggccgggcgcagtggcttatgcctgtaatcccagcactttgggaggcagaggcaggcggatcatgaggtcaggagatcgagaccatcctggctaacacagtgaaaccccgcctctactaaaaatacaaaaaaaattagccgggcgtggtggtgggagcctgtagtcccagctactcgggaggctgaggcaggagaatggcatgaacccgggaggcgtagcttgcagtgagccgagattgtgccactgcactccagcctgggcaacagaatgagactccgtctcaaaaaaaaaaaaaaaaaaaaaaaaaaaaaaaaaaaaaagatcagtctggctcaggggttctcactctggctgcacattgggatcatctggaggatattttcaaatatactgatgtgacgcccaggcccatctggcatcaattaaataagaatctctagggggtctccccaagcactggtataaagttgcccaggtgattctaacatgcagccagggttgtgcaccccgcattaacaggggccaaggatgaagacccagagacccccaagaggctactgtgagtgcccaactgaaagatgataggggctgaagttgagttgctgggggtagggggctgtgtaggcacaatcaggaggacttggtgatcagtaagtgacagtggaaagctgaagtggaaagtttcaaaaacgatactcaaatgtctagcaaatcaactgggtgcaaactgatggcactttttgggatgggaaccttggacgaggaacaaggtgcggaagtaagagcactatttctgttctgatgtagtgttgaaaaggagggtgtcttcggagagttggccagaataaagctgtaagggactgcaatcaaatgataaagagccttgaatgctatcctaacaatatcctcctcatatagcaggcaatggctacaatgacgtagtgaaatacgtatgacctttggattcagacactgttccagtcacatacaatgtatgtgagcttcctcagcttcct

SEQ ID NO: 12 - DNA, 10525 bp, Homo sapiens
cttggtctgtccaagtatagtctgagtgaaagaattatacttacaaaattaccccctcaaaatgtgtttgtgttgtgaactgtttagaggggcgatacttcccaaccctcaggcaagggggctagagaatctatgttgcagtgtagaattgtgtgtcttttcttttctttcttttcttttttttagatctcggctcactgtaacctccacctccagggttcaagtgattctgattctcctgccttagcctccagagcagctgggatcacaggcatgtcccaccacacctggctaatttttgtatttttagtaaagacggggtttcaccatattgtccaggctggtctcgaactcctgagctcaagtgatcggcccacctcagcctcccaaagtgctgggattacaggagtgagctaccgcgcccggccagaattgtgggtatttctaaataatatttatgttgtgtaatgtactaaacatattcattaaatatttggtagagatgcagtggagctaaaacaaacacggttccagccctcatggggcttagactcccaaataaacactaaccagtatttaaatgataattgtagtaagtgcaaggaaaggaggtgtgtgtttcatctgaaggaagtaggagtgtgtgaagtgaagacagtggaagtgggcagcagagacagcagttgaagcagaggaaacaatgaagaccaggttgtggtagaatgaagggagtatctccaaacatgtagatcttgttacaggtgtttaggagcaaaaggcaaccactaaaaagttttaaaagggtgaatatgttaggagttgagaaattaaatttacattttggggccgggcgtggtaactcacagcttgtaatcccagcactttgggaggctgaggtgggtggatcacctgaggtcaggagttcgagaacaacctggccaacatggtgaaaccgcatctctactaaaaatacaaacattagctgggcatggtggcacacacctgtcatcccagctgctcgggaggctgaggcacgagaatcccttgaacccaggaggcagaggttgcagtgaaccgagatctggccactgcactccagcctgggtgataaagcaagactcagtctcaaaaaacaaacaaaaaaacagaaaaaaaaatgtatcttttggaaactgcactgtggctggcagactgggaaagaatttgagaccactagaatgggagagaaggggccacctaggagtgactgttgttgtgtaggaaagagatcatggtggcttggattaaggttgtgatggaaaagatggagagaaaaagatgaactcaagagaaatttaagaggtgatatcaacagaacatgtggatagattagatacagggcaatgagaaagaaatgtcaagggtaacatgtaggtggttgtggaactggatagatggtggtccattcattggcagaagtgctctactgcaatagcctgacaccgtcctctacctagcttgtctagaactaatgtcacatgctaacagtcaccccatatctgctatggtactcacgttgaattcttctaacagttatcaagacagaagctccctttgtagttcaatttttcaatgaaaggcattttcatggaataagaccttttttaaagttagttaataaatcaagttttatatttgttttttgttttgtttgtttgtttgttttttgagacattgtttcattcttgttacccaggctggagtgcaatggcgcagtctcggctcactgcaacctccgcctcccgggttcaaatgattctcctgcctcagcctcccaagtagctgggattacaggcacccaccaccatgcccggctaatttttgtagttttagtagagacagggtttcaccatgttggtcagtctggtctcaaactcctaacctcaggtgatccgccctcctcggcctcccaaagtgctgggatttacaggcgtgaaccactgtgcccaacctaagttttatatttgacatcatggaaaccatgtagtgtgaaagaataatgcactctttaatggcctcaggcaaattagaagacaagagaatttaagttttaaataatgccagatgaaagccagatgacatgacagcatgttatacagccaaagggttcacatattttcatagagaagccaagtcttcctaaagtacacagaagtataggcatgttatgagcagtcatattgcacattcatcattataaaggaaagcattgcacatttcctttgtggtaacaacttcccttgttatttcattgttacgttacttcattagtatgaagtagttagtatgaagcgttgctttttaaattttttttttcttttgagacggagtttcgctctggagtgcaatggggtaatcttggctcactacaacctccacctcccaggttcaagcgattcgcctgcctcggtctccctagtagctgggattacaggcggatgccacgacgcccagctaatttttgtatttttagtagagatggtgtttcaccatgttggtcaggctggtttcgaactcctgacctcaggtgatctgcctgctcggcctcccaaagtgctaggattacaggcgtgagccaccatgcctggcctgctttaaaaattttttaaagtactcttacattgagatgcactatcagattcattggcccaacaataacagatagctgttcaaaaactagctccttgttaaaaacaggaaagaaattgacagcaattatctaattttagcaaaacaatatttgtaaattaatttcaactttatagtgctataagaactataagcataatgactttgcacacagctttatgaacggatttatttaagtaatattctcatgtaaataagaagtcaacatcaggggtttgagagaattgtttctcttaaaaggggtctgagccttatttgagttagggaaacactgggctataaaataaaagcaaaccttggctgggtatgcaaggtcttccgtgatctggccctcaaaataccactgcctcatctcctgtcactctcctagtcaaacctgaggtcctgccaacattgtattttccatgttgttattctagctgttccctctctccagaacacccttctaaatctactcagctaaaataataatcacagcccataggcaggtcttgggattttaatcctcccagaatgacaattacttacttattcaacggaataaaatggtacaatatgtctaacatctcatgatgagatgtatatggagaattctcccacattttattgtgaagaatggactgagcacccactacctgagaatcaacaggatccctctaagccagagaagcaggaccaatagtccagaaaaaacagagccttctccaaaaaacaggacttgtcagacagaatggtcaatcccagtcattccccaatacttctcttaagcgttttgcttgataaatatggacttttgaccagaagaagagagaaacaactctggtgtaaaggttgttatcactagtaatccctccctccttccctctctccctctctttctgtctttctctctttctttcttgaggcaatctcaccctatcacctaggctgaagtacagtgacatgatctcggctcactgcaacctctgcctcctgtgttcaagtgattctcctgcctcagcctctggagtagctgggattacatgcatgcaccaccacgcctggctaatttttgtatttttagtagagacaggggttttgccatattggccaagctggtctcgaactcctgaactcaagtgatccgcccacttcggcctcccaaagtgctgggattataggcgagagccaccgcacctggcaggctgcagtttctttcaatcaaaacaattcaattgttgagaccctgaggaaaaaatgtgtattcttaaaacagaaattgtgtactttattgattataggagaccaccagtgagaaaaaatcagcattgcttttcagcaactaaagttgccgtataggtgtatttgataagtcgtgataccaaagcatctttttaaactttcatcctaatattaggtctaggtagatggcatgtggcccgcagctgtcaggtcattgatctaaaggaaaagggaagaaaagattcctccttgagtcagtctaagtttaaattgctcaaggattcagggattaaaatttatgtctgttttactttctacttgcttgcagcttatagttttcaacaatctttaggttttaaaatacttatcaggtttttaaaaatttcttcatttatttgtatatatgctatttgcattttatattctatatgtagcatatttgagataattttttcaagtttttttctagattcctatttacttaaaacagtatttccacaaaataacccatgaaatactagccctgcaagatattctgaaaaaaagggagaatttccaaaatcaaaaaggtttggaaaattgtgtatatcatagtcaaaatttactttaatatattagctaggccaagtgcagtggctcatgcctgtaatttcagcattttgggaggctgaggcaggaggatttctaggagcccaggagtttaagaccagcctgggcaacatagtgagactccatctctaaatacatatatatatcatatatacatataataaatatatatcatatataatatatattataattaaattatatataatatatattttaaatatatattatatattaaattatatataatatatattttaatatatattatatattaaattatatataatatatattttaatatatattatatattaaattatatataatatatatttaaaatatattatatattaaattatatataatatatatttaaatatataaatataaatatataatatataaatatatatttataatataagctaaatactctgggaaatcctgcaacaatgaaagctggttagtcttgtttagttcagcatttctcagacttatttgaacattttatcagtccattttcatactgctatgaagaaatacctgagactgggtaacttataaagaaaaaagaggtttaatggactcagttccacatggctggggaggccttacaatcatggtggaaggcaaaggaaggacaaaggcacgtcttacatggcagcaggcaagagaacgtgtgcaggggaactgcccttttttaagccatcagatctcgtgagacttattcactatcaggagaacagcacgggaaaaacccgcccccatgattcaattacctcccaccaggtccctcccatgacatgtggggattatgggagctacaattcaagatgagatttggatggggacacagccaaaccatatcaaacatgaaataacaaaaataatattttagaaacagcatttaacaccctctggaattagtgttttacagaaaatgctttgacaaatgcttatctaaagtcactttttaggctgggtgcggtggctcactcctgtaatcccagcactttggaggctgaggtgggtggatcacctgaggtcaggagttcaagaccagcctgaccaacatggtgaaaccccgttgctactaaaaatacaaaaaatgagccaggtgtggtggtgggtgcctgtaatcccagctactcgggaggctgagacagacttgaaaccaactgggaggtggaggttgcagtgagccgagattgcgccattgcaatccagcctgggcaacgagcaaaactccatctcaaaaaataaaataaaatagtcactttttttttctcattaaactttgttttaatgggtctcaaaattctgtgacagatttttggtcaagtatttccattaaaaagtactaatttttaaaactaataatttaaaactgccacacacacaaaaataataccaaagtggtccacaaaacattcttctttccttctgaagattttacgatgcattattatcattaaccagtcttttactattaaacttaaatggccagtcgaaacgaacagttctgagactgttcttccaccactgattaagaagaccagggaggcaggtattacggataacattcatttagccttctgagctttctgggcaggcttggtgaccttgccagcttccgcagcctttttgtccactgctttgatgacacccacgacaactgtctgtctcagatcatgaacagcaaagcgacccacaggtggatagtctgagaagctctcaacacacaagggcttgccaggaaccgtatcaacaatggcagcatcaccagacttcaagaatttagggccatcttccagtttcttaccagaacagcgatcaattttttccttctgcacaggaaacttgcatgcaatgtgagccatgtggcaattcagtacaggggcatagccagcgctgatttggcctgaatggttccggatagtcacctgagcagtcaagccagctgcttccattggtggttcgtttttgctgtcaccagcaacattgtcatgacgaacatccttgacaaacacattcttgacactgaagcccacattgtccccaggaagagcttcactcaaagcttcatggtgcgttttgacagactttacttcagttgtaacgttgactggagcaaaggtgaccaccataccaggtttgagaatgccagtctccactcagccaataggaacagtaccaataccaccaattttgtagacatcctggaggaacaggcacaagggcttgtcagttggaccagttggtggtaggacgcagtccagagcctcaagcagtgtggttccactggcattgccattgttaccggtgactttccatcccttgaaccaaggcgtgttagcacttggctccagcatgttgtcatcattccaaccagaaattggcacaaatgctactgtgtcggggttgtagccaattttcttaatgtagtgctgacttccttaacgatttccttgtatctcttctggctatagggtggctcagtgtaaccattttgttaacaccaacaattggttgtttcacacccagtgtgtaagccagaagggcatgctctcgggtctgcccattcttggagataccagcttcaaattcgccaacaccagcagcaacaatcaggacagcacggtcagcctgagatgtccctgtaatcatgtttttgatgacgtctctgtgtcctggggcatcaatgatagtcacgtagtacttgctagtctcaaatttccacaaaagagataccaatgatgataccacgttcatgctcagctttcagtttatccaagaccgaggcatacttgaaggaggcctttcccatctcagcagcctcattcttaaatttttcaatggttcttttgtcaatgacgccgcatttgtagatcagatggccagtagtggtggacttgcctgaatctacatgtccagtgacaataatgttgatatgcgtcttttcctttcccatttggcttgggagttttcatgacacctgtgttctagcggcaaacctgttgcgaaaaacagtactgtcactttttaaaaaaaagaaaaaaaaaacaacaacaaactttccaaaggggcagagattctccagtgataaagagtgatgctgaggacagcagaagggtgaatcctatcagtatccagctgagtgaggctaagagaaaagggccttatgcttacaggaactggggttgctgcagtgaacccagacattttaagttcagaatattccatttaggctgaagcaacctgggcgatcttaggctggacaggataaccgttactgccatttttactgttatttctgcttcaatttactgctattaattgcttaagatgggcaaggcactatacatatattatctcaaaccacataagactcctgcaagatagattttaccctcccaattttagagataaggaaactgaggctgagagggtgacgtgattcttgtagaaagaatttggtcttagacatttcttaatacattgtgctacctcaatctgtaaaccttcattgaggcgactgctctctctttgctctgtaagccacttattactttccctaaagccttccctgccagaaataattctagaataaaacaggttaaaccactgatgaccttggcccaattaatcttatcatgtctggcttccatcatgaaccaattaattacatacattaatctgataagacctatgattacctacacatggaatggtattttgaaattacttcccaaggctatttaagaatcactattataaagacacatgcatgcatgtgttcaccacagcactattcacaatagcaaagacatgaaattgacctaaatgcccatcaatgatagactggataaagaaaatgtggtacacacaccatggaatactatgcagccataaaaaggaatgagttcatgtcctttgcaggaccatggatggagctgggggccattatccttagcaaactaacacaggaacagaaaaccaagtactgcatgttctcacttataagtaccaactaaatgatgagaacacatggacacatagaggggaacaacacacactgaggcctatcagagggtggagggtgggaggagggagaggatcaggaaaaataactaatgggtactaggcttaatacctgggtgatgaaatcatctgtacaacaaacccccacgacacaagtttacctatataacaaatctgcacatgtacccctgaacttaaaagtcaaaaaaagaggctgggcgcggtggctcatgcctgtaatcccaacactttgggaggccaaggcgggtggatcatgaggtcaggagatcgagaccatcctggctaacatggtgaaaccccatctctactaaaaatactaaaaattagccatgcgtggtggtgggcgcctgtagtcccagctacttgggaggctgaggcaggagaatggcgtgaacccgggaggcggagcttgcagtgagcagagatctcgccactgcactccaccctgggcgacagagcaaggctccatctcaaaaaaaaaaaaaagttaaaaaaagaatcacaaaagaaattcttaacattgaaagccaaagtcaaacacctacagaggccaaccaggtaacataaatgaggagagctgctcaggaataagacaggaggggtgatggagactgtggtgatctagagtgagtatgaaccatccaaagggtttcactacttctgagctttggcagattgttgtcaagcagaaacgtgagcctcatgttgctagatcttatttttcaaatgaagccagaaacagtttttatgtgaaatctcaatgtttaagtgttacacaactaactttaaaaaaagaaaaaaaaaacactagcagggccaaaaataacataaactttcaggctaatagctcatgaccttttctttaaaatcataagtcagcagctgggcgtggtggctcatgcatgtaatcccagcactttgggaggccaaggcaggcagatcacctaagtttgggagtttgagaccagcctgaccaacatggagaaaccccatctctactaaaacaaaacacaaaaaatacaaaaaaattagctgggcgtcagccatcccattactgggtatatacccaaaggattataaatcatgctgctataaagacacatgcacatgtatgtttattgcagcattattcacaatagcaaagacttggaactaacccaaatgtccatcaatgatagactggattaagaaaatgtggcacatatatatcatggaatactatgcagccataaaaaaggatgagttcatgtcctttgtagggacatggatgaagctggaaaccatcattctgagaaaacgagcgaggacagaaaaccaaacactgcatgttcccactcataggtgggaattgaacaatgagaacacttggacacagggtggggaacattacacactggggcctgtcatggggtggggggagcggggagggatagcaataggagatatacctaatgtaaatgacgagttaatgggtgcagcacaccaacatggcacatgtatacatatgtaacaaacctgcacgttgtgcacatgtaccctagaacttaaagtataataaaaaaatgaaaaaaaaattatctgggctttgtggtgcatgcctgtaattccagctactcgggaggctgaggcaggataatcgcttgaacccgggaggcagaggttgtggtgggccaagatcgcgccattgcactccagcctgggcagcaagagagaaactccatttaaaaaaaaaaatcataagtcagcttttattttaaaaaagtattacctctgccaccaccccctactccactaatcactcccttcattgggtagacctgggtccagattgcttttgaaacactaaaaaggcatagcaaatcagctttgagaagaggaagcagaaatatgtcatcactggagcagtgctaatggcttcctcatactttaaagtcttaactat

SEQ ID NO: 13 - DNA, 209658 bp, Homo sapiens
cctaccctatgcacagaacaatcactaaactcagcaggaaaaaagatcaatcagtaaaaataggaatttgagtttaattcaagtacctgggaataccaacatgctttcatataatctcagtactgattacttttaaaaaggcataacacttcatttaaaatgaatatctgagtgcagttgattatttatgccctttatatatctctaactattcaactaataataacaaaaacaataatcgttaacaatttcttgagtatatacaacagaactgaatcactgacttaaatactttacataatgacctcatttaatcctcaaaactattctacttacagttgataaaactgagtctgggaggagccaagatggccgaataggaacagctccggtctacagctcccagcgtgagcgacgcagaagacaggtgatttctgcatttccatctgaggtaccgggttcatctcactagggagtgccagacagtgggcgcaggccagtgtgtgtgcgcaccgtgcgcgagccgaagcagggcgaggcattgcctcacctgggaagcgcaaggggtcagggagttccctttccgagtcaaagaaaggggtgatggacgcacctggaaaatcgggtcactcccacccgaatattgcgcttttcagaccggcttaagaaacggcgcaccacgagactatatcccacacctggctcacagggtcctacgcccacggagtctcgctgattgctagcacagcagtctgagatcaaactgcaaggcggcaacgaggctgggggaggggcgcccgccattgcccaggcttgcttaggtaaacaaagcagccgggaagctccaactgggtggagcccaccacagctcaaggaggcctgcctgcctctgtaggctccacctctggggggcagggcacagacaaacaaaaagacagcagtaacctctgcagacttaagtgtccctgtctgacagctttgaagagagcagtggttctcccagcacgcagctggagatctgagaacgggcagactgcctcctcaagtgggtccctgactcctgacctccgagcagcctaactgggaggcaccccccagcaggggcacactgacacctcacacggcagggtattccaacagacctgcagctgagggtcctgtctgttagaaggaaaactaacaaccagaaaggacatctacaccaaaaacccatctgtacatcaccatcatcaaagaccaaaagtagataaaaccacaaagatggggaaaaaacagaacagaaaaactggaaactctaaaacgcagagcgcctctcctcctccaaaggaacgcagttcctcaacagcaacagaacaaagctggatggagaatgattttgacgagctgagagaagaaggcttcaggcgatcaaattactctgagctatgggaggacattcaaaccaaaggcaaagaagttgaaaactttgaaaaaaatttagaagaatgtataactagaataaccaatacagagaagtgcttaaaggagctgatggagctgaaaaccaaggctcgagaactacgtgaagaatgcagaagcctcaggagccgatgccatcaactggaagaaagggtatcagcaatggaagatgaaatgaatgaaatgaagcgagaagggaagtttagagaaaaaagaataaaaagaaatgagcaaagcctccaagaaatatgggactatgtgaaaagaccaaatctacgtctgattggtgtacctgaaagtgatgtggagaatggaaccaagttggaaaacactctgcaggatattatccaggagaacttccccaatctagcaaggcaggccaacgttcagattcaggaaatacagagaacgccacaaagatactcctcgagaagagcaactccaagacacataattgtcagattcaccaaagttgaaatgaaggaaaaaatgttcagggcagccagagagaaaggtcgggttaccctcaaaggaaagcccatcagactaacagcggatctctcggcagaaaccctacaagccagaagagagtgggggccaatattcaacattcttaaagaaaagaattttcaacccagaatttcatatccagccaaactaagcttcataagtgaaggagaaataaaatactttatagacaagcaaatgctgagagattttgtcaccaccaggcatgccctaaaagagctcctcaaggaagcgctaaacatggaaaggaacaaccggtaccagccgctgcaaaatcatgccaaaatgtaaagaccatcgagactaggaagaaactgcatcaactaatgagcaaaatcaccagctaacatcataatgacaggatcaaattcacacataacaatactaactttaaatataaatggactaaattatgcaattaaaagacacagactggcaagttggataaagagtcaagacccatcagtgtgctgtattcaggaaacccatctcacgtgcagagacacacataggctcaaaataaaaggatggaggaagatctaccaagccaatggaaaacaaaaaaaggcaggggttgcaatcttagtctctgataaaacagactttaaaccaacaaagatcaaaagagacaaagaaggccattacataatggtaaagggatcaattcaacaagaagagctaactatcctaaatatttatgcacccaatacaggagcacccagattcataaagcaagtcctcagtgacctacaaagagacttagactcccacacattaacaatgggagactttaacaccccactgtcaacattagacagatcaacgagacagaaagtcaacaaggatacccaggaattgaactcagctctgcaccaagcagacctaatagacatctacagaactctccaccccaaatcaacagaatatacatttttttcagcaccacaccacacctattccaaaattgaccacatagttggaagtaaagctctcctcagcaaatgtaaaagaacagaaattataacaaactatctctcagaccacagtgcaatcaaactagaactcaggattaagaatctcactcaaagccgctcaactacatggaaactgaacaacctgctcctgaatgactactgggtacataacgaaatgaaggcagaaataaagatgttctttgaaaccaacgagaacaaagacaccacataccagaatcgctgggacgcattcaaagcagtgtgtagagggaaatttatagcactaaatgcctacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaatcaatgaatccaggagctggttttttgaaaggatcaacaaaattgatagaccgctagcaagactaataaagaaaaaaagagagaagaatcaaatagacacaataaaaaatgataaaggggatatcaccaccgatcccacagaaatacaaactaccatcagagaatactacaaacacctctacgcaaataaactagaaaatctagaagaaatggatacattcctcgacacatacactctccaaagactaaaccaggaagaagttgaatctctgaatagaccaataacaggctctgaaattgtggcaataatcaatagtttaccaaccaaaaagagtccaggaccagatggattcacagccgaattctaccagaggtacatggaggaactggtaccattccttctgaaactattccaatcaatagaaaaagagggaatcctccctaactcattttatgaggccagcatcattctgataccaaagctgggcagagacacaaccaaaaaagagaattttagaccaatatccttgatgaacattgatgcaaaaatgctcaataaaatactggcaaagcgaatccagcagcacatcaaaaagcttatccaccatgatcaagtgggcttcatccctgggatgcaaggctggttcaatatacgcaaatcaataaatgtaatccagcatataaacagagccaaagacaaaaaccacatgattatctcaatagatgcagaaaaagcctttgacaaaattcaacaacccttcatgctaaaaactctcaataaattaggtattgatgggacgtatttcaaaataataagagctatctatgacaaacccacagccaatatcatactgaatgggcaaaaactggaagcattccctttgaaaactggcataagacagggatgccctctctcaccactcctattcaacatagtgttggaagttctggccagggcaatcaggcaggagaaggaaataaagggtattcaattaggaaaagaggaagtcaaattgtccctgtttgcagacgacatgattgtttatctagaaaaccccatcgtctcagcccaaaatctccttaagctgataagcaacttcagcaaagtctcaggatacaaaatcaatgtacaaaaatcacaagcattcttatacaccagcaacagacaaacagagagccaaatcatgggtgaactcccattcacaattgcttcaaagagaataaaatacctaggaatccaacttacaagggatgtgaaggacctcttcaaggagaactacaaaccactgctcaaggaaataaaagaggagacaaacaaatggaagaacattccatgctcatgggtaggaagaatcaatatcgtgaaaatggccatactgcccaaggtaatttacagattcaatgccatccccatcaagctaccaatgactttcttcacagaattggaaaaaactactttaaagttcatacggaaccaaaaaagagcccgcgtggccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataatgccgcatatctacaactatctgatctttgacaaacctgacaaaaacaagcaatggggaaaggattccctatttaataaatggtgctgggaaaactggctagccatatgtagaaagctgaaactggatcccttccttacaccttatacaaaaatcaattcaagatggattaaagatttaaacgttaaacctaaaaccataaaaaccctagaagaaaacctaggcattaccattcagtgtgacatgggcgtgggcaaggacttcatgtccaaaacaccaaaagcaatggcaacaaaagacaaaattgacacatgggatctaattaaactaaagagcttctgcacagcaaaagaaactaccatcagagtgaacaggcaacccacaacatgggagaaaattttcgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaagaaatgctcatcatcactggccatcagagaaatgcaaatcaaaaccactatgagatatcatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaatgagtataaatcatgctgctataaagacacatgcacacgtatgtttattgcggcactattcacaatagcaaagacttggaaccaacccaaatgtccaacaatgatagactggattaagaaaatgtggcacatatacaccatggaatactatgcagccataaaaaatgatgagttcatatcctttgtagggacatggatgaaattggaaaccatcattctcagtaaactatcgcaagaacaaaaaaccaaacgccgcatattctcactcataggtgggaattgaacaatgagatcacatggacacagcaaggggaatatcacactctggggactgtggtggggtcgggggaggggggagggatagcattgggagatatacctaatgctagatgacacattagtgggtgcagcgcaccagcatggcacatgtatacatatgtaactaacctgcacaatgtgcacatgtaccctaaaacttagagtataataaaaaaaaaaaaaaaaaaaaaaaaaaactgagtctcagcaagtttaaataacttgatcagaccacacattaatgatggagctaggattgaattcagacatgtcctatatatttcattcattcatgagtatattaatttattcagtgaatatctttgtcctaaagaaatgccactgtagcagaaagatggttgcaaattctttgtcactgtgctcattgaaaggcaaaacgtattgttctccccttaaatatagacttgccctgtgacttggtttgaccagtggaatgtggtggaagtgactaagatacttccaagctagcacaaaggagatctgctgtttttgctatcaccttcttggaatattctgggaaccataccactgtggagtgagaagcccaagccatgtaggaggccacagggagcagaaccaggacgtgccagtcaacagcctcaataaccagcaccaaagctagtcatgtgtgtaagcaatcttatgcatcttagggctgttgaacactgagatcattgcagccccaactaacactacatgtagtggaaaaaccacccagcagtatacagtcaactcacagaatagcaagagacagtaaatggttgcttcaaacaaccaaattttggggtgactagttatgcagcagtggataaagagctgcaatatttttcttgaaatgagagcattgggtataatatagcaaaatacaaccctagaaataaaataagtaactataataatattattttggcataatatagcaaaatacaactctaataataagaaaaagcatgaagcaattgcttttctcttgtggctgggcatgatttttatactgaaagcctagtaaagtaggaaaatcagaagagactatggctctttttcttcacttatttattcatgtactcatttatttaaacttactcatttatatattcattaagcccctatttcttgttacatgtgagtgtctttgttaactactgtgggtcatactataaatcaagataagcctactgcctttaagaacttttaggtctaaagaaggtaaatactttttggttgattgactctaatgcattctcaaaacagtaaagtggaagttagaaaaattaaggaaagcaagggggaaaattggagaagcccagtccaagttttaatttttgctgttgataatacacaaggtaaattatgaaatatgtactgtacttatattttaatatttcatttctacccatagaatgttaagccccccaaaaatgaacataaaagagagtgtgtattcaattgcgtttgctcttctgcttggctctccttaaggcttctgagtttctaacctgtcaaaggattagtttccttaaatgcaaaattaagatgattctacccctacctgccccaaggtgtattatgccatgcaaaatgataattatgagataaaactattaaatctttatattggggtcagaacttatttacataaccatcttattcagaccatggcaatgcaaaagtgatattttatgcacttgtaagcagcagaagaaaataaaaattaactgtaaaagctctatccaaacttaattaaacaatgtctccacacattcaaataggagattctaatagggctgaggatcaaaatactcagtcctcctgtcctcaaagctgggtgtgggatgcaattggttccatcagattcctcccccaagaattgttagatttggagctaatggaggaagggcttggattttgagtcactggtcagaaggatgtgaatcaaacactgccccactatcttccctattacacagagaaagcctatattctataacaaaatatgagatccacacagacaaacagaggtgagggacagaccaagtcttgataacctcgcttggtcctctggatcaggctgtgcctaaaactgtgataaacgttcacttcaaagttgtgtgaaccaaaaattctcttttattattcaagttaatgtaagttggatttctgtccactgcttccaaaagaatcttgtctaaaaataaaattaaagcatcagaggtatactgaaatcatctgagacctttcataacttgtttgggcaactaatctcttatgaggataaaagtatcatcattctcagtaaacgaccacaagaacaaaagaccaaacaccgcatatcctcactcataggtgggaattgaacaatgagatcacatggacacaggaaggggaacatcacactctggggactgttgtggggtggggggaggcgggagggatagcattgggagatctacctaatgctagatgacgagttagtgggtgcagcgcaccagcatgtcacatgcatacatatgtaactaacctgcacattgtgcacatgtaccctaaaacttaaagtataataataaaaaaaataaaaataaaaataaaaataaaagtatctctaattgtaaactaagaaagatggtagttaaagcaagggacacaatgggtaacactcttatcctagccaccaacctgattgcattctttactttctagtcaagccccttcttcccttgtctaactacagatcaacacagatttttttctcatctttttttttttttttttttgagacagagtcttgctctgttgcccaggctggaatgcagtggtgtggtgtgatcacggctcactgcaacctccacctcccaggttcaagagattctcctgcctcagcctctcaagtagctgggaaaacttggacaggtgcacgccaccatgcccggctaatttttgtatttttagtagagacagggattcaccctgttggccaggctggtctcgaactcctgacttcaagtgatctgccctcctcggcctcccaaagtgctaggattacaagcatgagccaccacacccagcttaacctgcctttttaatttccaattcacaaagtgctatcctccaggatgccaggaaatgaactgggggacagaagaaagagtcaagaaaagaagataaaacttagcttgtagcctagtggcataatagctaacatgtctaaccattagcaaatgctcaaaaatcctgagcccagaaaagccttattcactacctttacagaaataaatctagaaggttagctatgctgaatatgttagggaaatggagaagcactgctattttgataatcaattcaaaagaaaattaaatttactaatggaaactaccgctattcattttctggacatatgtaaagataaagccagcttaaaacaacaaataaccaacctagtcttttaaccttcagatatggtgcaaaagcatgacctaaaagatactttttcattactagcgaagcaggctttagtctcaaactttaccttagaccattcaacgtctgcccatttgtcttgtactgacttttcctttcagtgccctggatgtcaagggaacttggctgccaaagactgaggctggaatcaaagtgctctgggctttcccaccagaactccatccatggggcatagaagcagacttggaaacagacaagtgctgtgtctgcaaaataaactaactagtgtagggcaaaatgggctctatgctttcctcaaccccagccccaacaaaaagcaagatccttgtggtcattttgcctttgcttacatccactgctgcctgaagctaaagaaaggctccttagtagaccatggtaagcccccttttatcctcctgctgtcagggatgaaagattccaagcctcaagtgcaacacagctgcagacgccgacttttccaaaagataaaaatcaaaacccaaaaaagaccacaagttcactttgaaattaaaaaaaaaaaaaaaaaaaaaaaaaaaaaaaaaaaaaacaggccttctcagagtggctactttccagacaccagacacacaaatgctttaaagacaaaagcaggttgttacatttgtcagggtgaataaaaagcctagagcaggactctcaagtctctctttctgtgctaaggaatgtcttcccaattttttgcagccttgaggaccgggagatgactgggaaattgctgacagggcagggaaagggctatactctacatgctggcattcacagacaaacaccgaggggcagcaacagcaaagaggagtcttggtgctcttcctggagttcccaggctttactggccatggatcctgttattcaatcaaatacttattgtgtgcctactacatattgggcactattctaggccctgtggatgtattagtgaactaagcaggaaaaaaaatcacctactcatgtgaaggttatgttgcaatagactttggggacagagacagacaataaattaaacaaataagtaaagtttataataccttagaaaataaaaagcactataaataaaataaagccaggaagagatataggaattgccagaagggcaaatggtagacttgccatttaaaattggcgttcatggaagattacaggaaaagtcaaagtttgaaagatttgaaggagggaagggagtaaaccagatatttgggaagaagagtggtagtggaaaagagagagcaagagcaaagactgagaggaaggaccttgccagccatgttcaaagaacagtaagcaggattcatgtctgcagtagagacagtgatggggcagaggttagagatgaggtcagagaagcagttttggaccaaattatatatggattgataaaacaccagtttttgctctgatgtgggcagtcctcagaaagttttgagcagaggtatgacacaatataacttggctgctgaattgagaaggacagaagcaaggagattagttaggaggccattacaataatgcaactagtactctggcgatttcaataggcatcttaattttttcacagtctaccttcaaataatactatactacttcatacataatgtaataaccaagtcactgcaacagaatacttccattcctccctcattcctttgtgctattatcatattttactcttatgttataaaccgcacaatgcattattatttttgctaaaaagaaaattattttttcaaagaaatgtaaacatgaggaaagaaagtcttgcatattttcccacatatttactatgtcttgcactcttcattcttttttgaggtccaaagttccctctggcattttccttcatcttgaattttttttttattattattatactttaagttttagggtacatgtgcacaatgtgcaggttagttacatatgtatacatgtgccatgctggtgtgctgcacccattaactcgtcatttagcattaggtatatctcctaatgctatccctcccccctccccctaccccacaacagtccccagagtgtgatgttcccctttctgtgtccatgtgttctcattgttcaattcccatctatgagtgagaatatgcggtgtttggttttttgtccttgcgatagtttactgagaatgatgatttccagtttcatccatgtctctacaaaggacatgaactcatcattttttatggctgcatagtattccatggtgtatatgtgccatattttcttaatccagtctatcattgttggacatgtgggttggttccaagtctttgctattgtgaatagtgccacaataaacatacgtgtgcatgtgtctttatagcagcatgatttatagtcctttgggtatatacccagtaatgggatggttgggtcaaatggtatttctagttctagatccctgaggaatcaccacactgacttccacaatggttgaactagtttacagtcccaccaacagtgtaaaagtgttcctatttctccacatcctctccagcacctgttgtttcttgactttttaatgattgccattctaaatggtgtgagacggtatctcattgtggttttgatttgcatttctctgatggctagtgatggtaagcattttttcatgtgtcttttggctgcataaatgtcttcttttgagaagtgaaattttctttatgatttcttctagtgcagaaaggctgagaatgagttatctcagcttttgtttgtctgaaagtgtcattttaccttcacttttgaaggatattttcactggggatatagaattctaagtcaccatatttttttctgcccatgatattaaagatgccattttattatcttctagactgcattgtttctagcaaaaaatcagtggtatgtcttactttgtttctctgtaagatgcctttttctttggctgcttttaagacttttaaagaatctctgattgtaattgtgatatacattagtatagtgtttttatgcttattctatttgggactcattgagcttcttggatctgtaggtttacagatttcatcaaatttggggatttttcagtcattaattttctatctcctgtcccatcttttcattctgggattccagttacatatgttagaaccctgtgttcccatgggtcactgaggccctgttcattatttttgagctttatttttcctctgagctttagttcagatagtttctactatgtctttaagttatatgattgatcttttttttctggagggtccaattaactgttatcctcatctagttagtttttttattcctgatactgtgtttctcagtttagaagttccatttgattttttctgtatttttcatttgtcacttcattgtgtccatattttaattgaaatctctatacatatttacatggctgttttaaaatctttgtctggtaattccattatttctattattcctgggtctgattctattgactaatttgtctcctggttatgggtcatattttcctgctactcagagtgtctagtactttttaattagttgaaaaacactatgaacattacgttgctgaatatctggatttttctgtcttcttctaaagactgttgaaggttattttggcaagcagtaaacatttcttgcaaatgagattttaaaggcttatgtttatgatctgttaagataagtcaaatgtagcctttaccttagagctaatttagtcctcctactgagacattacccttttgggtatctctaatgaatgcacgaggtgttcagtgcagtctcccaatgtggtgggaactgaaacatctcccagccctgtgtgagatctgggaaaggtttagctcacagttatccagtcacttccattgcccaacctcgtgaagcgtcaccatttgcatgaacatcttagcattcagcaaaaattcaagaagaatcctatgcatatttctggaactattttttatacataattctttcctcctagtgctctgtaccacaaatgtcagtaactttgttctccacaaattccaattttatcccttcaactcaaaagtcctgctgggctttgattatgtttcatttctctgtggcatagtccagaaagtaccttcaggctaaacttggagtgagcttagaaattatcttgtctgttgtccttctctcaggagccacagtcctacaataccggttgtccaacaaccaaaaatcattattttaaattttgttcaattttctgggtttctttatggtgggagagcaaggacagagctagaaagaacttgaaaaggaagtccacatccttcccttttgtagatgaagcaacagagactcagggtggagttgcagtacactcaaggtcacacagctactggtagaagcattaagctcagaagctgttttcgaagtccaatgtctttctcactccagcgtgctgcctcttacagaatgattggtagagtgtagcgtattagtttcctagggctgttgtaacaaattattacaaactaggaaacttaacacaatagaaatttattcttcctggccgggagcagtggatcatgcctgtaatcccagcatgttgggaggccaaggcaggcagatcacttgaagtcagaagttcgatgccagcctggccaacatggtaaaaccctgtctctactaaaaatataaaaataaaccaggtgtgatggcacttgcctatattcccagctatttgagaggctgaggcaggagaatcacttgaacccaggaggtggaagttgctgtgagccaagatctcaccactgcactccagcttgggtgacagagtgagacgaaggaaggaaggaaggaaggaaggaaggaaggaaggaaggaaggaaggaaggaaggaaggaaggaaggaaagaaggaaagaaagaaggaaagagggagggagggagaaagaaagattggcacttgcctatattcccagctatttgagaggctgaggcaggagaatcacttgaacccaggaggtggaagttgcagtgagccaagatcacaccactgcactccagcttgggtgacggagtgagagaaaatgagagtgtgagagagagagagagagagagaaagaaagaaattaatttattctttcccatttctacagaccagaaatccaaaaccaaagtgttggtagggctagttccttctgaaggttctgaaggagaatccattctataactctctcctagcttttggtgattgtttgaaattcttgatgttagttcacttgcagacaaatcactccaatttctgccttcttttcacatggccttatcctatcctctgtttgtttatgtcttctcctcctcttataaggatacttgtcattggatttagggttcacccagtaaactcacgatgattttatctagagatccttcactgaattatatccgcacataccttttctccaaataggggtacattcacaggtactggggattaggactggatatattctttttgggaaggggcacaattcaactctcaaaagatagaaaaggggaaaggtaaataatatagtcaaagtaacaatttgggaatatttatctcatataaaagcagacattgaagtttcccccagctgaatctattttggagaatttgaaagggtttccatctaggaccgtgaaggaaaaaaaaaatgcaaaagcaggttgataatgttatattttacctgggcacaatcatggtactggctcacacctcactacattcattaagtgcatcacgcatttaacaccattgttaatttggccaaataatccaagatgcaacaaggaattattgctttcagttactctaacctcttttgtctctaataaccatatcagtcatgactagaggcttgaatcctgaaaacggggacacgtagtaaagataaattactaacaagcccttacccataataggaggaaagtcatcactataataattctgtttgctgagatgacccaatgccagtttcagagtctttattaggtcaaaaggaaaggacatctaattgctatcttagctatcatttttcactaaccactgaaatgtgtggggttttttttagcatgaagtctttttttttttaatttttccaactttcttagcagtttcagatggtacattgtgagacaaaggcaaaagcaacagggagaatcatctcatgagaaaaattagcaataaagcactgtgacaggacagcaaaggcactttgttaaaaaattatttcaacctgaataatttgacagtgttaatttgttaagaaaaaaatatctagaacacataccaccctgagatccttaagcagttctctgaaactttgtttaatacaaacacttccactgcattgcaattgggaatacatctttcaacccacattttgcctggttataagtcctattgggtactgagcagaggcagtcaatttggtttgctttatgatctgaaccaaacacaaatattaagtgaggtcaaataacacaccccactggcaatcctcaaatctctaaagctgatttaaaagagactgggaaattgagctcaacagaaatggcaaaaataaagaagttcatttttaatgaacaaggaagcctaccaataccaatctccattgggccacagatgcctcattgtgcccaaattggattggaatgcacaagccaacaagcacaagcacaactgcccctccacccccacaaaaaaaatcacaatttggcagaagagaaagatttagaggaatgttaacttaatgcacctaaaattcaaatcatgattagaaaagggtattctggatatgacagtttaaggtaggtaaagagagttacgaatatgttcaaagtaattggaaaatgagcctaataccaagagaattacagaatattggtgatggaagagaattagagaataatttttaccttaaagtgtagatcctgagttcaggaagaagcagttacttgctcaaggtcagtgtctaaaactaaaacgggattagaacccacacccttttgagtctggtgctctctctactctgccaattgttctcaaggctgtggggggatgttaagagtttctcaaagttcacaactgggcctctttctttctctctcctcctcttccttatctcattcttttcccaagcttttattctcattgacagacttagtcatccaaacgtatttctccagttctgacatctctgaactccagacttagaatcaacagttctatttctgggtctcccaggccgctcaaacttaacatgtgcaaatgtaaacatctaccccccatccttcccactacagacttgttcctccctgcttgttctctatctactagatggaactatcatcttaccagtgtcagccttgaattggtatcttttctttactctttccctacagccaaccatcagtaagacctcctaagtgtatctcgaaaacatctatccactttctctgaccccaccttagtccaagccaccaacatcttgttcctggactgcctcctaacctctctctctgttctgatttttccacttccagttcatttgccacacagtagccagagtgatcttttaaagacattccgtttacaataaaatccaaacccctcaccattgcctataagatcaggcattatttgtccgcttacttctctaatctcatggcgtgccaccttcttccttgacccctctgctcctggtatactgaactctctaaattctcaaaacataccacgctttttctagtgcaggacctttgtacatgctgctcccactgtcaggagtgctcttttcattgtgaaaggctggttccttttataattccgggctcatgttatatgtcacttctaaaaaagaggcctttcctgatcactcatctcaatgacatattttttttaatttaatctttcaatttcaattaatctttaatatttcagaaagtatatcaacattgcctaacatgctgttttacacacaatagatacatgatcaatgtttgatataaatatacatatctttaaaatctttggtttaaccagctaaacttttaatattttatgaactagttagccctgagtcataaatttacctactttttttttttttttttttgagatagtttcactctctttgcccatgctggagagcagtgacgtgatctcagctcactgcaacctccaactcccaggttcaagagattctcctgcctcagcctctcaagtagctgggattacaggcacctgccaccacacccagctaatttttgtatttttagtagagacagggttttgccatgttggccaggctggtctcgaactcctgacctcaggtgatccacccgcctcaccctcccaaagtgttgggattacaggcacaagtcagcatgcccggccagatttacttattttttatgagatttaaaactgtttttagagatagagtcctgctatgttgtccaggctggagtgaagtagctattcacaggcatgatcattgcacactacagtgttgaacttctgggttcaagtgatcttccgacctcagcctcccaagtagctgggactacaggcatgtgccactgagtccggtgtatttttataagatttttaaaaagataacatattctaaattatgacgtccacataccatttacttttgtgtggaattataaggtgatattttaaatgatgggaatgaacaagttgacatgtatatcagtaacctctaaacatctatttcaaacatctattaactgaaagtgatgattcctccagctcttatactaagaacttccatacattagagcaatatacatattcaaaaagtgacctagttcaattagacaagtaaataattttcctatgtttaggtaaatttgaaaaatatacataattactacctcatcctagttagaatctcatttatatttattccactatgttcatgattttgtaaccaacttggaaggcatcgtattattaaaagtgtatcagattagctccctcaacttactatgtctagtaaccattctgaagaaataggcactggctttgaatatggcctgttccagtttgtgaacagtcgtaggcaagtaaagttgttgggcaaagaggtgagctataggatgactgagggtaaattgtcactactgtatataaagaagacaaatgagatataggaagagatctgttataataacatatatgacatatatctaagtttttcatatatttcagaattatagaaaaaaaagtatgtaatcttttctaagatgtatggatgacttacttttaataatatttcttgatttataatgtaaataagattaagcgaatatgggttactcttgaatttaaaaattggcacatgtaaatgagcattttaatacaaataattagaatatatttatactgtatacacagctacacaacggaagatactactaaaattttgctctatagcacattaccctagaaaacatagaattctagaattctctttaaaaagatcactgagaattattagatgatgactgtgaaataggttctcccagtacaatactacttctgtcattcaaagttctgacaacagttgtagctgaagactgaagcactttatgagaaagcctcattcttccatcagctgggtcacatccaaagtatttcacctgaatttcttggccaacttctaatcctagggcagtaggatgtttaatatttcattgatcaagttgtgtgttataaagcagtaccaaaatcatatttggatataattttaccattacaccagtatctctgctttcagttattgtggcagtacacactgctccaaattctaattgctgctcctgatcatccttgcggatttcagcaatgaagtctcttgcctcatgcatagcaccgggtgttggtgcaaatatagaaaacgtttcttcatccacctgactaatagttacaactgtttcagcctgaagttttttaagttatatccacctggtccaacaaatttttctcattttgataatggaacctgaacagtttctacaacaggtccattttcttttctagatgcttgaggttttgaaatagctttgttcatgatctgtaaaatctcctttttgccactgaagcttgttgaatagcctccattacaattttcattgttattccaggtaatttaatatctgcctgtaatgcagttattcctttattagtgccagctattttgaagtccatgtcaccattgtaagcttcaattcccagaatatctgttagcaaatgataatcttctatttcacccttctcaagatcggttttggtggccaatcccattgctacacctgtgacagcagattaaattggaagccctgaatccattaatgctaaacttccaccacatgcagatgccatagaagatgacccatttgactctaggacttcagatgtaactcttatggcaaaaggaaaatctttgggaataacaggatacaaagctttctcagcaagagcatcaggcccaagttctcttctatttataccggtgactttgacaatttcattagttgcataaggaggaaactcatagtgcagcatgaaatttttatcttttatcccatttatagttgttataactcgatccaacttaatactggattctaatgaatcaaatgtaacagcacaaagcagctgtgtttgtcctctttgaaataattctgatccatgaagggttttaaacatatctacctcacaacttatattccgaagtaaagtcaaatcccgaccatcgcatcttttgtattcattcaaaataatacttctaaaaactttctttgcaacagtattgaaggattctattatctcatatagatcgacctctggaaatatttcttttagttgttcctctgtatctaatcttattttgttaacagcttcatctctggaaattttatcatgttcataatctgtaaaaactgcatagagtctctccatagtgagtttatgagcatgtttcacaatctcttgtgaaggggtaaataacttctgaggtgtcctcttggtaacaccaatttcttttaccagctgctggatgccctgaattatttgctgggtatatttcactcccactttgatagcgtggcaaaagtcctgctgtaaaatgttctctgcagaggcttccaacatgacagtctgacttttaggtgctccagcaaccactacatttaaagtactagaagacatttcttttcttgttgggttaacaacacattctccatcagtcattcctattcatactgtcccaacaggtccattccaaagaatatctgataatgagagggctacagaggttgccattaattgctaggacatcaagttcattaataccatctactgctaacagattacacagaacctgtatatcacagaagtagccagctggaaagataggtctaactgaacaatctactattcaacgtgtaagaatttctttatcagaagtactaatctctcttctcagagggtttgtgggaattctacctactgcagcagccttttgtccgtagtcaaccaccaaaggcataaactgggaaggggaaggttttgttttactgacggctgtggccattaccgcagtgtcacctgactgtattacagcagagccatttgcaaatctggccagctttccagaggatatttctaatttcctgttgcccaagtccatggccacagcttgagaccctgtgctactcaatagtgctcgcacctgcaactggatgagtgcccgatcccaccctggcagacagaagggaccatcactcagcggccggagccacaggctcagtgaggtcttagcttcctcctgttatcctctgtagcaatgccttagtgtttccttcacagcacttattacaatttgtagtcatttactgatgtgattattggttattatccctcatgagtctcacagctaaatgacagcagggatcaagtctgtcttcttccctgtgtcacagctgtatctggcaccaagcacatacaaggcatttgataagtattctttaacataatgaaaatgaagtacatttataacactattctttctacccaaagagaacaaaaaaattatggacttccattctgtgtcaatatattcaacaggatagaagaaataacacaactgaaggttgcaaaatactgaaagttatcaacgcttattctctagagatccttgttaaacaatgtcccatccatcaagggtgaattagatttgtccctggcttgaggacagaataagatgacttcacccgactccttataaacttataattttatgaaaaatccatgagctctcatctttccagcactctgataacgaggtaattacccttttaatgaaaaaggaagcctttttatatctatccccattgaattatggacctcaaaattgaaatgaagtctaatagacatcaagcacaactacctgccagttcctaacaaggatgaggaaaaaaaaatagtgatatctggggagccaacgggcagtatgacagggtgtccttcctgccttctctgatgacactttgctatcaacaccagttcttccttttgtgccttactcagtttgtaagccagtctgcaacagtagaaaagtcattagtcacccttccctatctgttccatgggctttgaaatgaagccctggttcaggttcccatttaggtgtgactttctccattcctactatgttgactgtaatcaaagggctgggctcagtcctgacaacacgttcagatcccacactgcactagccctgctctagaatctcaatctattttcccagtgtcctaagacctgtcaaagcccctgccaccagcctcttccactactgactgagctcttccatcaaacgactgattaatggaaccacaacaccgacaccccacatgaattgcacccggagcccacaatccatactccttccccatgctccttcagtttatcgatgctgtttaattatcagtagtggctcggattaagccctaaacatctagctaccctgttccacagccaagactgttactctcactcctcactcctaggtcttgcctaactccccccatttcaggtattttatagctgagtctctacaagttatcactcacagctaaattcacacttttacttggtctctacattttaatccttggtgatctctttttatgcaattgccagtttagaggcataatcttgtaaacctttaccttctggacagtagcatcggaaagttcattactttcagttacgatacaacagcgagtgacaaatgcagctttggaaagcggaaaacttctttctccttgagagtctctgcacaactttccacatttggaacccaaggacatttcctttctctctctgctaacatggagtacagaaaggttacattagctaataaaagccctctgctgacaaaagatgcgtttgaaaagtcactcgaaaagggagctctctcgatagctttattaaaataaaatgccatatctttgtgaagttaaaagtctctggattgtggttaaaagtctggtctgctccttatacaatggaaagtctttcaaaagccacgtgtttcttaagctggcctcaccatgcataacagctagaatataaatctagactctcgccgcccatctatcttttcttttctgtgtcatgtagaggttcctatgtgaaggaaagatctccagaataagatgagagatagcttttataagaacaccaaatgatagaaattatggaaatcatgatattgaaataatttcttccaagttaaaacatcaggaacatttttgcttatcagataggcaagaatacttaaatttgaatgttggtcagcattcaacaagaaggcagtgcctagacccttggcttatgaattgggggcaattgcagcttccttcattcctctgaagggttgagaacttatgcaaagccatgggtgcagtgctgtccgacgccctgcagaggtgatgccaagagtaaggctaaatatgccgtttttgagagggagcccagaaagccagacttcagcagacaccaaagagtctattgaactactctgatgggaggatatgcaagagcaatgctgaatagtaacacccctgaagagagacaccatggaaagtagttgtcggacttgtggctacaaacaacaagaaagtccttcgcctggagctgcctctggaaagagcagctagactctagctggagagtctgacagagaaacacttcctagcagaggctcagcttcttgcccttccagaatgagaggctgtgtggttttgtgttcaagatcacgctatgaacatgatatgaacggttggtatgtcgagacaccttcattgaaaagagagaataagaaattgctccctgaaacctagaatagatggtgccccaggattgatcacaataatcattgggaatatacattgtagagacctcagattcctattgcacatgtgtcctacaaagaagggttacagagattctatcttgaattgtttgtgaatttttccacatgcattacttttgctggattataaacttctacaacacaaccatatgtttcacttcttataaaatctctcacagggtctaagtcaaagtcaaaggaccgtcattaatcagttgattggcactagagtggttggcctagcgttggtggacatagtcattctcagtgtcagaaaatcttgcaccctatcggaaaagcgtaagaggaaacacaaaaattaaacagaggatacagcaacataatagttctataaagatagtacatactgggagtctaaaaaacatccatatcttttgacataaatctattgctagaaaatcatcctaccaaaatatctaaagagtaaagaaactttatgaagaaagtcattctttgaacagaatatagaagcagaaaaattttgaaacaatctaaatatcaacaatagaggatatgttatataaactaagaatcttcttctgtgtaaacctgctattaaaaataatgcttaagaagtattttcaaaggtttaacaagtggttatgacgtaatgttcggcaacaaacaattgtatacaaactaggatctcaattatgttgaagtgtgtagaatattgacagtgggtatttctgagtggtaggatttggggtgtttctaattttcttgtttgaactttctattttatacttttcaagtttcctgcaatagtaatgttttacttttataatcaaaaaactattgaaataatactttaaattatgcatgtgaaaagattacctggtccaggtggtcattgtatccagctgaaggtgttaaatctagctagactctggcctgggtcttgagaggttagtatctataccccaccttcccttctaaacaggttagcaagctggcaagctggtaaaggagcctagcctcttcctccctacaggacactgcaacatcaaaacaaagcctctaaatactcccctaaagacaaggaagactaatatctgtgacgtagctattctcttctgggacatagaggaaaaaaataggtctctctcataacaagacaccattcatttctcaggttaagctgccattaccttcgaacacacagaagctgagggctgtttctgcagccctatcctacccagtcagccctctgcgtgctctcaactgctattctcactgcagaccaccattttcagacaaagctctgaaaagccccttaatgcccaagagccacaggttgtgtttgtgttaattactacagggctcagttcacaatatcacttaataaaaattaataattttcaagaatagattcataatcttctcagttatcagaacagctgaagttatttatgtgcttattggaacaatattataaatgtttgctttgttttaatacttcattgatgaatcacataatagtttataaaatcatgtttttacctgatatacttagttggccatgttttcctgattacaacaaacagatgaaaaataatttctgagttatttcctttttccttcagtatctcaaaggatgttcactgtgaatactgacaaaataatttattattattttcctagattctgaccatctgctgctaatcaattcattagaaattcaactcaaaaagaaaatttttggagatagtatgttaatataccagtttagagaaaacaacatacaattacttttgcacaaagtcagttggagaatagtttgagaactgtctagagacagcaagatattctcaagatgctccaagtatccattctgactctatgactattctgagcacaaactcaggattttagtttccttcactaatatctagtaataaaaaacctccatgtgttatttatgagaacagttaagcagataaataataaagtctcctgacacttcaaaggaaaatgaagaaaatatgagtaaatataaaatcaattcatcagatacattttaaattccagctgttagagtcagaaggaatcacagaagatcatttcactccatctcctgggtttatgctgataagctactgctctatccatatgagcgaagatgcagccgcaggttaaggggcaagcctgttgccatacagctggttagcaccaagaagcaaagtgaagttagatttcagtttctagtatcctcatacaggcctcttcccaatgagccaagctacttctcttttaaaaataattctgtctggaacattaagggggtcatccgtactgattcttcatgttttaaatacatattgtttgccagtcattatgctaataagaatacaaaaagaaaacaatatatagtatcagcacttgaagacctcacagtccagtaaggaaaacgtcaacatgaacaatacccatatgatacttgcatagcaatgtgagcacagtgctatgggaacatagaagagggagcaataaattctgctaagaaagtgttaaaaagtttcacagaagagctaggccccaaaggatgagtaagaggtatttaggcagaaggaaccatgaaaacaaaggcagggatgtgaacaacatctttgaggaggagccagcatacagaatgaaagatattgcgcatcaaaagcaaaacagcctttgcttttacacagacctatcatggtaaagcatcctcacagctgtacacatttaggtaatctctgtgttccccagcccctctaaagagcatcactgtgtcctccttgcctatatccatgccctctgtcaggaaaggccttgcccttttcctctatgccaactccccactgtccctcctgatacatctccaatattacctcttctccaacctccctgggagagttaattacctcctcctttgggctcctataacaacttttacatctcttgcaagaggttacttgaattacttgtttacatacatgtctatctcccaaacaagtctaaaaatggtaggcttctaaataattatatgtttgataaatatgaatgaatgaccttttctatggaaagctaggcgctaaaggtgatagagagataacatgcacatacgaactctcaagggaaatagacagacacatagataatgtataagtagaataataattctttgaattgaaatccccagggaaacattttcactcaaccgaaaatctaactgcaatctaaagattttcacatacaaccacttggcattgacttacaactccacctagataggttcataaagtcagatccttttcttgttacattcttagagctcataaaaggtggtctgaaaaggcaactctttgggtataatttagtcttattaaacagaattgtaagggagagaaaatgactgtctagtcctttatcattgggcatgtaatccattataaaggtgttaagctcactggtaagtgtaaaaatgagaggaaatgagtctactgacaaaaaatgcaatgagacaataaactaaaattaatgcttcacaaattctcagcttctcagccttattgtctcaatttgttattctcataaattatcagaaagtaaagcacagccactgctcctaaaaataaaaatcttattaaacttactatgtataaaactgcctgaagacattggctctcctttgacctcatgagttactcaagatactcaatcccagggttcaaaaaatatatctcattagcagtaccagatgtcagcagatgtgttattaaactgcctgtcactcaagcctcaatcctgaaaaatacctaggtcacctaatcctttatgccatccacatcttttcacatataataacaggaactttagtgcctggaattgttattaataataattccaaaaactcaatcatttctgggatgcctttgagttaatgggaaagaagctactatctgcctgacaaattgctgcacactggtaaaagatgattgacagaggatagatagtgtattagcctccttgggctatgtcataatccattcagctggctatcacaaaataccataaaccaggtagcttataaacaacagaaacatttctcacagctctggattctgggaagtccagcatcaaggccctggcatatctcttgtttggtgaaggcccactttctggttcacagatggcaacttcttgctgtgtcctcacatggcaaaaggggcaagagagttctctggggcctcttttacaagggcagtaatcctatttctgagggacctgcccttcataacctaactactttccccaccttccaataccaccacattgaggattaggattcgatgtatgaatctggggtttacacaaacattcagaccatagcaggctaccttaaaaaccacaaaccggtggcttaaacaatagaaatttattttttcatacttttgctagctgaaagtccaagacgaaggtgtcatcagggttagtatgtagcaaggcctctcttcctggcttgcaggtcactgccttcttgttgaatgctcacatgactttttctctgtgcactcacagagaaagaatgaaatgagctctctggtgtctcttcctgtttgtataaggtatcagattatggccccacccttctaagctcatttaaccttaattatctccttaaaggtcctaactccaaatactatcaccttggggttaaggcttcaaaatatgaatttgatgagagacacagttcagtccataacagacagactgatggatggatgtgaatggatggacagatggatggatgcatggatggatggatggatacatggatggatgcatggatggatgcatggatggatgcatggatgggagggacggagggagggagggagagagggaagaagagaaggaaggaaggagggaaggaagagagagaaggacggagggaaggagggagagaaggagggagggagggatatgattaactcatgaaggaggtaggattacgatcagacttaaatctgctggaagcaaaccattgcctgtaaggtaaaaaattgagaagtgttagaaaagcctcacactgctccaacatgctgcacataaacacgagccacagtgcctaaaatttcatattaaccaaagattcaacaaacatttatcaaggaagaactttgtgtctggcactgatctagtgttacagagcatgttaactgaattcctcactgaagacatttatattctaacatggatgaaaaaaaatctatgtataagaaagttgttcttaacctgaattacacaaaggatcacttgtgggactttaaaaaaatacatattccacaatcatatcttctgaatctaaatagcctgaggtaggccctgggcattgagatatatatatataatctctccaggggattctgaagcacagcaatacgaaaatccagtccagactactgagataagcattggccttttcttctaaacactaatgactctagaagataatatgtgaagaacctactaccgcagtgtaaataaactcactagatggctagcaataaatgatccagaacaatatgagactgctgggcaagagaaggcatgattgatttaagataatgtacacgaaacttggtagcagacatgaaatccctttgtaaacataaaagattattactcctcagtaggtcaccattttacaaggcagatcatttcattttaagagcttccaaatactgagccaacacatggtttttttggtaactttcttccaatgtgtctaggtccatagttttcagcgcatgccttctcccgaagtcttcagggtgagactccacaatgccttaggtctaggaccatagccctctgaagttcctgagcaagtctggaccaaggctgatcaagatcactaggcttagcaccagaagtatttgagagtctggaattaatcttgcggccattaccgcgggcttcagtgggttataagcccagggcaactgcatatctgttacactgcagtgttccctttaattccacctgctgccagccctgagtctaatccattcaactgacttctgtctggggttcctgttctccactagagctctcacgggaaccctagcctgtttggttgagctctgatactctggccagccattgccacctgcacacttcagggctggtttccattccctatacatccagtcagtggctgggtgacatttctttactattgacatgcccaagctgctatatggactcctgccttagatcattgattctcagatgggatggttctgccccagtagaatgtttcagaaactcttgatgatatatttggttgtcataacagtaacatctgcctccttctacagcatcaccccatgtttactggcatttagagtgtgggggccagagaaaatagacatcccacaatgaatgcactgtgtaatccacccaaggattagttgtactgtgttctcgaacactcacacagatggaaaacctctctgttagtatctgagcctagaagctaactgtttcacacataatctcaaagtactttttgcagcaagttttaatatgcaactaattttccaggacagtctctagcctgtaaatcatggggaggaaactttaccaaaaattgttcaccaccctgaaaatcacttcaccaacactataatgacattcttgctacttgagtgacaagtacaaagctcctgtaacggtctgcatttgcagtttccattcttcatgtagctacaagcatctgactactttattatgtcttttagtgtaaccaagctcaagcccttaggtattaactacatattatgttacttttaattattttacacttttaaacctttatataaaaattagggcattatattaatttattttctatatgaaattaagtatgtagagatattgtattacctacaagttatattatctgtgagagtaagaagggcactacaaaatgtctgttgggaagaggggatattaggtctgataggtttaagctcagtattagtatttattgagaataaagtgaatattctcaataaaccctgtagataccagccataccctttcatggcttcgcccttacagctgcatcagttcctgcacttcagctcccaacaaggcatcctccaggccaaggatgtctcaggatgccttgcagtcaaatctatccattggcagatgccatcctacaattcaaaaataaaacctaaaaattatttgtgtaattcatttgaattaaaagcatgactcttagcaataatagcataaagagattggctattacttttaaaacctatatttcaataatgctttcacatatattgatttcatttgatattcacaacaacacgatgagatgacagagaagactgtgcatttcttttttttaaattatactttaagttctgggatacatgtgcagaacgtgcaggtttgttacataggtacacacgtgccatggtggtttgctgcacccatcaacccatcattttcattaggtacttctgctaatgctatccctcccctagcccccaacccccgacaggccccagtgtgtaatgttcccttccctgtatccatgtgttctcatagttcagctcccacttatgagtgagaacttgtggtgtttggttttctgttcctgtgttagtttgctgcgaatgatggtttccagcttcatccatgtccctgcaaaggacatgaactcatcctttttcatggctgcatagtattccatggtatatataatgccacattttctttatccagtctatcattgatgggcatttgggttggttccaagtctttgctattgtgaacagtgctgcagtaaacatacatgtgcatgtgtctttacagtagaatgatttataagcctttgggtatattcccagtaatgggattgctgggtcaaatggtatttctggttctagatccttgaggaattgccacattgtcctccacaatggttgaactaattgacactcccaccaacagtgtaaaagtgctcctatttctctacatcctctccagtatctgttgtttcctgactttttaatgatcaccattgcaactggcatgagatggtatctcattatggttttgatttgcatttctctaatgaccagtgatgatgagctttttttcatgtatttgttggccacataaatgtcttcttttgagaagtgtctgttcatatccttcacccactttttgatggggttgtttttttcttgtaaatttctttaagttccttgtagattctggatattagccctttgtcagatggatagattgcttccaccattctgtaggttgcctgttcactctgatgatattttcttttgctgtgcagaagctctttagtttaattagatcccatttatcaattatggcttttgttgccattgcttttggtgttttagtcatgaagtctttgcgaatgcctatgtcctgaatggtattgcctaggttttcttctagagtttttatggttttatgtgttacatttaagtctttaatccatcttgagctaatttttgtataaggtgtaaggaaggggtccagtttcagttttctgcatatggctaaccagttttcccaacaccatttattaaatagggattcctttcctcattgcttgttttgtcaggtttatcaaagatcagatggttgtagatgtgcggtgttatttctgaggcctctgttctgttccatcagcctataaatctgttttggtatcagtaccatgctgttttggttactgtagtcttgtagtatagtttgaagccagaaagcgtgatgccttcagctttgttccttttgcttaggattgtttggctataggagctctgttttggttccatgtgaaatttaaagtagtttttttataattctgtgagtaaagtcaatggtagcttgatagggatagcactgaatctataaattactttgggcagtatggccattttcacaatattgattcttcctatccatgagcatggaatgtttttccatttgtttgtatcctctcttatttccttgagcagtggtttgtagttctccttgaagaggtccttcacatcccttgtaagttgtattcctaggtattttattctttttgtagcaattgtaaatgggagttcactcatgatttggcttcctttttgtctattatttgtatataggaatgcttgtgattttgcacattgattttgcatcttgagactttgctgaagttgcttatcagcttaaggagatttgaggccgagatgatggggttttctaaatatacaatcatgtcatctgcaaacagaggcaatttgacttcttctcttcctatatgaataccctttccttctcttgcctgattgccctggccagaacttccaatactatgttgaataggagtggtgagagagggcatccttgtctcatgccggttttcaaagggaatgcttccagcttttgcccattcagtgtgatattggctttgggtttttcataaatagcttttattactttgagatacgttccatcaatacctttaacatcacactgtcaacattagacagatcaatgagacagaaaatgtacaaggatattcaggatttgaactctgttcaggaccaagcagaccttatagacatctacagaactctccaccccaaatcaacagaatatacattcttctcagcaccattttgcacttattctaaaattgacctcataattggaagtaaaacattcctcagcaaatgcaaaagaacggaattcataacaaacagtctctcagaccacaatgcaacaatcaaattagaactcaggattaagaaactcactcaaaaccacacaactacatggaaactgaacaacctgctcctgaatgactactggataaataacaaaattaaagtagaaataaataagttatttgaaaccaatgagaacaaagacacaacataccagaatctctgggacacagctaaagcagtgtttagagggaaatttatagcactaaatgcccacaggagaaagcagggaagatctaaaatcgacaccctaacatcacaattaaaagaactacaaaagcaagggcaaacaaattcaaaagctagcagaagacaagaaataactaacatcagagtagaactgaaggagatagagatacacacaaaaaaaaaaaaccttcaaaaaatcaatgaatccagcagctggctttttgaaaagattaacaaaatagatagatggctagccagactaataaagaagaaaagagagaagaattgaatagacacaataaaaaatgataaaggggatatcaccactgatcccacagaaatgcaaactaccatcagagaatactattaacacctctacacaaataaactagaaaatctagaagaaatggataaattcctggacacatacaccctcccaatactaaaccaggaagaagtcaaatccctgaatagaacaataacaagttctgaaattgaggcaataattaatagcctaccaaccaaaaaaagcctgaccagacagattcacagccagattctactagaggtacaaagaggagctggtaccgttccttctgaaactattccgaagaatagagtaagagggactcctccttaactcattttatgaggtcagcatcatcctgataccaaaacctagcagagacaaaacaaaaaaagagaattttaggccaatatccctgatgaacgttgatgtgaaaatactcaataaaatgctggcaaaccgaatccagcagcacatcaaaaagcttctccaccacagtcaagtcggcttcatccctgggatgcaatccgtcacataaacagaatcaatgacaaaaaccacatctcaatagatatagaaaaggccttcgataaaattcaacaccacttcatgctaaaaactctcaattgtgtatttctgtatctgttttaaaaaagaatcttgaggctctgagattctgatcagctcagtcacagagctagcaagagagctgggattagagtctacaccttcagaagccaaaagctgtgatattttcacctacataacactgcctctaaagtgagacaagtaacaacaggaagaaaagaacaacagaaagaacaaaattaaaaggatcaatatgaaatgctgaaacatgtaaatactaacagggtaatggtaatttctgaaagcctaaagaggaaaattccacaccacaatccaagagatctgattaagcaggctattttgtcatgtgaacatactcttctatggcaacccaccacagctcacatctttgcacccattgtatagaatgcctgtgggcacacacaaatggctcgcaaagacgacacttaaaaatagctgtgctgccctctactgttgaaaaaagagcaagcatgaaaacggcaatcagatttgctacttgtgtgtcttaagctgataagtgaacagcagcagagtgctacaaacaccatttcattattatcagtcagtggttcagtagtaactttagcattgaaataaatattttgacattaatgagatcaaacagtttatttggcttaataaagacaatatcataattgtttattgttggtgctatccttgttagttggattgtctgcttaagactagctgaatagacatgaatattcagtacttaaagcttgttttcagattcttgtaatgtcagggctaaataaaacttaaaggtcacatagaggtaaatggatgttttacatatgacaactctgatccataggcagcagctgcctggagaaatgtgtaaataaggattttgagactctgttcaagctcagtgacaaagaagattacaattgattagtaatgtcttccaagtaagagaaagtgagataatgctatacgtgcaacatccatctgtccatgggctaaattagactgccatccctaggctcgtctgatcactttacagataaggaaatcaaggcccactgagacgaaattgcttgttaaagatctcattgctggccaggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactggggaggctgaggcaggagaatggcgtgaacccgggaagcggagcttgcagtgagccgagattgcgccactgcagtccgcagtccggcctgggcgacagagcgagactccatcccaaaaagaaaaaaaaaaaaaaaaaaagatctcattgctgctggaaattagcctgggtcaatcctattactgggtatatacccagagggatataaagcactctaccatatagacacatgcacacaaatgttcactgtggcactgttcacaatagcaaagacatgaaatcaatctaaatgcccatcagtgacagattggataaagaaattgtggtacatatacaccatggaatactatacagccataaaaaatgaaatcttgtcttttgcaggaacatggatggagctggaggctattatcctcagcaaatgaatgcaggaacaaaaaaccaaatactgcatattctcacttataagtgggagctaaatgataagaacttatgaacacaaagaaggaaacatcagacactggggtctagttgagtgggaaaggtgggaggagggagaggagcagaaaagataattattgggtactgggtttaattcctgggtgatgaaataatctgtataataaacccccataacatgactttacctatgtaacaaaccttcacatgtaccccgaacctaagatgaaagttttaaaaaaaatacctgtaatgtgaaaaccctttactagtgggattaatattgtttgggcaattatcatcactgtacaagtggctgttaatagcattttccacttgctctgtgctgggcactgtactatattctttaccaactattatcttatttaattatcaaaggctctttggcgttggatattattacccttgtttttttgttttgtcttgtttttttcctaaaaaaaagaaagaaattaagctggatcaagaattcaagcatcctgtattctggaacattcttcttgccattagatataagtttcttagctaggcctccaggaatggaggacaagacatttcagcccaaactttataaagtaacaagtgatgttcattctcaatacagctttaagataattctttactgtcaccaaggcacatattttcttctttacatagaccaaaagcctttgcgaaagatagggcacaggcaaagccttttcatcttacaattgatctttttgatgatttgttcataaagaaatagaatttcccattgtggagtcatttccatggttacctattgatttcctataggaagcatgctgtttacacggccatcaggtctttattgtggagggtaaatcaccctctgagttttcactttatctgcaacctgaggcatgtaaaaatgagctctgcaaaattaccagaacaagataaataaatgattcatgtgaattggttttgcatgaataagtgattaatcctctctttcaactttgctatgagagaatgcagaattaatgtaattctatgcaaacagaatccacttttctgaattctgacctaattgttggtatttgtgaggcaaaatacatgtaaaatttcctgtagtttttaaaaaactaatgatactgctactgaaaatcaggaaccaaacttctctttataaaccttaactgcagatgcacacggatgagattgtgatttaccctaaaagttccttcaaagcatcttgtaatttggcattccaaaggtatatgaccttagtgttccaaaataggacttagaattgctcaccaaatagcctagtctttaaaccagagtccatgtggcagccttagcagcctgaattaattaggctcttggaagaaacacacctaggactctggagttttcacataatgagaaatcagtagaccattcaataaatcagtagaacactcaacccaagaaaacatccacaaaaataaaatccctttaattggggacataaaataacaattctattctatgaagatgtgtctcagcgttacgctagaagtttaggtctctttctccaagagtatttcacctgtagtcaggaactttaaacataaacccagaccaaccaagtgattctataaaagtcacaaaataagaatactaggaagaggagataatcttggactggaagataagcagagaaggcttcttggtttgtgcaaaattgtggcttttgccattactttcaatggcaaaataaattttggcaaaactttttgttaggagacttgcagaagcagtgagatttgaatagatacaaatagaaaattatagtagctaaccagttagcgagcatttaccataggacagacgctctgccaaaccctttatactctatcttatcttcataactatccaatgaggtgagtaagttattattctcttttttataggttagatcgatgagattaggccaggcgtggtggctcatgcctgtaatcccagcattttgggaggccgagatgagcggatctcctgaggttgggaattcgagaccagcctgaccaacatggagaaaccccgtctctactaaaaatacaaaattagcctggcatggtggcgcatgcctgtaatcccagctacttgggaggatgaggcaggagaattgcttgaacccgtgaggcaaggattacgatgagctgagatcacaccattgtactccagcctgcgcaacaagagcaaaactttgtcacaaaaaaaaaaaaaaaaaaaaaaaaaaaaaggctgaggtgttaaacaactagtgtgacagggctagttccaatgattccaatacatactgtctcctaagtctacaatcataactaaaccatttcagtcagagggaaatagggaatatagtggcaaggaagcaaatcacatagcaagagggtgacagaggttaaatcactacatcaacagagagtggtgtagtaaagggaggaagggctgggaaaactgcatgagggtggattacagagagctctgaatgccattcttggtaggataaaatgtgagaactgaaccccaactgagaaggtgccaattaattcaggtggcactgacctgtgaggctgaggaggtcttaatcaccagaacactaaatgctcattatccaaccttttaattagcaaagaaactaccctgtctggaaaagttttcagcaaagaactaagatttgatcatgctgttaaagaaaaaaaaagaaaagaaaaaaacaatcctctgatctctcccaggcaacaaatcttgtatttcagatgtatgttttcatatcttccaggtcccaattggagagaaaatgaggaaaaggaggaacagatgggactaaaagcagaaggcacctgatgaaagagaaaaagcaaggctgggggaagggtgtttagagaaggactgggagaacaaaagcaaagaatctgaaatgtaaggttatctcctctgctgaactacacacacaaagttgttctatttactgctttgcaatattgagtgactctatcaagtactggtggcgatcggtgcctaggaataatcacatggatctctcaatagaaagctcactttacagaatcaggtcactaataagggcctggggcatgtatatcaccatgtaggtgtgaaaatgcaggacagggtcaggctatgccaacatctttgtacatgtgaaaaatgaaacccaagaaggtcaacagaaagggcattggcctgggaatcagaaaggtagtcctttccctgaaagaggataaatgtattttcccaaggtgacaaggtaagtagtagagtgcctacattttgtttcttgcctcttaggagagcatgctttcttccgttcccatgaacttcagaatgagccacatctttactcaaagcctcctctgctatttatatgtgtgaccttaggtaagttattatcctctttaccatacagaaaaataaaacaagttctttgctttcaaacagctaaattaaatcaggcacaggtaggtaggcaaggtccaacaggaggagttggtgttaagtgattcaactttgttcccagcaccaggctcatattataattatcactaagagtagaatttaccacttcagtagaggaaaggctccccatgcttttccatagcttccaaagttggtttgatgattatgggggaagagaaggaaattgggacaacaccttcgatactagacagtatttatcagtcactcagagctgtccaccgtgcttacagcttggtggatattatttcattcaatcccccagtaatcctttagattattatttcaattgtacacatgagaaaattgaacttcagaaaaattaagggacttgcccaaatcccactagatttagcaccaggctccaagctaatagcaaactagagagctcttatgggaacaaccatattactgcagctttcccagtgtagttgtcatgaccaactcagggttctccagtccaaacaaggaggtcgtgctaatccattcatacatcttaactcccggaaatcatttccattccccatggagcaaaattttggaaagcagattcaacaaattttgcaaggtactgggggcaatgtggctattatacagaaataaaagacaactttcctgtcctccaagaacttatagtttggcacgaaagtggtaagtaaacagacaacagcaagttagacatcttcttcagagattatatttgagcagtgcagatgtacaaagaaaggggaagaaagtgaacagggagggagacattgaggaaaagctgtggtgggagggagagaaggaaggagggagggaggcaagaaggaaggaaggagcgaggaagggaggggaggggagggagggagggagggaggaggcaggctttgtatgtcagggactgtgttagttatattgccttatctcttaattcttccaacacctggttgtcgatatcattactcccatcatattcctcctgctaaccttcatcacccttagaatgacctagtcttgcatgatatggttcctgccttcctctgtggcatacatcctaccacactgacccctttactatgccttgaatgtatcagtctctctttaacctcagggcacttgctgttctctccagctcaaatgtcccccaactccctccagatgtccatatggcctgcttctctctctcttccttctactcaaatgttgcttccacagaaaggctctccttgatccccctaataacccacctctcagctccactctcttctccttactctggtttatttttcttcaaggcacttaccattaccaatctttctttatttgtatttgttggttgcttgtctccccattcctccactagaatgtaaacatttattctctctcaggatagtaggcagtgactgtttatttttatttatccccagaggagtctcagcagtgcctgacatatagtaagtgctcaagagaaattttatgaatgagctaatgaatctgcctttgcaagatatggaaactggggttcagacaagttatgcatcttggccatgtcacacaaatggacctaccaacttcatgacattgttatgctcactcctgcctcaggctttgggccttgaaaatctctcctcctgcaggtctgctgatggatcttcgcagagctggctccttcccatagcttcagaagagccttctggggtcacctcctttaaaattgccccttccactcccattaccctatttaacattctccatgacacttactactctctgaaattaccttattttcttatctcccttattagaatgtaagtactagagaaatcagaccaatgagactatttctttctcattcacagcctgcctagagcagcacaaacaatgcaaaaacaaaccaaaaaatgaataagcgtgtgtatgtaggtctcttagtaccatgcttggcccataacaagtgcttactagctactagttactaattttttagtagtagagatttaataggaaagattataggaaaagaaactcaaaacaagggaatagtgtgaattaaagactagcttttcttaaactatgttgccaaggtagttttacccacaagtctgtgtcctgggcaaaaatagtggaaattggcttcagcgcaatcacaagacttctggaggagtctttcactccgtatggatcaaaaatggtgtgtttcaaccaagagtatggctttggacatcttctcgtacaattcacatatttgtcagtcatataaacatttcaatttcaagaatagcatctaatgtgcaatttaatttggcctccattttgtaactctcggagctgcaaatgtagttattttcacttgcagcaaatggtttggttgaatagtgcatggctatccaggactggcagaaagcaaaacaccaatcgataagagcaataaaactggaaatccacaagatgtgtggcctgaaacatgtataatttttaattcataatttacttaaatgattgattctcccaaaagaaagaactgaaataagtgataaattgaagtcttactgtgcagaaaaatgaatacagtgttgatatgtctttaagatttctccacaaccaacagagaagagaaggtaacttctggaccctgaagtaaatcttatttttatttggggaattatttggacatagctgctattgccaaaaaaagattaatccatactatgcccacctcccacaggctctacaaccattccaaagaaaaacaggtgaggagctaaatgatgttgcaaaaatcagtgaatttggaataaaaaacatctgtattcaaatattgactctgtggtaggtaagactagaggatcagacaggagggcaaatatgttgaatctttacttaaaggccaactcccttgctgcctacttttttttttttaagagacagattttgctgtttcccaagctggagtgcagtggctattcacaaatgcaatcatagcacactacagccttgaaatcctgggaccaatcagtcctccttcctcagcctcctgaatagctgggactacacctacctatttttgtgctctacacttatctatttcccttaagaggtaagggttagtatttaagacttgtcccttgaagcaggcctcccaagaaacaagtgggctttctgcaaagtaccaacgaaactggcaatggcctaaatcttaaggacattaatcctggtcaatgatggcaagtcctggatcccagtcccccagttatgtcagattctctagctatgaatgctgatgtggcaaatccagccgacagcttgctagactatacagctgcaaccacaagagttggactccagcctgctaattactccaggggagaggctggtgctaccccagacataaatgctgagttagcagcatggagctagagccagctcatattgctgttgtatcctggctgatctctgaatatagcaaggaggaggtgatgcttccctaataattcaacttgaaagccccaaagcccaaggatggggatctatcccagaaatctgacttgcagtcatgctgaattgctgtgtactaccctagaatgtgataaacaaaagaaaaccacacatctgctactgcatacgttcgtaagtttgcctctagggctgatatacattctggctgtatacattctggttatttgtatatcagccctctagggctgagataaattccggctctacacattctggctatttgtcctggtccccacaatacctcattgataacatttatgaagggaagaataatacttcttgataactttttggaagttgacaaaatagaaaaagaaggtccaaatgtctatatttttatgtacacatttatgcatatttacaacttctgatatttcttcttttttctcagattatatgaacctctggactctggagtaagcatgtaaatatatacgtatatgtctgtgtgtgtgtgtttctgtgtctgtgtgtattacttatatttatgtttatatttatatttataggcattttgaggtcctgtggtaaaggccttggtcatgtctgcataaaagtcagcatgggatatcctcaaagctgcaaggctccacctatgtagacactactgggagcaggatgcctgggagacgaagcagggcagcataaatttttgtagcagaggcagcatctacagggggtgtctttgtgtctcggaggattgttgcaaaagagttcataaatgtgcagttccctatcttccccaacccttcaaagatgggaaagaacttcatttagatgttccatcctaccccgtttttttactgatctgggcaataccaggtccccttaacacacacacacacacacacacacacacacacacacacacacacacacacacacttcctgcaatatattgtgctgaaaatcagccttgctgtcacagttccattatcaggagagtttggagtaatgcccagcctagtctataatgaaaaattgtggctcagtgtcctgattaaaaccatatcatcctttcttgtctatagctccgttcttaatttcagtctagcccaagacgctatctaaggtggcttggaatgcaggcccacatgttcctttctgctgtgagtacaagcagaacaggcagagctgggattcaaattgacctctctctgattctgaaccccatggtctttcccatgaagagatctagttttttttgtttttgtttttgtttttttttttcatctgttaggggctgttatgggttgacttgtgtttcctccatcctccctgaaaaagatattttgtagccctaacctctagtaccccagaatgtgaccatatttggagatacggtctttatagaaatattaaagttaaaataggttcatttggtgtgagctctaatcccatatgactggtgtccttatgcacagaggaaatatgaataccaagaaagagacacagaggaatcagagaaaagacagacacctatgagccaaggagaaaggcctagaacagatccttccctcacaatcctcagaaggaaccaagcctaccaacaacaccttgatctcagacattcagcctccaaaactgtgatgcaatcagtggtgctttgttatgccagtcccaacaaactaatacaggagaaattcagagttttcaaactggaagtgcatgtccgtgaacattagattgttgcagccatccaactgtacagtgcacagctccagagggcagtattcccagggtcacatcatggtgcattcctgcactagacgtcatacaccacacagcctcacacagtggtccctgaccaagctgacacagatagagtctcctcctgtgagacatctgttacatatgttacatgtgttaaacctgttataaattcagttaaattgccctcaaagtaaagattataaaagaaggatgttaagggagatactgttggatttgttgcagtgcatttaaaaatagataacttcaaggccatggaatatgggactgttttttagcacaaaattataaaagtggagaactaatatatgttaacctatcgggaaactcatctgagtatgagctgggcagacgttttgattgtctatggagggctggacttcccacttttctcccactcatctgacaggatcagtttttcaggtgatgaattaggaacaaggtgagaaggaggtggctctagacaccctggatatagcactgttttctgttaatgagattcagatggcctgataattaaagctgtctccaaaacagaatggctttcctcatctagcatccttggcacagggtaattcaactgaagactgggttcatttatccattcaactccctaataaatacttatggagtattaggcaatgtcctggatattggaggaatacaaagaatagtgccagtcatatcaatcttgctctcaaagagtttaggttctaaggagaaataaggtagatgcgtagaaaattccaatatagaatataaaactatgtgtcacagaaaaagtgcagttaaaatgccacaggagttcagagtagtttacgaaggaagatattgggacagtgatggcatttaagctatatgaataacattaacagatagagaaaatggcataagccaagatggagaggagaagttgaaggctgactggagtacagggcatgtttttgggagctagaaaatacaattggaaaggtcttctatatcttctttggagatggttttaaccactagaccaggaatgtaagttttattctgaggaccaataggagccactcaaagaagacgaccttacagtgatgttgacagagaaattccaaagataagaagttacccgccaggcaaggtggctcacgcccataatcccagcactttgggaggctgaggcaggcggatcacaaggtcaggagattgagaccatcctggccaacatggtgaaaccccgtctctactaaaaatacaaaaattagctgggcatggtggtgcatgcctgtagtcccacctactcaggaagctgaggcgggagaatctcttgaacccaggaggcggaggctgcagtgagccgagattacaccactgctctccagcctgggtgacagagcaagactctgtctcaaataaaaaaagaagaagttaacctatcaagtgacttctgaaatctccctctcagatcactgagtctctcgattcatgctgaagaagaaacaataatcccttatcatagatatggaccacatcagttgagatagggcttggagggtggggaagctatgaaatccttctgaaagaatggctatattttaggggatcacagagaatgcaaagttcaagcaactaaagggaatagaaaatccaagctatgcggggggctcttccctttctcataatccccctgggcaataagccagttcagagacatcatcagcttattttctcataaacaacaatttatcagtaagaaagtgatatttttcctctttgcctgactccttaacacataattggtagtacctcccataactgattaactcagaacaaagctgaaaagaaaataactattgtgagctggaagaaataaactaaactctaggcgtctttcacctccttagatccatttacagtgacctttagccaagggaagcaatgatttagagagcagctagaaaggatttgtggaatccactgaactggaattcagcacacggagctaatcctgcaaaactgtgattataaaattacaaagcttgaccaaagaaagctttgtgcattctgtggacttgtacctaaaatcacccttagtctgaaatatcctttttgtcttccacaggaattggctaactgtattgctctatttatgccatctttgcaactaaatactgtgattaacttgaagtgtggtttccagaaatttcttatgaggaaacagataaatatggaaagatgtatgccgaaagatgtttactgcagcaatgcctaagataaagactgaaaacaatataaatatccatcaggagacgattgcttaagtatagtacagtaacacactggactatcatccagccaataagcagactaagttagatactaacaagattctaacaataaacacagtaagttagtactaacaagaaactatgtccatctgttgcccatgtgtccattaaatattgctaagaaaaagaagtaggacgcaaatagtatgtgtaatatgaactaatttttaactttgtatgtatgtttgagaaagagaaaagcgtaaaaatggtgaatcaaattaacagtgattttcatggaagactgggattgtagtgaatccttcattttctccctatgcacttctgaatggcttggattttgttacaatgagtatgtactgtttttataattagaaaaatgatattcctattagaaaaggaagataaagagactaattcttcactatgttttccaaattttaatattacttatatcagagattattttaagatattttaaactactcagtgtagtagaaacaatactggacctacaagccagtcttcagttgtgagttccagctctctgtttttcctatctgagcctcagctgtcttcatacacaaaatgagtggctgtatttactgactcacaaagtccctactagtactcacatttcataattctaactggaaataaatacaccaggcattcaatcctgtcttatgcaatatggcctaaaatgaggcccacaaactgctataatccaaagacaagtggactcttggaagagctgaattacataatagaataagtttctatcatagatccccagggaatgagtcttttttatacacttaccgtcagaagttctgtcaaaaattctacaatcatctccagccccaacatacacaatttactagacaggaaattgaggccacagaggcaaagggacttgtacaaaatctcacagctaatgagtagaaaattcaggattacaaatatttaatcatttctgggctgggtgtaatgcttcttagatcttagagttcaggctaaacatgtgataggttcaaaacaatgctttgaccgtcccccacagccctacaccaaatgaatttctttatgatatcctccacagcccgatccacatctctgaaactgaaacacattaaaaggaaaagatttttgaagaagtataatttccatttcctttttccacccacatatgtgcaggcacactgatataaaaagggactttaaaaaatttgtggaatcttaagcaaaaagaacaaagtcagaggtgtcacattacccaacttcaaactgtaccataaggctacaataaccaaaatggcatggtactggtacaaaaacagacacatagaccaatggaacagataagataacccagaaataatactgcacacctacagccatctaatcttcgacaaaggcaacaaaaataagcaatagggaaaggaccccctattcaataaaaggtgttggaataaatggctagccatatgcagaagaatgaaactggacccctacctttcaccatatgtaaaaattaactcaagatggattaaagatttaagtgtaagacctaaagatttaaataaaagaatcctagaggaaaacctaggaaatacaattttggacatcagctttgggaaagaatttgactaagtcctcaaagcaattgtaataaaaatgaaaattaacaagtgggacctaattaaactaaagggcttctacacagcaaaagaaactatcaacagagtaaatagacaacctacagaatgggagaaaatattcccataatatgtatctgacaaagatctaatatccagactctacaaggaacttaattcaacaagcaaaaaaataataataataacatcattaaaaagtgggaaaaggacatgaacagacacatctcaaaagaagacatacaagtggccaacaaacatatgaaaaaacgctcaacatcactaattatcagagaaatgcaaaccgaaaccacaaagaggcaccatcttacaccagtcagaatggctattattaaaaaatcataaaacaacagatgctggtgaggctgtggagaaaagagaatgcttatacattgttggtgggaatataaattacttcagccaatgtgaaaagcagtttggaggtttatcagagaccttagaacagaacttaaaatttaaaacattcaaaccagcaatccaattactggctacatatccaaaagaaaataaattgttctaccaaaaagacacatgcatttatatgttcatcacagccctagtcacaatagtaaagacatggactcaacctaggttcccatcaacagtggatcagataaagcaatggtccccaacctttttgacaccagggactggttttgcagaagacaatttttccccatatggaggtggggaggggaggtggggaaatggtttcaggatgaaactgttttacctcagatcatcaggcattagattctcataaggaacatgcagcctaggtccttctcacgtgcagttcacaatagggtttgcactactatgagaatctaatgccatggctgatctgacaggaggcagagctcaggtggtaatgctcacctgcccaccactcacctcatgctgtgcggcccagttcctaacagcccatggactggtaccagtctggggcccaggggctggggaccccttgggtacagaaaatgtagtatatatatgccatgaaatactacacagccatagcaaagaatgaaatcatgtcctttgtagcaacatggatgcagctggaggccattatcctaagtgaattaacagaggaacataaaaccaaatactgcatgttctcacttacaagtgggagctaaacattgggtactcatggacataaaaatggcaacaatagaaactgggaactactacatggggaaaggaggaaagtgaggaaaggggcaaaaaattatggggtgctatggtcactacctgggtgatgggatcattcagacctcaaacctcagcatcacatagtaaacccacgtaacaaatctaaaaccatttttctggaaaaatggaattaaaagataaaaataaaaaatataaactttatttctctataccatcaccatcaaattcatgacatttttttaagtgatgatactagccatttagccatccctaaaggactgagggtcctggtaagttaaccatgtctatacagtctttctacttgttaataaaataaaatgagtgtcttttaaaggtttcttaagattagaaaacaaaaagaagtcagaagaagtcaaatcaggacggtaaggtggatacctaatgagttcccatcaaaactcctgcaaaattgccctagtttgttgagaagcatgagcaggagcattgttgtggtggagaaggtctctctggtgatgttttccaaggtggtggtgtgctaaagctttggctaactttctcaaaacactcctaagaagaagatgttatcattctttggtcctccagaaagtcaacaagcaaaatgccttgaacatccaaagaaactactgccatgacctatgctcttgacagttctgcttttcctttgactggaccatttctatccctttgtagccattgtttcgaatgtgctttatcttcagcattgtatcagtaaaaccatgttccattttctgttacaattcttcaaataaatgctccaggatcttgatcacacttgtttaaaatttccattgaaagctctgctcttgtctgcagctgagctgagcacaaaagtttggcacccatccagtagaaagcttgttcaactttaatttttcaaacagaatgtggttggaaccactatctatggtgtatactattgtttgtgttgttaatccttggtcctcttcaatgagggcatgaacaagatgaatttttttcttccaagttgatagggatggcctgccactgcaggcttcatcctcaaaatcatcttgtctcttcttaaaacaaatcatccatttgtgaactgctgatttctttggggcaccatccctataaccttttggtaaagcatcaatgatttcacccaagcatcattataaatttgatgttcatattgctctgatagggctcttttcaaactgatgtcttatccttcttattatctcaaagtagtttctgttcagacatgttataattagtacaaatttattttgatgcaaaaaaaaattttaatctatgcatagttttttcataacacacattttctatgaacttgtgaagagccctcatacacctctcacttactttgtataatttactttcaagctgcaaccacactcaaggtgtgggtcacagctatcctggccacgtgcaaggaacaaaacaaaaaacgactttaagatggaagatatattaaaaattagggctgacttagaagtgtagagcagctgtgtttaataaaaaatcatgaaactaggaaataaaagacctaggttcaagttctacctctgctactcagttgtggtaggaccttggtcaagctatttaagatttctaagcctagtttccatatgtataatttaagaaccattcactcattctcatggtttttatggtatagagggagagttaagtattaaataatcatacaacaaatgaatgaggatttgaagacaactaatatggtcctttcagagaatagaacaaaagtacctgacctccttcgtagcaggtgatgcttcaacttggatttgacagatgagtggtcattaattcactgaaaggaggaaggagttaagaggaagtatattctaggagaaggtaccaccatgttcaaaggctccgtagtggcaggaagcatagctggtttgacgaaatgaaaagaaggccagcaaaaatggccattgaaaagtttaaaatatgggagtgaatgttacagggtagctgtgagatgatatgaaacagggcacagaacatttctttaagtatgaaagcacaaaatatattaggtgttgataggataaaagtatacaaatcatctaaaagaactcttccccaacacaaaggcactgtcaaaacattagctggtgttgttcagtgactagggtactctgctaataaaggcaggaatggaataaaacatcaccacagtgacttttttcaagttgaaaatcttgcagcagaaagaacaaaagatacaggttcaccacgcataaaagaacctgactgtagggcaaacaaatgacagaatttgtcagaaatctccactgcagagccaccaatgaataccaacctagtttgacacagtacaggtgaaatgccagaagagaagcccccaggttgtgatcaaatgcagctgcttggaaacaattcaaaatgcaaacaacagacttcctgaactcctgggtcaagtttcaaccacagaaattataagctgactttgtcacaacaaaaatttgtcccacaaaatggatattttctttcgagcttgcatgaaactcaaaaaaaaaggtatcaatagaatggataggtcatttgtctctcaagaacactgctggggaaattacttataagacttataaatgagggtgatataatgtcagctctgataaggatattaattaaaagaaaattgactgttgacatttctgcaagttcagactatcagatcaaacacaaacccaaaggaagggagaaggtcaaggtgatattctataagccagaaagtagattaaaagtttctggacaagctaagatatatgaaattgcagacctgtgggcttttatgcttatagaaaatctaaactagaaccatctacaacttaaattggaaaggaatttgtagaaacaatgtactagatagcaatcagcatgataatacagagcacatcaatgtaaatttccttttttgacaaagtgaaagaccacataaacaaaggagaaaaggggtatataatctattataaccttagcaatcttttcaattctgccatgcaatacatagtaccatataagataaaaatctagatttttatagtaatgagatgactggaaagttatatgcaaaaagtggttaactaaacaacaggataatgtatactacaattttaaatatatacaaagctatttaaaaactaattgaatactaatcaaagctttggaaagagaaactagaagcaatttgaaaaaccagaaagaaaaagatggatatactatgtcacctatacatgaacacatttctgaatatcaaaagcataaccccaaatagagataaattatagattggggaaaacattgccaaataatatggtagacatcagattactatcttaaatatacaacaaggtcactaagataccaatgagaacaggggtaaagaatgataaagacgacagaattaaggcctgttttttatttgtttgtttatactttaagttctagggtacatgtgtacaacgtgtaggtttgttacatatgtatacatgtgccatgttggtgtgctgcacccattaactcgtcatttacattaggtatatctcctaatgctatccctcccccctccccccaccccacgacaggcccccgtgtgtgatgttccccttcctttatccaagtgttctcattgttcaattcccacctatgagggagaacatgtggtgtttggttttttgtccttgcaatagtttgctgagaatgatggtttccagctttatccatgtccctacaaaggacacaaattcatccttttttatggctgcatagtattccatggtgtatatgtgccacattttcttaatccagtctatcactgatggacatttgggttggttccaagtgcacttcatgtctaaaacaccaaaagcaatggcaacaaaagccaaacttgacaaatgggatctaattaaactaaagagctgcttcctcacagcaaaagaaactaccatcagagtaaacaggcaacctacagaatgagagaaaatttttgcaatctactcttctgacaaagggctaatatccagaatctacaaagaacttaaaaaaatttacaagaaaaaaacaaccccatcaaaaagtgggcaaaggatatgaacagacacttctcaaaagaagacatttatgcagccaacagacacatgaaaaaatgctcgtcatcactggccatcagagaaatgcaaatcaaaaccacaaagagataccatctcacaccagttagaatggagatcattaaaaagtcaggaaacaacaggtgctggagaggatgtggagaaataggaacacttttacactgttggtgggactgtaaactagttcaaccattgtggaagacagtgtggtgattcctcaatgatcttgaactagaaataccatttgacccagccatcccatacccaaaagattataaatcatgctgctataaagacacatgcacacgtatgtttattgcggcactattcacaatagcaaagacttggaaagcctggtttctaatgaggttttgtttagggtcattgctttgattcctctgtgtatttgttatctattgtcatataaaaaatacctgaaaactaagtagcttaaaacattaaacatttattatcttacagcttagcagcttagttggctggggcagcagtcatctgaaggcttgactgggggtggatgatcagtttccatatggttcacacacatggttatgggcaggaggcttcagtctcaccacataaacctccccgtaggctgccagaacatcctcacaacatggaagctgatttccccagaatgaatgatccaagaaagagcaagagaaagtcacactatattttgtgacctggcctcagcagtcacacactgccatttccacaatatcctactgattacacaaatcagccccatccagtgtgggagaggactaaactagggcttgaatgtcataagactagctactgattaataatagaaaatataaatctttcttttttcactaaatatttattgaatatctacaatgtgccatcgggagttctaccctggtaaaaaccaattcaaaatggtaaacctcacagtcacagaaacctcaagtaataatatcatatttcaacactgagcaacagtgagatctaagaactgcgcattcaggttgcagtctcaactcttcatccctgaaacatctatggatcattatgccaatgggaagttcataactttatttaatggccagaaaactgttcatctacatcgcaatacctcagcccaacatcagatctttcccaagcatgtcaacacaaatttccaaacagagattgcagctctctagctaggaccaacacaagaatcatcaaccaatgtttgaaagactcagatgtgaagcctgtagacattttctagattgttccaaattcattttatgtgcaaaagatgatatttctagcccgccacccctagagtgtgcatttcactttgtctactacccaatcaacacatatttgatggaatgcctgttagattttaggcagtagactagttgttgggaaacatattttgtcttcatgggagaaatagacagtgaagcaaaaataaataaataaacaaactgaataatatggctcatgataaatgccataaagccaataagcagaggacttgatagcgaatgctaagagaagggtagcagaagtggcctgggatgattttctgagataatactatatgccgagaccttggggagctagtcatttttaaaaggccagaaaaaagcactccaggtccagcatttcagactgataagtgccaaggtataaaaatgcttggtaagagcttggatctgttggatgacagtttggctgaaacaggaagcaaggagagcatccctcaaactgaggtaatagcaataagaggcagaagacaaacttttcagggacttaagagctgtgataaagagtttggggtttatgctgagtgtgatagggaaccagcaaatgtttttcattgggcaagtggcaaggtcagatgtaaatttgtagtttgtggcatagtccatgagacctgtggtttgtgtgacagctgccagagagcaccaagggcagtcagggcaaaggaaccaagcggctgattttgcccatagaaagataagacccttggccttatcttcatttgaacagtgccatttttattggggactgaaataaatgcatctgttgctactgatggttagtttgtcctcatttgctgaaagggaaaggtctcttcatgactcatccacaaatcctgctgatcctcctaattaaaaagttttcaaacaagttgatacattacttattaagagcccagacacaccaggcataaatccttcctgccatccatatgtatgccaggacttcactgctgtatctttcatcattatgagggatatccttcaatataattttcatgacaccatctgccatgttcttctctcaactttttttggtggggtgacaactcagtgattatgaatgtcatatctggcatcttttaaaaataaaactctatcagagatctcaagggggaaaacaagtaataaaaacatatccggccaggagcagtggctcacgcctgtaatcccagcactttggcaggtcaaggcaggcagatcacctgaggtcgggagttcaaggccagcctggccaacaccgtgaaaccctgtctctactaaaaatacaaaaaaattagccgggcatggtggcaggctcctgtaatcccagctacttgggaagctgaggcaggagaactgcttgaaccctggaggcagaggttgcagtgagctgagattgtgtgactgcactccagcctgggcgacagagtgagactccgtctcacaaaacaaacaaacaaatatccactggcaagtgctatggaccacagacctaggaatgcattgcaggttagccttttttacaccaaaaacaatgcaactaagaatgaaggtaaactgaatttgtagccttcttagttttcagcaaattaattcttgcattcttttaaaacattgcacgttttcatcagtataattggttatgtgttgcaaactattaaaggtggaaagagcaattcttaaaattaaactctctctccattcaccttcaccttatgtatccaagacctttaaagttccacctcctctgagatgacttctctaatgaatccaaccacatggtttattcacattatgtgacattatatgtggcctctggcatgaaaccattagcaaataagcatggatctaatttgtttttttatatatctccacccaaaataaataaataaataaacagagacaaggacttaggtgcaaggagtttattttggagatacccccaggaagcagcagttagggaatggggagattgaaacaaagaggtaggaagaaaccataagaggtgctgttaaccaccatgggcaagtggtgctcgatgcagctggggactaattcttgagtgacaggtaggatgtacctaagaatttccttctaagggacaggaggttaaggaatctatcatattttctagtggttgaagtttgcctctggagcatcaattttccaaagttctgtgctacccaaaaggcagatcaagccagctcctgggcctttggaaaaagtcttgaggcagaagtgcagaggggtgggaggtgcttaaagtgggatgacgtcattttgcatgggaactgtccagcacagctatagtggaaattagtggtggatcaagagattgtagcagagggcacaaaaagtgtctatttcagcataaaaactgtgttgttaattaaaaataaaattttgtttaaaatgatgtttttaacaatatcactgaagatataaacactcatttctcttagtgtcatagagagactgactgatcagctgactcagtctgagaatgcccaagtattaaatgagcacttgtcgaacactagttgagcagtatgaagcaatgcacaagttaaagtcaagatgcccaactctcaaggagcttgcaatcttacagggattatcaacattcacaaacaaactaacacataactggtagttctgactacaaaggcagaaaaagtgagagacagcatcatgtagcggttaaaagcttccactctggagtcagagagacctaggtttaaaattaatctaggatttgcagtgtgatcttggacaagggtcttaatctctctgtgtcacaatttcttcatctgatggttagaaaaataactatctgcttcatggagttgtctgaaaagtaaatgcaagtaaagcactaatcacagcacccggcacataaatattcattaaatgtcagttgttttgtgaaaattaaagagaaacgtaacagtagaatgggatttaaagaagagaagtatctccttgtcagactctttctctttcttaaatatgaattttctatagcctctggcccctgttctagtaccattttcccttttttaaaagtttcattttctaaaaaagaactacttatattaagattgggaggccagtattaaaagatgtggaaatatagcacaaaatgcacgagctttggagcaatactagccaattttaaatccatgtatcttgccactgaatgaccttgggtaaatctcttaagcacactgccactcagttttctcatctacaaaatgggagcaatataacctgtcactgtgaagagtaaaggaatgtctctggaggatttccaacacattttagatcctcaaaagtattgattgctattactcactattcattcagtagacacttactaggcacctactatgtataaagcactgtactaggttctacagaataacaagacagacataaataagatatgggtccaacagtcaaaagtgttacaggttaaacttattaatacataaaaaaatctagatgtttgaaatgactcaaattaataagttacctgaatatcaaatgttactatcctaatttcaaagacaggaaaggagacagggaggaagagagagggggagggaggtggggaaggaggaaactaagctggttatctctgagacagagtttgcagaaatacaagatgatgagatctgtttaaattcacatctgctataggatactcagaagtctacaatgtgaactgaactcagagaagatttctcccatgaggctaagaatgtataaggccaactctaccaaccctgaacctgcaacatataacaatgctgctctatcccaaacttctaatccaggtgaaaccaggatgaaatgactgtcattgacaccctggaagggaaatgagtttgagtagagatgagaaaaattaatatggtgatgatgggatcattctactggctggaatgcatgtaaggcctcatctctttcctaagtcactgtcttaccaaaccagaatggggggattccaaaaagagcaggatctaagctagcaccccaagtttattaaactcaagaatggctctcaagatgagcatggtcttcacaagtatatacttctccttggttcaacaagtatcccttcctcacacttgcagaatactttatagttcacaaagcactttaatgacatttaatgtccatcatctcacttaactctcaggacagccctttgtgtttagtttccattttgtagacgaacaaactgaaacttgggaagcttaagcaaccggtttgaggtcccataccaagatgcagaggagcctggactgaaactcaagtcctctggttccatttccagggcattttccacacttgtgtacagcctctgagaaaagggaaggttgcatcaatgaaattggaaggcagtaattggaagccattttcctctgacttagagacctgaggcatctctgtcaaataaaaattcccaactaaaaaactggtggtaagccgggcatagtggcacaagcctgtagtcccagccactcaggaagctgagggaggaggatcacttgagaccaggagttcaaggccagcctaggcaacctagcgagacgtcatttctaaacaaacaaacacacacacacacacacacacacacacacacacgcacgcacgcacatgaaaaaattggtgtctctgaatctgtgctatccctccagatcctcagatgtgaaatccttaaatcctttatgaacatggagcctactccatgaagagcaccattagattcaagatagtaaaattcattcgaaactaattggtgagtaatgaagttgctaaagtttatgagccttgcaccaacactaatacagaggtacagtgtcaacaataaaattgtaatcactgacaaaactagccttcatgcagaaaagggaagccttttccttttcccttggcctgtagacaatagcattagacaatttttggagtgacaagatcacttcctcctgcctagttttaaagagtgaccacaaggaacagcttcgcccttagaaataacttttgattatttgataatggaaaggaaaaaaagtgtacaactctcctctagttaaatttcaagcatttagagaagtggatatgtctatatcacaacatatcctgaaaaacagccatggccatacacaagagaataatacagtgcccctttgtactcctgtctacacaggcagttgtctgctaccaaagaggggttccagaagaaaatgttatttggggcagaaaagactggcctcccgccccccaacagatctataagaatatgttaacctcctgtgcaactcccagagagctgaatggataaatacactgagtactcagtaaaatctacctcaaaacaattattctggtttttgcttagttagtatttgttcttcctaattgtattaagagaaccagttgtttccagaggtcagtcctggagaatgccagcaagccctgggatctttattggctgggatcttcatgttggctctgatgctacactgaccaacgaagttaccacaggtctcacacagctattgagcactgaaatagggccagtccaagtggcatggactgtgtgcagacaaagtgactccatattaaatgttaatagctatgttgacttattaacctcagtcccaggaatgctttctgattcccactctatttactgtcctcaatgtgagaacatgtacttgctataaatcccgcctttacatcaaagcaaccttgatgttattgcacaaattataggctatgacgcacatagcattcttgccttttctggagggctgcctttaattggctatagagcacatatgccctttctctgtggtatataagctcttggtctgaggagtaatggtgtggagatctacctgtcttgctgccacccaagaccatgaggcaagttccccagtaaatcaccctttactagcaaactggatttgtctgcctcattctttggtttctcagctccttctgtgcttggtggtcactttgcatatgtggtcttttcacagaacagactatacatgtcaaatacacatcagattttgaagatttagaataaaaataataacattggtaatttctatattgattccatgtaaaaatggtagtagtttggagggattgttttagtaaaatagattacaaaatatatatatatatatatatatatatatatatatatatatatatatattttttttttttttttttattatactctaagttttagggtacatgtgcacattgtgcaggttagttacatatgtatacatgtgccatgctggtgcgctgcacccactaatgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggacatgaactcatcattttttatggctgcatagtattccatggtgtatatgtgccacattttcttaatccagtctatcattgttggacatttgggttggttccaagtctttgctattgtgaatagtgccacaataaacatacgtgtgcatgtgtctttatagcagcatgatttatactcatttgggtatatacccagtaatgggatggctgggtcaaatggtatttctagttctagatccctgaggaatcaccacactgtcttccacaatggttgaactagtttacactcccaccaacagtgtaaaagtgttcctatttctccgcatcctctccagcacctgttgtttcctgactttttaatgattgccattctaactggtgtgagatgatatctcatagtggttttgatttgcatttctctgatggccagtgatgatgagcatttcttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcaaaaattttctcccatgttgtaggttgcctgttcactctgatggtagtttcttttgctgtgcagaagctctttagtttaattagatcccatttgtcaattttgtcttttgttgccattgcttttggtgttttggacatgaagtccttgcccacgcctatgtccttctgaaactattccaatcaatagaaaaagagggaatcctccctaactcattttatgaggccagcatcattctgataccaaagccgggcagagacacaaccaaaaaagagaattttagaccaatatccttgatgaacattgatgcaaaaatcctcaataaaatactggcaaaccgaatccagcagcacatcaaaaggcttatccaccatgatcaagtgggcttcatccctgggatgcaaggctggttcaatatacgcaaatcaataaatgtaatccagcatataaacagagccaaagacaaaaaccacatgattatctcaatagatgcagaaaaagcctttgacaaaattcaacaacccttcatgctaaaaactctcaataaattaggtattgatgggacgtatttcaaaataataagagctatctatgacaaacccacagccaatatcatactgaatgggcaaaaactggaagcattccctttgaaaaccggcacaagacagggatgccctctctcaccgctcctattcaacatagtgttggaagttctggccagggcaatcaggcaggagaaggaaataaagggtattcaattaggaaaagaggaagtcaaattgtccctgtttgcagacgacatgattgtttatctagaaaaccccatcgtctcagcccaaaatctccttaagctgataagcaacttcagcaaagtctcaggatacaaaatcaatgtacaaaaatcacaagcattcttatacaccaacaacagacaaacagagagccaaatcatgggtgaactcccattcacaattgcttcaaagagaataaaatacctaggaatccaacttacaagggatgtgaaggacctcttcaaggagaactacaaaccactgctcaaggaaataaaagaggacacaaacaaatggaagaacattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcccgcattgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataatgccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagatttaaacgttaaacctaaaaccataaaaaccctagaagaaaacctaggcattaccattcaggacaaaatatatatttttaaaaataatttcacctgtttcttttcaccctaaataatatatgtactagaaaatttaaaattacaaatgtagttcacatgtttgaattacattatatttttatagggctctaatgctctggaggacacatccttattctccaagatctctatcaagtcatttaggtaagtttaatagaagaggtataaatgccatgttttaatgaccctgaatttgggtaagttagaaagtgcttacttgctgtccaaggttctttgaaagtagaaagatgcaaaacagtgtgcttgtttgcctggttgttttgggcagtttgatctctcattgtctctggtaggaacagtgtctgtttaactgatctgtagggattcagcattgtgtgatggggcatgtgggtgtttaactgtaacacttgagaagaatgcttacagctcagctgttagaatctcgtgctaaggaatctaaggttaagggttgaatccccagccagacacacttagctcagctttttttgtggaccaggcatgcactccccacctgggcttgctttcttgcaaatgtccattcttggttacaataggggccagtgaaataatggtgctgtacacttatcaaatccatcaacaccactccaaaaagcagctcagcttcatccttcaggggaacagcatcacctgtaccaccttttcatataaaggaaagcatattattttcctgtgttaaaaaagaaggttttttttaaagcgatacctgttacaagtttcaaaagccaagcaaaggtaaaaacataaaaagtattgtgtttgctccctcatttgcttccagaaaaaccattcttaagctataaaggtccagatttgggtaagctaaatcctgcccatctaggagatttagaagatcatagagaaacatatttatgcttcttatttttcataaacttactattaagaaactcagtatattagattcttgcatgacttgtatccctcaaatttccaagaggaattggccagcagtgctgtgtaacagaagccagagtccagagattcaggccacaggctgactctgcaccaatggctatgtggaatgggacagttcatctccgtctctggttctgtgtgtccccctctgtaaaagcagagtttgtacttacatttagtctaattctatagtttcaaagcaccctagttgaccaccttgaaaggccaaatcaaacattcatgtttctcaagtctactttttttgttggtttgtttctcttcaagagcaatagaggtgatgcctcagaatttggccgaccttcattttaaacagctgtgccaggcagctttggaatgggctcctgtctccagtggcttttgcacctgcaatctggctggctcgagctttctgtttcccgcctgccccggcagcaggctaggagtaagagcagttgcctatgacgttctctgaacctcctgctccaggcgactgagccaggagatacctaaggggcttgtcaacacctaatgctgtctctccttctccttggctccaaacactgttctgggtattgcctcgctgggcctggctaaagctctgtcttctgaagtgaaggttgaccttttattaaatactaaccctacaagaaaagtagaataaactagtcccattgtaacttgccaagattaatacatccatagaattggggcaggagataacaccgaatgtgtactacagactagatattgttaagtagtatatttctaatttaatctttaatctttataataagcctatgtaatagataggcactatgattattgccaatttacagatgtggaaactgtgggttagagaaataaggtaactttcccatagacttatagctattaagtgacagaggtaggatttagagataggtagatccacttgagtccagagcttatagaggtacctaccttaccaacaggacggctttttggaattcatttcgataaaaaaaaaatcaagttggatatgacggacttgatcatttcttctgcctgagatgcctaacacatctaaaagagctgtacgttagttcatgttattgaaaagcagccaccaagacaggctagatgtcactatttctgagcctccttctactcctcttgtttttttccttttttaggagggaaagactggcggaaagagaaatacacaaacctcagaagggagcagacaattcacacatttctacagtttaaccttcagtgccagtaagtgtcaggtagtagagcttcaggtatgccccaaaagtctccttgcaaggaactgagaaacctggaacatttctgcgtttatgcttatccacctatttctatcctctaaattcatttgatatctgctcttcctttcaaaggtaattcagatcacaccatagcaccacggaccataaatcattctgaacagaactctgtttctggggcacatcaatgttcattcaagggatcgtgctttagaaactaaccaccaatatgtatttcagtaatctactccaatacttataatgtgacacaaagaacaatcttcagccttcaccacttcctcaacaccacattttgctcagctttccagaactgcctttggaatctcatcttataggagggagcttatatgcaccagaaaagataatgagcaatcctgtttaccagaaactcatctaggaaaacagctaaggaaagaggatgaagcttattaataagccccaattctcagctttgactgcgttagatatatcaagttcactggaaccttactaggtatcctagtctcagccactgtatttctcaggtctgggacatatctctgagcctttcccctatgctgatgttggtttatcaggtagtgcctgccaacagcctatggctcatgctaaaaataattgagagttgctcaattatttctagagaggcagctggtgtagtggaaagaacactgactgataataacagctattgtttactcacttcatgcaagacattttacaagcattatctccattctgctgataacctaaggaaataggtatgattgcccccattttttacctgagtcagttaaagattagagaatatccatgatttacccaaggcctcaagtttattgtccaacagatccatgatgtgaattgaactctctctctgattccatataattctgatgtatcattactgcctccaaatagaaggcagaaaacttggtcagagtcctagaattgccacctgggtggcctataacaaaccttaatttcactctggatcttaattagctcagctacagaatggaaataatgctattgagtcttaggtgaggatgcagtcctaagagtcaaatagcctgggttaaaacctagtcccaagcttaccagatgcatgaccttgaagaagtaaattagctttacttttaacatggaaataatagcaacaactaccccaatagatattgagtagattaaacaaattaaaacatgccaaatgtattagtcagggttctctagagggacagagctaatggaatatatatatgtatgtatgtatgtatatatatatacacatacatacatatatatacatacatatatatacacatacatatatatatacacatacatatatatatatagagggagaggagtatgtgtgtgtgtgtgtgtgtgtgtgtgtatataatatatatataatatatatatataaaatatatataatatatgaatataccttgcatttatatatgaaaaaaacagaatgtattagcctgttttcactctactgataaagacatacccaagactgggtaatttataaagaaaaagaggtttcatggactcacagttccacatgtctgggaggcctcacaatcatggcacaagagcaaggaagaacaaacggacatcttacatagaggccagcaaagagagaatgaaagccaagcgaaaagcgtttccccctataaaaccatcagacctcgtgagtcttattcactaccacaagaccagtgtgggggaactcaccccccatgattcaattacctcccaccaggtccctcccacaacatgtggggattatgggagctacaattcaagatgagatttgggtagggacacagagaaaccaaatcacagagccaccaggtgatagtctgcaaactccttgttttaaaattattttctcctttgcctggcctagaggtatggaggctctattatcatagcatccagatggacataggagagcagcctgaatgccaagatgtctggtatcagatagctcagttaaaggcaaagtatggaaattactaagagcaggaaaaaaaagatacaaatattttcatctgataagagaagattacagtgatcacagagtgtagtggtttggcatcaggctgccaagagtgaaattccaacaagtttgcttatcagtgtctcagtttccttgtctgtaagctccgcctgttaatagtgtctacctacagggtcactaagtaaggtatttatcacagggtaagtattaaataggtaatagatgtaaccctatgaggtattctatatatctgctgaggtaaattcttgttcctaataatgtttcctccaacttcctgtgagtttcggcggtgagaaagttagaatggaaaaggtctgaaattgagagaaagttgcgaaatgagcaataagatggtgttcgtgccctacgtcaaaaagacttggtcagaaacatacatctttgagacagacttgagagctcttgtttggctctctgaccttctgtgggaaattaaatctcccaagttgttaaatccaagccagtctttttctccttttcagttttccaaggtcataaacacagaaaagggattcctggccctggtactagagctcatcttataagcccaatgtagtatagttctaaactaagcatattctataagcaaagtccctagatttgtttcctggcttcaccacttaccatcaattggaccctcggcaagttatttaacctcactaggcctctcttttatcatctgtaaaatgggaacaatgaaatagagacactgagaaaattcagtgagacaatgaatatgtgataggcagaacaatgtccccgtcccccaaaaaagtctacgtcctaattcccagaacctgtaaacacgtcatattacatagcaaaagggatgctgaaagtgaaattaaggtttcagatctttaaatagggagattgtcctggattatccgggtagacacaatctaaccacatgggctcttaaaagtggaagaagcagcagaaaagtcagagaagtggccagagagttccaaagcatgagagggattcaacccacacttgttggctctgaggactgaggaaggtggccacaggtaagtgggtggcctctagaagctagaaacagtactcagttgacagtcagcaaggaaacagggacttcagacctgtaacagcaaataactgaattctgccaacaacttgaattagcaggagtcagattctaccctagagcctccagaaaggaatacagtcctcgtaacacctggatttaatccaacaagacctgtgttggacttctgacctactgaactatgaggtagatttttgttgtgtcaagctctaaggctgtggtaatttgttatggcagcaaaggaattgtggtacggaatgtcaagtacttagaatgtccccagcacacagagtaaaatctcattcaaatccagcaatttgatgatggcaatgctgatgaggaagaggggaatgacaatgaatttttaggttacatctgaaattatgactattaagcctgcctataaacacaatattaagatttttaggtcctcttgtggatccaatatcctattaaatgttttctatttagtaaattactttatctaagcctcaaaactattctatgaaataggtacaattacacctattttcatgaggaattggagctcagaaaagttcatttatcttatgctgagtttcgctctgagtgattttgggttatgcagaagctatcaaggacataagacaatcctagtggagggaaaagttcataatgtccccaaagacaaaaatacagcacaatgagttattccttcaatgagcatacttaggcaacactttctttccatcaatgcctaaagcgatggttggagccctttgaaatcaagttaaatggggagaggtgcacagaagcactagaacttgccattgtttaagagacagaaaagaattgtgctgtctgagcaagacaatcctagccatgtgcctgctgagagcccagagcatgtgagctttaactaaggaaaccaactccaaatcctcagcagctacggaagtatgaaatggatttcaggtggactgagacagagtttagaaatgggaccaaatgtgcagtctcttttgaccaaagtttaaaggatgatttgcttcttcttttcccaagcagaatgcaattttagatcactcattacatcccaagagaaattcataaaagtattactcaacaggtgaataccacaggagtttctagttcaaattttagaccactccaagtatggtcaggcaaccactgcctcaaaattacttgtgttgcctgaaagaaatatagcttcctgtccctctcccaaaagcaaagaaattgcagaagcccagaatctgcatttggtgattctctcgcaaattcaagtttgagaaaccctttgtagagacttacatgggtatccagaggtaagtcaggaggcatcagcaaatattccgtggcaggctccatgagaagtactgagataaaaattcttgccctggctccaagatttcacaggcaattgatgaactacaatacaggacagacagacataagtaatacatagaggtaggtataagtagactgctctgggcacacagaaatagagcaatcaattctagccagggctctccctccaggattttaggaaaaggtatcagtcagactaaacttgacaatgagatcagcagattacggtgtaagattggggaatagtaagttggttccacaagcagaaggaaggtccagaccaaggtcagcaaaggcacaaaagcatgtccaggcctatgctatggtggaagagaggtcctcaaagactgtgagtaaagacgtcagaaaatcagtccagctggaggacaacaaaggcactgatggccataataaagtgggggacattttgagtttttaaagcaatggtatgagttagtctatggtttcaaaatgaaataggctatgcattattttcctgtcactcccataagaaattatcacaaaatgaatggcttaaaacaacaagagtgtactgtctcacagatctggaggctggaagtctgaaatcaagtgttggtagggctagattccacctaaaagctagagtgaagaatcctttgccacttccatctactggtagctccaggccatcattggcttgtggctctatcacttctacctctgcctctgcgttcatgtgagtttctcatcttctccctgttatcatcctcttttgtctcttatgagagcatctgtgattggattaagatcccaaccagatcattcaaaatgatctcatatttagctgcttaatttaattacacctgaataaaaccttttttccaaataaaagcatattcacagaagattaggacaaggatatattttagagaggccacaactcaaccttctataggcttccattaggctgtatgatagatagacagagaccagtttttgaagacagacctaccctggtttgtaaaatcaattctgctacttattgggcatagaacaaatgtgcccaatggtgataataaatattttgtagggttgttgtgaggattcgaataatgtctatacctttctaagatagtaggtgtctggtgcataatgcggtctcaataaactgtagtaatattagtgacatgaagtacttgtgctttgtgagatatgttagagacactgcagtttagggggtgagtggacagggttgagaaatgaatgctttgggtgcagttcttagcctatgtgaccaatggcctatgtgacctgaggaaaatgactttgtctgctggagtttttttaatctgatatttgtgaaaggaaatttgtaatatttactacatcaggagattgctattagtgtttaaaaaaataatgaatgtatttagctcccactagaatatgagaaaacaaaacaaaaccaagcaatgaatgtaaaacatttatcccagtgcctatcttagcacatagtaattgagctactcagtgattatgaggatgagacaaaggatcatgtgtatgagaaagtagtcattcacacatggagacctcatgtttagaatgtaaacaaagtacttttgtgtgaaatagctcatttagagctcctataaactgttatcttattttgaggctctgcctggggcaagaactctgcccttccagatgttcagggagagaccacctccctggatcacatttcttatcaaattaagtactgctgaaaattttctgttgacttttggagggcagaggccaaaaagaaaaaatgaaggctctttggggaagacctgcatgagggttctataactcttcccataggcctgagtgaaggctgctgcaggaggagttttctcactcctcacttccatttccttcttgctatgatcctcagaaatgaatccattaaaaaaaaaaaaacagagctggtcaaccaagacctgctcagtccagagaagctacacagagccccactgtgaggagaaactaacatgataatctattctggtgctgaatgttctgtctctacctcaacaaagcagaggggctttgctttaaattttttttctaattttaaaacaagacagcaaattaattgttagtgtccaggcaaagcagatctgctgaggtcagtgaggcaaaaaaaaaaaaaaaaaaaaaaaagagaccatggtgaaatcacaaggagaatcatacagaactaggtggagatactgagggaaccaacacactgttctgaacactttgggggcttcagagtatgaagatgaccaggttccaagatatacacacagcttaaaagtttcaaggagacacaaatcagaaaggtgtatcaccacaggaggagaaacaaataaattcaagtattcccaaactagactacaccacagaaatattctaagactaagatctagtcaaatacattgagagaagagtgatctattggcatgagtgacacagagtaaggaaataatatggatagaccacatttattttcaatgaagaaagtaacatagcaaagataaaattgaaactaagtttctaaataattccttatctggtcccttccttctcattctgacatcaccgcctccttccttcaacttctatagtaagttctaagtggtctccttatccacctccacttttaacccattcttttcacatcttccattttaacattcttcccagaaaacataaatggccaatacatcggaataaaatttcacatatgccaatataacaagagatgaaggaaagttaatggtagagggaggaatagtgtgttttttagttctatcagattcttttttatactggcattttcatctgtcaactcctgtatcatttttttgcgattcttagtttcctttgattggattttgctgttctcccaaatcttgatgatcttcattcctatctatattctcaattctatttctgtcatttcagacaactcagctggttaagaacccttgttggagaactgatgcaatcatttagaggacatagacacttgggtcatttgggttgccagagttcttatgttgattctttctcatctctacatgtgtgtgttcctttaactgtgatatagattgaatatggtcagtagacttcttttctggatgtgttcacagggccaaggctttgcgcagggtctttatttgtaactgacatcttgcctttggtttcacagttggcgggttatgttattgaggtattttggtattgaagctttggagtatgatccaataggtggcacttagatgtagtggtcagttagcaggttcttgctcagttgctgtgttctcggtcaatgatctgaaagtgtgagttcctctcccacttaagagctggctgtagatcgtggcttgacattcctgggctgcccaccaccgctgcagggtgatcttcaggtttatatttcctcaccaacttggaggcagcagaggaagaggccttatcaatagatgtggctgatggtctttcacttgtctcctgggggctccaccccagagatatgcaggtcagcaatcgctcactgcaatcagcccaggataaggggtctgtgctgtgggcccaaggcaggggttccctgcttggtgatgggtgatggggtggagtctgtgggagaaggactggcctcctccccataggtcgactgcagcttgttagaggtgtgaataagacacttacggtctttgctccttcattagactgagggtagcagggatagtaccactacagaggcagtagcagagtggctttcagttgctcccgggggatccgcctctgataaatgtggactcccagctgttgcccagagtgttcagccattggggtggggcagctgcactgttggtgtgagcttggggctccacttgctggggagcaaagggcgaagggctcactgggaagagagactagtctactctccatatggtgatagtggcatgctgtaagctcaggtgtagccctcaggctctttgtttcttccccagactgagggcagcaggaatagaaccactgctgtggcagtggaagagaggcagtcagatggctctgggagtctctccccagggaaactccagaccactaccactgggtatgctcaggatagctaagttttaccaggaaaatgcaaatcaaaagagttcaggggttgcgatattagtatcagacaatgcttaattcaagaaaaaagcaataaagagcataaacagattaatttactaactcacaattaagacagcaacttaaccatttataaacaaaatagcatatcataatatttacattttgtttgaaaagagaactacctaaatgcaacagcaatggcaaacattaaagcactccccccttaattttttatagttcaagtagaaaaaaattacagagaattgaaatacagaaaatacatttaatatatatcataatccatatcctaaaaatggatctataacttccttcaagcatgcctgaaacatctatgcaaatttttttttttttttttttttttttattatactctaagttttagggtacatgtgcacattgtgcaggttagttacatatgtatacatgtgccatgctggtgcgctgcacccactaatgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggatatgaactcatcattttttatggctgcatagtattccatggtgtatatgtgccacattttcttaatccagtctatcattgttggacatttgggttggttccaagtctttgctattgtgattaaaaggtgaagaaagctcaatattctaaaaacaataggtcctaatgactatagttaattataatgttttgtatggtcaggtatggtgactcatacccataatctcagcacttttggaggctgaggcaggaggatcacttgatgccaggagtttgagaccagcctgggcaatacagtgagacctagtttctacaaaaaaaattttcaaattcactggacacggtggcatatacctataatttcagctacttgggagcctgagataggaggatcacttgagcccaggagttaaggctgcaatgagccatgatcacaccatagcactccaacatgggcaacagagacctgtctcaagaaaaaaaatgttttgtatacttgaaaatttgctaaaagagtagatcttaagtatttttaccacacacacaaaagagagataactatgtaaggtgatagatatgttgattagcttaattttggtcacatttcacaatctggaaatatatcaaaacatcattttgtactccttaaatatatacaattttaatttgtcaattatacttcaataaagcttgggaaaataaataaaacaacaggtcaaattatgtacctcagaatggggaaaagttcttccctaggctccttataacctacttttctaggcctattgctactaactcattaattttacaacatactatggtcactcttcataatttattcttccccatgtctccctactatagtgaccaggaacccagcaggcgtctaataacccttcctccagccctgtttagcattttaatcaatgatttagatgaagatatacgggatatatttattgaacatgcaattgaaacaatagcaactatatgaacaaaatcaacttccaaaatactcgtaacaatcaagccagtctaaatagaaggaagtttaacagacatataaatacaagattgggtataaaacctaaagaagtgaagaatgtctgagatttgatttagcagcagtatgtcacgtaaaactaacaaattgtaatctggttttagtagacagtgagcttaatacagttcaacagtgtgcaatgttgatgccgaaatgggctaattgtgtattactagatgcagagtaactagaaccagagaggcaatccattccaatttcagtttggggtgtgaaacatttttattgaactctttatggactgagtgggctaactcagagggcactgagttccccataaccaaaagtgttcaagcaaagccagaactatgttagtagactcatttattcagttttcaggagtaacctcaggttgggtgcccttggggtctgaagtttatggcagttcccaaagagtgccttcctcctgggatattcagattcaatcaatgcaaccattcttttttgtttttgcttttgtttttttgagacagaatctcactctgtagcccaggctggaatgcagtggtgcgatctcagctcaccgcaacctccgcctccggagttcaagcaattctcctgcctcagcctctgagtagctgggactacaggcacacaccaccatgcccaggtaatttttgtatttttactagagataggctttcaccatgttggccaggctggtcttgaactcctgacctcaagtgatctgccctcctcggcctcccaaagtgctgaaattacaggcatgagccacagcacccagtcaaccattctttatgatgatatatcaggtgacttactttttatttccctttcacgttcacctgacacaataactacttttgtagacaatacccttcagagagcttcagcactgcaatcctgctcaggtggaaacttagtgagtaagaaggaagtgccacataaaagcagcagatggtaaaattcccctaatacagcaggatctgattgtcccagatagctggcatatctacagaccagacacaagttggggggaagaaaacttgcccccattagtagcatttttatgcgtaggtgacattctacaggtaagttacaagagggcaaaaataaaaaataacacatcttgtaaggcacaggcatacacatgaggtaactccaatttgttgctgtgtgctacctgcatgagctatacctctttttgcctttttcacagagagaaacagaagtggctggttatgaaaaccggcagcacagctttttccctccctgtggtgtcttcccagataagaaagcaggcctgaatcccgggtgctgttcttccagaccacatgaaaggtactgtctcaggctcctcatctggaacttttatgctttacaaagatgataatagtccctcaaaatcacctacaatgctgaattaaatagcattcaaagtatactaggagaaaattacagtcaagtttgagtcaacagatctcttaacctggtaacttttaggaaaccacttaatttctgcaactcagtcatcttccctataaaatgggaataataaaacctatcttgactactctaaagactagtattgagaagcaaatgaggtaagagacatgagaaagatttagaaattataaaattcaacataaatacaaattaatgaggtacatctattatgtcacctgatctttataacgtgacaattgtccaaatcaaaatggagtcactaaagtttttttttgtttgcttgtttgcttgtttgtttttaaaaaaaccctgataaatagagccacagaagtccatgaagagaggattctcatattcgtatacctgacaagaaacactatcacaatgactgcaaaaaacacaaccttgtacaaagaccattacaaacttacacaaaagaatacctttgcaaggacatctgcccagcaattgcctgtccaatctcagactggtgtcactcttgttatttatctttgtaaccaaggataattatttcaaaacaattatgtaattctcctcattttttcctttaaaaaccatttctttcttttacctccctgagtactcatatgggcacagcagtctcattgcagtgtattctcatgcactattcccaaataaatatttttttcttttagaaagcctctctctgtttgttatttaggctgacaataacaaccccaggaaatgggtaagttattatccctatttattgatgggttgcgggggagaaacagaaaaggatcaggctatttgcttaaagtccctcagcaagttggctcccaaggcaagtccagtgcccttgcatcccatcacctcctagaccctccaccagtgctgcttattctctctgctgttttcccagaatcattcactgcccttctccacatcacaggagctcctgtctcctctgacttcaggttggactggctaatagaaagaccaaaaggtggcaggagagcagagttgagcattcgttccctggctctccccctgcctcagcactgtggctctgacaatgactggatccctctacaacttcgactcttatctagagcctccttccacagtggtaggtcatggcaccccatgaacactggatccccatgctcaccccatgctcttcaggcctgggcagtacaacagcttcctgctattgctaaaacctggcacctcgtcctctcttcctaggtgcctcagccctgcccacacatctctaaattgtacctttaaattgtatatctttaaattgtacctttattcaattatctgtaaaattccagttgagcatgtcttctatttctgctgagaaaactaagaaactcctccttttcaaactatttgttcacaggctgccaaaaacttttaccacctgtccccaattcctctctcagccctctcctcactttacccagactcctttcacaggaagtcataagccaccccccattcctctccaggcgcgaatttaccatggctctggacttgccctttaccagttctctattaatttaaaagctgataagtcctctcccaagctcctatttccccatcctctcttcttcgtctatctcacactttatttctccataggaaagaatttgaactatcgatctgtctgctgtataatttggattgagaaacagagcatgaaaacactctttgaataccttcagggaaacatactctattcaaactatgtttctttcaactctaaatttgtaaactattcttttttttaaggtagttctgcctaaaagagttaaaaaattgactaccctatcaattttgccctcgaggttataccaactatttctatactggcaataaaatcaactccatttcttccaggctagatcacaattattactaggcacatattccaaggctgcaataattcagtggcccaatactatttcaaatttatagcagaaagaggcacaatagtcattttggcctctagggtgccttctcactaaagaccatgagctcagaggttacacataacctataataatagttgtgtcttcctagggtgtgattgaagaaaagaaaataaataaaaatgcccttgccttcttatgttagaatgcgtaaccaaaagcacccaagagctgacattcagttcaggatttctgagacccttcctcctttccttgctgtgaaaaataatgatctgctgttctctgactgtcattcaaacaatgggcccaagaagccagcatctctctcctcactggcctcttgttctctaaatgtactgcccatcaccactttccaaaccacattagtcatgaagtgctgacaataattactaacacattgaaatggttgcccaaaatgatgactgtacaggcctacagaattggtatttttactgcagtaaaagggtatgagtatgaggcttcataagaaattttatggcattttggctactgatcacaggtacaaattatccatgctcaattaaagaaagatgaaagttcagctttctataattaaaccaataacttgttcagcctcaggctggaagtaaatgttaaggattcgtgtcttgcaatcctgcatgaagaattaaagaagcaaactctattatcaccgacttacttaaaatcaaggccttatgcatattggaaattattcatgatgagacttttagatcaggaaaaaataagtcattctcacactcttttggctgccttgcaggcaataactttcttcactattctgtttggaatattgcatcatttagatcattcttcttaagtcaatccagacattttctttagattctgctaagaatattatatgaaatttaaggactggaaaaaatacttaaagagatattttaacatgataaaaaaaagtccaacaaccagctctgcaacttcctaccctctgcttctatttccttacctataaaatgggctgtgatgattagttttatttgttcagtttagctaggctgcaatccttatttattcaaccaaacactaatctaggtgtttctgcaaaggtgttttgtagatgtgattacagtccacagtcagttaattataagtacaggagattatcctaggtaatctgggtgggtctagttcaatccattgaaagtccttaagagcagaactgaggcttccctgaggaagaagttctgcctgtgtcttcagatcatgccaaggagttctagcctccccctcctaacagcatgccttacagattttgaaattacctagcggcccccagttgtgtaaaccaattccttccaataattctatgtccaaccatccacccatccatccatccatccatccatccattcatccatccatctttctgcttgtttctcttgttataccttgactgatacatgaggataataatgcctattctgcagcagtgctataagaataaaatgagattgtatatataaaaattattttaacacaaaataaatgtaaggatgtgtatgtagaattactatttgatttgactaactcaaatcgagctaacaactccatataatcactgctctttcctaacaggccttgtgattttgttttccagattctgcatatctgttacattctaaggccacttcacaacactaccaaacccagctttacagtttggaagactgagagaatcatacccaaagccacaaacatccaaatatggtgttcttcacaagaaactaataatgaacttgagacagagtctgcagggataggtatcagaagtcaagtctaaagtatatgaggtctatgttcaaacaggagcctggacatgactgagataaagaatgattcccgagctgggcacactggcttatgcctataattccagtgactcagaaggctgaggcaagaggattgcttgaggccaagagtctgaggctctattgagctatgattgcaccactactgtccaacctgggggacacagcaagagcttgtctcttaaaaaagaaaaaaaaagattgagtccagagttagagctacaggataaaaataagttaactgaactcagggggagaaaggaggggaacctactccaaattctagctcaggtcttacctaaatgtgggctggctcagctcccaagtggctgagtgaggtcatgactgagaagaaaggacccctggcccaagtcgtgagttgaatgactcttaggttgagaagctttcgtacctaagaatcaagtggccagtggtgcaccatgggagagatgatcaccaaacttttcttctctttgaggtcacacacctagattacctgccccagtctcccttgcagttagatctggctgtgaggttgagttttagccagtgggataaagatggaagtttccactggcctaacccataaattcctccacaactcttcccacttttaatcttatgcccccatgtcgtctcttctcccagccttcttcgtctcaataaatgtcactagcacatatccagtcattcaaggaaaaacacaatggagaaaaccatcctcaactacccattccctttacctcactctttcccagcatcctgcaaaatctcgctccaaatatagctccagtttgtccacttccctcccttttctccagtctataaccttggtttactccatcactatctctcaattagactattgaaataaaatcctacctggaatttaaactcttaactgtctctctgtttctattctcatcctccaatagcctattctatataccatggcagaaggatctttcaaatcactaatccagttttgtcacttcactgcttgaaactttccaggaggcttcccttccttcgtaattaaataaaatttgaaccctgaatgtggcctaaaccctacacattttgcctcaccaacctctgtcaccgcatcgcttaccactaacaccctagctcactgggatttgtgccacaccaaacttcaaacacaccaaacgtatttctgccttatgaactttgaacttgctactccttttcactcccggaacactcctgccccagatctttgctggtgcctttacatctttcaagtctcagtttaaatatcacctcttccaagagacatcctttgactaccatatatcaaatatcccctaagctcattattctttgccattgtactctgttttacttttggaattatttgttttcttgcatgttgtcaatctccctcactgaatctttagcttcataagagcagggaccttacctaacttctttatttcactgctatatccccaacagtataatcttggtcatctcattcccctttctaacccttattttctccattttcaagatgatgacttgggattcggtgcttacaggagactggctcttcacattctttgcatccacagttccaaggaggctttagagctcaatactttccagccagtgacatttctaaatgcattttccaaatgaagtcaatgccctcaggcagcccagtggggaggtcatggagagccagtgagaaggaagtctggtgagttggattacatagttcctttgctacaccattccagccatactaaggagatgcacctcattaggtactaaatgtttagtgactgtcactattaattggtggggattaatactcaaaggagacagtaaatctcatgctgtactcaatgacatcacccccttgcagtcagacaatgcactgggagtttgaatctaaagcactacaaaaaaagaacccagagactatcccttctctgcttataagagtaaatattggttgccaattatatggagcatctcctcagttaccaggatctgtattaaatatcttacatgcttttatcatttcatctttacctcgatcctatggcatagttccaatattatcctcattttatggatggggaaacttccaaatagagagaagaggcaccttccccaaggtcacagagctaataatgatggatcctttgattagggtctgtttcattcagaagcctatgatcttagctactaagtaatattccatttcctataattatcatctcaccatatgattacaattatttttattcaaaccttttccattcttcaagtctgggctcaaatgctactttttttcacaaaactttctctaacccccagaaagacccatactcgccatcagcatcctctgcattggtcatatagaatcaatcacataggggaaggagactcagtaacaaacatttaatagcatatacggtatgcaggcactgccacagtcaaaagcttatgttagtcttacaactaccctgagaaaaatacattcatatctgttttgaaaagtaaaatgccttgagcagagtcttatggctcaaagtggcagaaccagaatttaaacccaggtctgcttgattgcagagcccaaggcatttccacaaactaactatgagctcttcattatgcccttggactaaataattccccctgttataagtcctcatagcaccatgtgcttctttatagcccccaccccagttataatttcatctatgtttgtgtgattaattttaatttccttttttaggccctaactccatgtacaaatgaccatatctctttttgctctacaaaatccccaacacttgacaaatacagtagtcatggaccttatacaagtatatttgaataaatgcacaaaccatgtacatttcattgcatacatttaatacataaatagagcccttccctgctagattctaatttctctgaggcaggttaccaacctaatttatttctggatccctcatgatgttctgcacttcataggaactcaataaacatttactggataaattttgcttatcagtctgtctgtaccatttgaaactctgtaacatccaaggcttctaagtaggccttggatttaattatagaataagatgaccacagaagagttttctaacctaacagatatagatttgaaagccatggggagcatgaaacccatgtcacaaaagtgtatcagtcaaaataagttaagctatgctgctatgataaacacagcagcttaaagaaaaggtttgtttctcacttgcactacacagacattgcaggctgtctgaggtcattgttctacatcatcctaactccaggacctaagctaacagagcatttccagttgccatggcagaaggaaaatggggcaaaggcaaataattcaatagctctcacagcttttactggaggtaatgctgtatcacttcttctcgtatttcactgtctatgtctaccttcaagaaagtgatgaaatgccctcttactccacagcagggagctcatgccaaaatatttgctggatggcactaatgaccaccaccacaacagactgcgtaggagaaaacactgagaaattgaaatgggagaattccctgacaccccttgctgaacgtgagacagggatgtgactcatctgttcagtaaccactgctcctcaaaccccttatgtgaggggagcatgcagacaggtaggttcaggagccagagtaagcacccctgggctccagccccagggcagcattcagggttgagagcctgcaactcccaaagcccaaatgggctgtgttacagtgtactctttcagccttgccattcgcgggcagcttatctgttaaccagctcagtgaattctctgccttttcacaatggcagagggccagtgtgacagctttctgtacccaagctctcgtccaacatcccagaagagtcaggtcacatacagacttgaaggatgaatgtgggggtattattgagtggtggaaattgctctcaatgagacgaatggggagctggaagggggatggagtgggaagatgttcttcccctggagtttggccatccagtagccaatctcctctctgaccatccccagccaaacttctctcagcattcggatggcccttctcttctctctcccacgccattctgccacttgtctactcttctccttgtctgcttctggagcctgcagtctggggtttacatgggtacaggataggggctgtggtgagccaaaaggcagcttttgggcatgaaaacaggaatgcctgtctccatttaggggcatgagtatcctggcttgatagtggggcacttgccagggaaccacccttttctacccagtatttccctatctcctgtccgttctaaatgatccatttagaacctgacctactttccgaaaaaaaaaatacatctccaaggcaatctattgttataaaatcactgaaattgctagagtctttccctagacttttgagcagttgctttctgggtctcaatgtccttatctgtaaaatgggaataaaaatagaatttcagaggggctttgaaaattgtcatgatggccaggtgtagtggctcatgcctgtaatcccagcattttgggaggctgaggtgggtggattgtttgagtccaggagttcaagaccagcctgggcaacatagcaagaccccgtctccactaaaaatacaaaaaattcgtcaggtgtgttggcacacacctgtactgccagctactcaggaggctgaggtgggagaatcacctgagcctgggaggtggaggctgcagtgagccgagatcatgccactgcactccacttcagcctgggcaaccagagtgagaccctgtctcaaaaaaaaaaaaaaaaaagaaagaaaaaagaaaagaaaaagaaaaagaaaaagaaaaatgtaatgatgtacatgaaagcacccatcatagggcctggcacaaacagttgatcactaaatattagccttctaagaaacataatcttcaaatccaagtatgggctttagaaatgtaagaaaatttaattcctccaaatatattaataagtgagagaaaactacgcactcaccctctaaacttgacgttttattttgctgatattgttgattgtctacccgctaaaatgacttgctgcgcacaactacccacatatccctgcaatgcgagtactcaagtaatttgaacagggctaaatatactacattctaaggcaaaaaaaagaaaaaaaaaaagggtggggaaaggaaagcagtggaagaaagctcctaaaacaactggaaactacctgttcctcccaggcagaaccaaccaccccatccaataggctatacaagttaccacagtttttctacccttctgctttatttcctatctccacatccctcctgagcatagggcctggtgcaggatcacagtgttgtacattcctacgttcttttctttgtaactaagtcacaggacaaagagccccaagaaagtggttttgtccagtgatgcacagccttcctgctcctctactgtccacactcgctcaagtgtgcgatccaaggagctgtaaaggaaaaaaatccccaaattaaatattattgtattcccactcctacttatgcctccatacagatgttctacaggcaaggggagaagcacatgttaaagttgtaacgtttctaaatagacgtaccatgtaaatgcctaagagagagaaggctcccacttttttcctccctcctaccatctttgacagtcctcaaggacaagtctcaattccaggacactagccatgcctgttagcagaggggctattaggcaataaaatatcaccacttacatgttcacttctgtcttctctccttttcatgccactggatcataagaatgtagactggtttgcacatcggaaaagacctggctgtctgatcagtttgcttttcttccttcttttctacccctgcagcctaagtggtaaaccggtctgagtaaggtcagtactgcactttagattatgagtgacgtaaaccaagaaagtatcaactaacaaccatagggcactttgattctcaaaatggttttggttctctgtcttactctatcttcatagcaacctgtacttgtttcctaaggctgccatatcaccatgccaaagctggttggcttaaaacaacagaaatttattgtctcatagctctggaggctaacaagtccaagatcaaggcaccagaaaatctggtatctggtaagagcctgtttccctgtttccaaggtcacagatggcaccttctcaatgtgtctccacatgatggacggggcaaggcagctctctttggtctcttttacaagagcactaatcccattcataagggctccactgccatgatgtaatcaccttccaaaggccttccagtatcatcacattaggggttaggaacttaacatataaatttggcaaggacacaaatattcaagcacagcaaaaagtttatatgtatttatctgccccttcctagaactgaccaaagactagagcttggggctagcccactgctctggacatacatgctttcccctcccatctcatgcctcccagagaaactgcagctcctgcatgcttcaagtggaactactctaacaacaaacagctactggagaagcaatgttgccctctcaaatgcaatattcccggactatgtgctaataagttacgtttaagaaaactactacttacccatccactattttctttgcattttttgtctactgtttttgtccacataatcttcttctcgtgataccctcaagagataggcagaacaattattacaggtataccttggacatattgtgggtttggtcctagaccacaataaagtgagtcatacaaattttttggttttccagagttaggtacttgctctagattaggctttggcttaaagaaatgttgtatgtggtttaatgttccatccagaccactcaaacattccccatatcagcagtaagactgtttgctctcttaccactcatgtattcactagagcggcacttttaatgtccttcaagactttttcctttgcattcacaacttggctaactgcttggcaaaagagctctagcttttggtccatctcagcttttacataccttcctcactaagcttaatcatttctagcttttgatttaaagtgagacacacatgattcttcctttcacttgaacagttagagggcattgcagggctattaatgggcctaatttcaatattgttgtgtctcagggaatagggaggatcaaggaggggtggagagatggaggaacagcctgtcagtggagaagccagaacacacacaagatttatcgattaagtttgccgtcttttatggacatggttcgtggcaccccaaaacaattacaatagtaacatcaaagatcaatgatcacagatcactgtaacagatataataataatgaaaaagtcttaaatattgtgaaaatttttcacatttgaaacagacacaaagtgagcacatgctgttggataaatggcaccaatagccttgctttacgcaaggttgccacaaaccttcagtttgtaaaaaatgcaaatctgtgaaaaacaataaagcacaatttttaaaaataagaatcaaaaaagctatgaggaattcacaaatatgcaacacaatttagaaggtggtccagaatcccagaatcttttctccccctaaagaacctccactgccctccgaactgtgacatggcctttgaaatcagggagaatagggtcataaggtttttgaagtggaaggaaattaatcttattaagtagtacagaagggagagtagagaacaaacaattcccaagacacataataaaacattgaacaaccgtcactacctcgaggtgatcagtgttggtgaatattttcacctttccaagcaagagaaatgtgaaatatggataaacttagaaaatgaaaaacataacacctatgaagtccttccaataaaaagtaaagttttatcataattactggctctgaagtaatttggaagccctacaatgacctattctgtgggttaaaaactgccatccatcacaaaactcgtctctaccaaatcaatttctaaaacaatcaatagtaacatactcaaaaaagaatgtctgagaaataataagagccaatgaaactaatcacgtcagagaaaactcaagcatgaccttttgagcaataccatttgttgagctgacactctgcaagataaataacttttaaataaatgaacacaggccaatagtgagaaaaagaactgtatatgagcacaatttcaacacaaagctctagtatggctttcaaagcaatcatgccttcaccagaaacaaaacagcttcaatttaaaggatttatcacaggaatgataaaatcttttgaaatgtcagcactaggtctagaaattatcaaaggaaaagaaaattaaaaataaaaatgaaaaccttgctgacaacagcaaaaaagctatgacaatccaccaccttgtcaaattatctttcttttattggctctctggcatcagtctcccatcctctgaaactcatgcaaatgctgtagcaaacagttaaatattttattcaggtgtatgtttatgtgcctgttttaaaagatatctttacccactaccctccatttatctgtcacagtcttttaccatcaagagcatgcctgttctcagtactatgtaatatttatgagatactcacagtgtgctcaatgcagatatcaactgaaggtctgccatctcactcaaccttcttgacccagaatcccagagaaactgataaataaacaactacagtaacaatatcaacaacaacatcttttaacagatattgagctgttaatttgcaccagcactgtgctaagggctccacgtatagtcttatttcatatgcacaacagatgtgcaatataggtgttctaagtatccccatgttacaatgaagaaaattgagactgagaaatgttagggaacatccccaaggccacacaaccaatgtacgcccagggtctttcctgactcaggggtctccctgactcagatgccttacaaacagcacttaaccaacaggctggatgacttcgctagttcacgtcttctcactgcgtgttgttgaaacagatactgtagtggagtgcgttttcttcatgcagtgtgttgttgacactcatctgaattaatgcatacagtgaaaaggcgttaagaatagttgaaaagtactatggtacaaatgatgatatggcataaatacaatgaaacggaaaaatgtgaaaaggaaaaaagcagattgtaaaacaatacagacaaaagtacaaaataatgttagctagcctttattaagtgtttactatatctcagatattttccaagttattatcctgtattaatatattgactctttataatagctctatttatttacatataccaggtatattagttttctagggctgtggtaacaattcccacaaccttagcagcttaaaccacacaaatttagtatctgttaaatttttattttattttattattaattttttagagacagagtctcgctctgtcactccagttggagtacaatagagtgatcatagctcactgtaatcttgaactcctgaactcaagtgatcctctggtctcagcctcctgagtaactgggactacagatgcacaccaccatgccccactcatttttacattttttgtagagatggggtcttgctatgttgcccagtctagcctcaagtgatcctcctgtcttggcctcccaaagtgcaaggattacaagtgtaagccatcacacttggcctaaaaatttgtatcttacacttagttctatagttcagaattctgaaatggagttcactgggctataatcaaggtgttggcaaggccatattccttcccagaggctctaaggaacaatctgtttctttggcctttccagcttctagccacattccttggctcttgaccatcttcctctatcttcaaagccagcaataacaggccaagacttcctgatgctgccatctctctgattctgtcttccaattccctgttccacttttaaagacccttgtgattacattgggcccacccagataatccaggatactctccctattttatggtcagctgattagcaactttaattctatctgcaaccttaattctcctttaccgtgtaacctaacatattcacaggtttctgggattgggatgtagacatctttagggaccattattctgcctagcagagttgtcttctgatcccaaaagattcacacatgtcccaagccattacaccaggtaattctcattgaattttctctattagagctcctgctatcaaaatacagaaactaaaaaggttcatacagtatgaaataaatcccaaaattaaataataaaatattaacaatatttattggtcagacatggtggttcatgcctgtaacctcagtgctttgggaggtctacacaggaggatcacttgagcccaggagttcaaggccagcctgggccgcatagtgagacttcatctctacaaaaacttaaaaaatagccagatgtggtagcatgctaattgggaagctgaggtgggaggatcgcttgagcctaaactgtttgaagttacagtgagctaaaatcataccactgcactccagtgtgggtgacagagtgagacgtctctaaaaaaaagcaaaaacaatgtttagctctgggtaatagaattatgtgtggtttttgtttctttcttactatgtgatccataattttttttatttattttttttgagatggggtcttgctctactgcccaggctagagtgcagtggtgcaatctcggctcactgcaagctctacctcccaggttcacgccattctcctgcctcagtctcctgagtagctgggactacaggtgcctgccaccacgcccggctaattttttgtattttaagttaagcagagacggggtttcaccatgttagccaggatggtctcgatctcctgacctcgtgatccacccacctcagcctcccaaagtgctgggatcacaggcgtgagccaccgcgcccggccgtgatccataatttttacaacaagcatgaataacttctgcaatcagaaaaagttattttaaaaaataaaatgtgttgaaatgagtgccaataaaagaatgtgcaggatgacagaggggcaacaagggtagcaccaccagctgcactcagatgggaagggaattaaaagctgtcactgagagggagtatgccagatggagaaatgagcaaggagtctgatgggccaatccaaaccaaagaataaagtcaagggctggaggccagttgctcttgtctcctcctcaccatcactcactgcataaggcgtgagttggggatgggcagtttgctcatgataagggactcaggtttggcaaaaaaccgcaaaaggaatctaagaaaaaggaaggacatgggtaaatcgaaaaccaaactcatagacttgtgttgaataaaagaaagaacatagagaaacaagttcaagtcccaccttcacaatttacaactgtgccaacctgggtcagcctagctgcctatctggtctttggtttccataactttaaaatagaaaggagaataatgccctgtgcctcccagagttgttatgaatattaaattacatggtatacttagcaaactataaagaatcatgacggggaaggaaggaggaacctgtggtccataaagcagcagctaaaatgtctcagccaaataaaggtggaaagttgcaggtaggtgcaaggtaggctggcatttgagtagtttatggggatagattatttttaacaacataaacacagaggttccaagaagttaacttgtctcaagttaacaaaaataaatggtagagttggaaccctatggcttcaaagtctgcttttttctctgtctctaatatatgccttgtgaaacaagagattcaaggtgttgagaaagtggcagagcagggattagagtctagatctaccaacaagtataagtgagtgttctctctatgctggacactgttgtaagtactttgtatatagtaacttattaaatcatcccagtatccatggaaggaaattgtccccatttttatagatgagaaaactgatgcattgaaagattcaataaaacccaagatcacacagatagtagatgagcaaatcaagatttgaatccaggcaatatagcaccacaatctgtattcacaatcacaaagccatgttgctcgcgagcaggtatatacacatatattctgcccgactgctctgcaactccttaagcattgtctgcaagcccccacatccattctacagggtcatgtacataacaaatgctcttgaaagatttcttaagttcagaaatggccttcgaatgcagtaatattcagggacatgataaggaatgaggaggaaaaagcagacattctgggtgatgtactagatatggaataccaaagggacaacataaggaaggtgcctagattaagggaccagggactggctggatccacacagaagggggcaggaactctgttgaaagatggctgggagagtaagaggaaaatgaagtaaaaggaaaagaggaggatagggaaatcatttagtaatcatataggagatgagttcctcaagataatatgttgacatagtatctttaagcaaaagaaaatacaaaactgaagaaaaaatcactgctagaaataaagtagaacaggcttggttcctcaaaagacattctgggagaagaaaagttttcaatgaatatgcaaaaacatacaaacaataaaacactccataattctaaccattaacccaatgccccatttccaaacagtcaggcttagttaatagcttttatagtgcatttaattttcaatttgtgagatgtcaatctgggaggctttgttggaaaccaatgaggtgagattactctagcaattacccccaaataatgggtgactgcattcaacaaagctgtaaataaaaaatgcctttcttttcattagagagaatgaacagcagagaaaagagggcatttgggacaacatactggaaaaggtgatcactctaaatatatagtgagctttcatgggacagatttctagaatcctatagaaaaatcccaccaatatacttgtgtttaaaaaaataaaaaggcggcactatttagcttactaaattcagcataaggctcatagatggacagatactatctgtcccactactactcaatgcaaggtctacagtcagatgagcatctaacacaatttggtttgcagagttttcaagaaagcagtgtattttatctgtacagctgcccatttcaactgtcccttctatgctcataggaggaggaaaagaaggcccttggaaattgccattctggaattgaaaacttaaatcctccagacaaccattaacttttaaaggacatctaaaagtgcagctctgtgataaccaagaagatgatggtgatagttctgcctatgactgaatacacaaatctcttaaacctctacagctgctcaacaaaacaaagaaataaacattgcattttgcagagaatccattctatcatgttattcaacaaatttgtattcatctgtgactatgttactgttactgagtatacgcagtcacaatggtgagcaaaaacgaaaacaatttctgccttcatggagttcacagtatagagggaagagaggcattaacgcataatcacaaatcacacaaatgtacaacaaaaactgtgatccatgttaggaatttaaaaggtgtccctgtggaaaaaaaaaaaaaaaaccttgagctgagatctgaaaagtaaatcagaggtgaccagggcaagacaaggggtgatgtgctggataaggagaataaaaatattcctggaacaggggactgtatatgcaaaggtcctgtagcaagagggaccacacaatacagttaaggaactgaaagaaggtgcaggaagcctgaggggctacggatgagctgagatgggagagacaggcatggtcaaaccatgccaagtggaggatttaggttattataaatgcagaagaaagacatttgaagcagaggctgataaagaagttatgatatgaatcagatttacgttttgaaaaatcgctctagctgcccagtggtaaataaattggtggaggcaagcaatatgtcagaactaaagtgatagagattagcgatttctgaacttacatgacatcatatacaaagtatttgggcagagcaatgaatagcagcctcttaatccatgtctggcctgccagggcacagactggttaaaaacacagactgctgaactaggattcctggtttggaatcccaggaatgccactgtgtgcccttgtacaatttatataatctctctgcctcggttttctcactgtaaaacgagaatgataatataggttacaaaatcttcatgaccaaatgtattttgaaattcagaattttttggacttttgaaaggcatgagattacactaaatattctgtaacacccccagcagagtcttgggtaggaccccatattcaaacacattaacattcaaacacattttgaagcaagatgtatgattattaacactatgtggaataaagaccaataagtagacttatgtcaatccagatcaagttttgccatcaaatgagtttgcaccaactttcaagaaaattctgttttttcagaatcttttgaaattcagaactgcaaatgagggactacgcatatgtagtaccttcctcctagggttatgatgaggaataaatgaatcattgtaaacccttgggaaagtgtttggcacatagtaaatagcatttgttaagtaaataaagctcttaggtaccaaactagctagctgcatgaacttaggagttcctactctgtaaatggaaggatgataagatgacctctgaggtccttccagctttcaagttccataagaccccaaagtgtcttgaggaatgtctgtttccaatactttgtggaaaagccagtagaggaccctgagtctattcctaatcagtgttaaaagaaaaacttcagacaaattaactttaccagagtttaattgagcaaagaataatttgagaattgggcagccccctgatccagaatagcttcagagcaatgatgacaccagaccaattgtcccatagcactgatgtttatggtttcttttgaataaacatagaaatggatcctcccaatcttaaaagtggagaaagttagaattgtcttatttgagtttctttctcagaaaaccaaccatcaggactcccagatagtattgaggaactaaaacttaccagacaccacatctggacaatgaaacaccagatctctcacccatcatgattgcctaactgactccctgcttcctgctgaccaattcctcttccttacccctcattaacttatgtttttctgcatgtagttacatttcttccctgctatataaacccctgattttggttggtcagagtgatgaatttgagactgatctcccatctcctcagctgcagcacctcattaaagccttcttctctggcagtactcattgtctcagtgattggctttctatgcagggagcagcaagaactagaccaaactgctggcattttggtaataatggggtggtgggggacacataagggaggtacagaaacagttggactgggtacagcttggcatttgtcttattagaacatgggttgaacagttgacagcctgtgacaggctaaaactctatgattggtacaagagtaggttacagtctgtttacacatctagttaggttacagtgcagtgtgtaaggagaaacctttaggccaaacttaaagtatgtaaggaggccgctttaggctacacttaaattaacaacgggtaatgatgatgctatagccatttgatacctggtcctcccacctcttctgtcccactggacagttcatttacactcagactcgtttctgtatttacctctcctctaataccgtctcaccctctctctcctacacctcagcctgaacagcacccccttcctcatagcacccttaccacagattcagtcatgccctaagctcctaatcactgatacaaatcaccagactcccagaaaaaacaaactcctgagccaacccttgcctgggaaatggaagctgacagctattctcactgtgcttgctttcaaatgtattgggagcatggtcaaactgggcatcaaagagtctagccatatgactttgggagagtcagaaacttaactgctcagaacctcagctcccttatgtgcaacatcagaatgataataatagcaatagaaccttcttcacactgctactgtgagggtcacaccaggtgtaacacaagtaaaagttaccttacaaagtgcagcttattgttattatcaactgttgctgccagacgaggtgtcagagtcccagcatcaggaagtggttggttcatggacaggatagtaagaagaatttaccaacaatcgtataggtttgaagaagaaaattttattagatagaaagaacactgcagaagaatgagtggggtgcctcagcaagagaggaatgagcgcaatgtggtggatttttccttgggaatatttatgaatcttaaagtgggtactttagggtaatttgaaccatattagccatgtaggtcatgaaaaatgattgcatttgtaggcattttggtaccttgatgtcaacaagggttgcacaatgagtttcaatatgcatgcattccggagatgtacagcaattctagttacttatacatttttgggaaagaaacctgcaaccagatgcctgctttagataacagggaagtctaatattctaaattcctcaaataaggagttttgtctctggatggcctgcttgatggccaccaggtgatctttgctttccttggttgccttataattgaaattctttctggaaggaaagatgtcctgataatgaatagtcctcccaggaaaagaaaaatctgcattttcaatgctttatttaaaaaggaaacaagcatttattgacatctttacatatgccaatgcgatctgagagactacacttttatcaattaagacagacactaaggttaaagaaaccaggttacctaccagtagagcgttcagggcctggctggcatggtaaatttctaaatgcccacacatcaactgcctaacaacaggagctatcaggcagatttacaacccagaccactataactgaacacaggaccaagagccagccttacaaacattttctgataagctactgcagaacttagaccagtttcagcagcttacagagactgcacacaaaatgtttttgtgtcctgtagttcactttttgatgtacagagccaaattctacctcattttaatgctaaaaccccaccccaaagtgaacatgggatgtatgttatatatatatttacccgtcaggcatgctcacagctcccgtcataaatatgtgtagcttttccccaaacctgctgaatatgcatgataaagaccctgtgaagcataaaacccaacctgtcctttccctcttcaaagagagagcaccttcagtccatgctagagaccttctcttcctggtttgcaaactgatatcaccaataaaagtctcctttctactatttagccatcctggtggtcttttggaagacaccaggcactattctagatatttttacatgtattatattactcaatcagaaaacttacttttgtggacaatgtcatcatatcatataccttattaaattattatatgtttcttggtctttatttcaaaacaaatacagtttgatgaaagtcagatttattaatcatagattggtagcttagaaataataacaccttaaatcagtacatcacttgacattctataaagggcttggccagtcactgctgagcttgattgtcccaacaagatacaattattagcactgcttgacagagaaggaaactgagggtgagataatggccctgtcagaggcatttgaaccagagtgacttcatcttgaataggagctgggtaaaataaggctgagacctactgagccgcattccccagaggttaggcattctcagtcataggatgagataggagaccggcacaagatataggtcacaaagaccttgctgataaaagaagatgcagtaaaaaagctgaccaaaactcaccaaaaccaagatggcaatgaagtgaccactgatcatcctcactgatcattatatgctaactataatgcgttagcatgctaaaaaacaccctccccagtgccaagacagtttacaaatgccatggaaacatccggaagttaccatatatggtctaaaaggggaagaaaccctcagttctgggtttgcttgcccctttcctggaaaactcatgaataagccacaccttgtttagcatataatcaagaaataactataagtatactcagttgagccacccatactctgcctatggagtaggcattcttttgtttctttacttgtctaataaacttgctttcactcttctgtatggactcaccccaaatactttcttgcacaaggtccaagaaccctctcttgaggtatgggtcaggaccccttttcagtaacagcctgataacaggagaatggcatgaacccgggaggcagaggttacagtggggaactcaggaattgaacccaggtctacagaacgcatgctcttaaccactgtgctctaatcattgtctctgcagtcctgagaaggagtacgcttcagccatattttaatgaacaagtgctaaatttctttgctcagataatttcttcaagctgtgtcatttggaaggaaaataaaacagcatgggacacagcaaaaagtggtgagtttcattaaactgatgtaacaaatggaagcacagaggaagaaacactctaatggtcacttgcaacatgtaaataaaaaagcaaggtttgcaccatggtgcagttctccaccctctctggcaagtcctcctagtaactctgatttatggtatgtaaagttctacagcagaaggaaaatcaactcctgtttaccttgcctcaccatttcccttcccatctcagaaggtactgtgcaaagccactgtgcagacttaatagtttcttccgcatttcaagatgctttttctcactgcttttttgctttttttttctgcaatgagacagagaagcaattacctctccatctgctcatcttgatacctatgcttcactgggctagaaagaagaggaaatgagaatgggaaatctaaaaccaaaggcctagagcctgaagaagatgtacaaagtttttaattcaatgagatttgcatgtaaatctgcagttcaagtttccatcctactccacttctaagaaaaacctaattgcatctgactaaggcaagacaaacagaaccgtatttttaaaaataatacttttaaggttcagagaatctactataactctatcttgcatttctacagtgatttacgctgaacaaagcattcacatacattatctcatttatttattaaagcagtgctaattccttaagcaatcatttgaacttgaaatttaaaaggatttggcagaaaaaaaaaattatcattttgagtgcctatggagtgctagccattgtactgagtgatttgcattcattatctccaatccttacaacaacccagcaaggcaggaacatcagccctggtcccagcagagtttaaagtcatccaacaaggattgctatagtaacctgaggctagcaacagctctgagaactcagaaagggtagcaaatggcaacaccaactatggctttccatggagtgaggaaccaacccttgtgatatgacaggggaaaaaatgaggggaacagatactcttaactcactgctcacccgctgtctgatctactgcttctgcctcccttcctgctccattgtctaaacacaattggaaccagagcacaagggatcccactgacgaaacccaacagaatgagcctcctggggcataaagcagggtagggaagggtgaaaagtggatctggaagggaaacagaagacattcagcacagtccatccctcccccagcaacactcccccaggaaccctcccccatcatttactgttatttttaattcaaaaattgcaaaaatgccaaaacaggatgaaatgatatcagttcagtcaacttcccaacagaaacccaaaacatgagcaaccaccaaaagatggttttcataaaacgatcttttttcatgaaaatatgagagtaaaaagtgaggagataactagttaacataaaatttaactgttatatttctgaaaccaaccaaattgtctcatagaatgatgtttatggttcttgaataaacatagaaattggccctcctggtattaaagcttgaaacttacatttgtcttatccgacaaactttcctttctcaggaaatcgaccctcaggcttcccagatagtatcaaggaaactgaaactcaccagatcggtgagatgccagacccattattcctcctgactgcttccttactctttcttaatttctgttttctaaattccttcctgctatatacacccccaaccccattttagctggttagaaagaacagagttgaggcttggctgccatcttcccggccgatgtcacctgcaatataacaaagccttatcccctggcaaaactcattgtttcagtgattggctttctgagcagtcaatgacaggacctagaccgaacacctggcatttccataacagttcctgtggcttcgcatacgagcataagacctaaggtgatgagcatagcagccagccttcttccaccactattccttgtttgccctatcctctgcccatttctcaactggatggtgttccttactgaaaaattaaccacagtcttgatttatgaagggcctgaattcgttaggggataacctcattatcccctggtaatcaggaccagtcacctcactgaatgcagtgaccccttttctatacaatggtccagctacataaggagctcagaatggccagaggcagcttcagcttccaattcactaggaccatgactcttttagaagtagtctttctttgggcattagcatctccagaacattaagcagaagtacttccaatgggttatttggtgtatcagtaagacaggccactctcatctccacccttggttcccatacctgggcattctggctataagggatgacactatattctagccattggttttgaggcatatataccatatcatgaaggagagcactccaaatttgtagaacgttgccttcccaccatcttcataactgagcctttggcaggccatcccactattctgttaagtagctgcttctagatgatgttgcacatgataatgccaatgaattccatcaggctaacttgactatgtcataccttttgcaagaaaaactgaccccaagtcataagcaatattgggacagataaggcattctgtacaggaggcaattgagcaagctctggggcatccccagaatgggcagctcatccacctggttatggagagcctcatccactctgggtgctctctatggacattaacacagtacacaaatatccgtgctcaatcaaagaaatccattcatatacttttctcccagaattctgatgtcctgcaggtgcccagccctactcaagagagtggggagttttgggtccaaactcaacctgaaaccaattgtcaagagagccctttggtgtcattcataggtcatccccccagagcacagaacaaggtagagaggataaagactgtaaccagagggcaaagatattcagctctgtagatattattgtcccttttttcagataaagaaactaagagtccaaaaagcaaaaatatcttgcctgaagtcacacagctggaagaggaagctgaggttaaaatcttccattctaaaacttgtgttcttccctaggccattagcaccacatggaggaagagaaagcctctgggcttcctgccaggcagaattaggttcatctgagatgcaaaccaattaccagcttaaaacattttcttacattgataagtgaaatccaaagttccctcctgtggtcattaaaattaaaacttaaagattatgatgagcaaggaattcaaagagctttattagcttgctcagtggaatgtgttcttaaagatggcttcacccccaatcctgagccaccacaatcacaacctccagaaagagcaatctgtctaatagaaatataatgtgagccacattatcaaagtttcaaaaatttacattttaaatttgagccacattttaaaaagtaaaaaacaatgatagtaattttaataatatactttaacacaatatgttcaaaatattatttcaacatgtaatcaatataaaaatgtttgtggggttttttacattatttatttcatactaagtcttcaaaattcagtgtgtattttgtacttacagcacatctcaattcaaacttgccacatgtcaaacgttcaatagctgcatattgctgatgcctacgtattgagcagcatggttctagagatgagaaggccttccacctgctggctgtgtgtcttctcaacatctcagatgccacatcttgaaaatagggatcatagtactcttgggactaaaacaaataagaagaagaagaagaagaaataataataacatgaataggtaatatttatttatttgtcatgtgacaggcatgctaaattttagagaacttacagaacttaattcttataacaaactacaacgaaaaatggacacttaaaatgattaagtgtcttgccccaggtcacaactaagataacaatttgagcactgacaatctgactacagggcctgaacccttttatgaaaataacaataataataacaataatagctacaaatattatatttaaatacccaggaagttgatagaatcagcaagaccaacagcaaggcctcagcagggccaaccgtgcatgataaatggagccattgttatgacactgtcctcaagagcttagaatgttgtagggagaaagaacacataggatgagataactagtcacagaaggctgtttatggcatgtaacaggcaaacaaaagtgagctctacacaaatccatgggggcagtgatccgtgtagggtcttagggccctgcaagggagagatgaaatacaacagcaaatgcaagtaggtcccacttcgaggtcatgtgtgacttgtgcaatcacttagggccctgtgctcagaagagtgccacacttggttaaatattcagctgtcatggtcctgaaattcttaataattttatcactgaacttatattttttaagtgaagtctgctgggacaatggagaatgttcatgagcagaggagatacaggtaacatgcaatctatgtgccctcttccatttcttgctacctatttgcatacagcattcatgatgccccatgagcacatgtgtgggagtttactgagatttaaagggagtgtgaggtgagtgtgttatgaatataacttgagaactaagctctgattttttatctggcccaaattcctacctaaggggtctagggggtcatgctctataaaccataaattctgatcagatgggttttattctatatatcatgacttacttttcaatctgactctggaataccattatgagataaggaaaaatatataaccccaaaatatattttcttgccacactttgaaattaccctgaaaagtctcttgtgggaaaaatccacatcctatagagaatcccctttcccctttgttttccttacttccttttcagatccaggagataatcaactaagagccagatacgcttttagctctgataagaaacatacaacctgctctctctgaagtctgctatctgagaaattcctctgcacaataaaacttagtctccacaatcctttatcttaacctgaacattcctttccattgatcccaggtcttcagataaactcaacgaattatgacccagaaaatgtttaaatttactgatagtctgggagctcccactttgagttgtcccacctttctgaacccaaccaatgtatttcttaaatgtatttgattgatgtctcatgcctccctaaaatacataaaaccaagctgtaccccaaccaccttgggtacatgttctcaggaccttctgaaggctgtttcacaggcatggtcactcaaatttggctcagaatcaatctcttaaaatattatacagtgtttgactcttttcatcaacaaacggagtaagaggacagcaccgtgagaagccacaacgtctctttgaaccagaaattgcttcaatcacagcatgaagtcattctttctaagagacacaccattctaagaaacatgaacaaccaatgaaattcatcatatcctttcttaattatgctactttattaactaaccactcatgctgaaaacgatgacatagaagaaaagggaaagatagggcaactcatatttattttcctttcagtcctttctttttcttttttctttttttttaggcagagtctcactctgctgcccaggctggagtgcagtggcgccatcttggctcactgcaagctccacctcctgggttcaggccattctcctgcctcagcctcctgagtagctgggactacaggtgcctgctaccacgcctaattttttgcatatttagtagagacggggtttcaccatgttggtcaggatggtctcaatctcttgacctcatgatccacccacctcggcctcccaaagtgctgggattacagaagtgacccaccgtgcctggcctcctttcagtactttcttactcaacagtaagcttaaggcagagatattggtagactgtgtgcatatcaagaagaagaagaataagttgatttagctttgtgtagtattttcactgttctggtaggaataatacatatatatttgtatatatatatgtaagctatgaaaaacaagttgagtaattttggtgattctacatacaagcttaaaactacatacttgcatttaaaactggcattaggaggtgcttccacgatggctgaataggaacagctccagtctgcagctcccagcgagatcgacacagaagacaggtgatttctgcatttccaactgaggaacctggttcatctcattgagactggatggacagtgggtgcagcccacagagggcgagccaaagcagggtggggcatcgcctcacctgaaacaccagggattgagggatttccccttcctagccaagagaagccatgagagactgtaacaggaggaacagtacactcctgcccaaatactgcacctttcccatggtctttgcaaccagcagaccaggagattccctatggtgcctggctcagcaggtcccatgcccacagagcccagcaagcttaagatccactggcttgaaattctcactgctagcgcaggagtctgagacgacctgggatgctggagcttagtggggggaggggcatccgccattgctgaggcttgagtaggcgtttttatgctcacagtgtaaacaaagctgccaggaagctcaaactgggtggagcccaccacagctcagcaaggctgactgcctctctagattccatctctgtgggaagggcatatgtgaacaaaaggcagcagcctctgtcagggacttagagaaaaacccctcatctccctgggacagagcacctgagggaaggggcagctgtgggcacagcttctgcagacttaaacatccctgcctcacagctctgaagagcagtggttctcccagcatggcattggagctcttataatgaacagactgccttgtcaagtgggtccctgacccctgtgtacctgactgagagatacctcccagtaggggccgacagacacctcatacaagagagcactgcttggcatctggcaggtgcccctctaagacaaattttccagagtaaggatcaggcagcaatatttgctgttctgcagcctcctttagtgatacccaggaaaacagggtctggagtggacctccagcaaactccaacagacctgcagctaagtggcctgactgtcagaaggaaaactaacgaatacaaggggcctgactgttagaaggaaaactaacaaatagaaaggaatagcatcaacatcaacaaaaaggacatccacaccaaaaccccatctgtaggtcaccaacatcaaagaccaaaagtagataaaaccaaaaagatgaggagaaaccagagcagaaagcctgaaaattccaaaaaccaaaacgccccttctcctcctgagggtcacaactcctcaccagcaagggaacaaaactggatagagaatgagtttgacaagttgacagaagtaggcttcagaaggtggataatcacaaacttatcagagctaaaggagcatgttctaaaccatctcaaggaagctaaaaaccttgaaaacaggttaaaggaatggctaactagaataaccagcgtagagtagaacataaatgacctgttggagctgaaaaacacagcacgagaacttcatgaagcatacagaaacttcaatagctgattcgatcaagcagaacaaaggatatcagtgattgaaggtcaaattgatgaaatgaagtgagaagacaagattagagaaaaaaagagtgaagagaaatgaacaaagcctccaagaaatatgggactatgtgaaaagaccaaacctacgtttgactggtgtacctgaaagggatggggagaatggaaccaagttagaaaacagtcttcaagatattattcaggagaacttccccaacatagcaagggaggccaacattcaaattcaggaaatatagagaacaccacaaagatattcctcgagaagagcaacccaaagagacaaaaccatccgactcaccaaggtttaaatgaaggaaaaaatgttaacggcagccagagagaaacgttgggttacccacaaagggcagcccatcagactaacagcggatctctctgcagaaaccctataagccagaagagagtggaagccaatattcaacattcttaaagaaaagaattttcaacccagaatttcatatccagccaaactaagattcataagcaaaggagaaataagatcctttacagagaagcaaatgctgagagattttgtcaccatcaggcctgccttacaagagctcctaaaggaagcgctaaacatggaaaggaataactggtaccagccactgcaaaaacatgccaaactgtaaagaccatcaactctatgaagaaactgcatcaaccaacaggcaaaataaccagctagcatcataatgacaggatcagattcacacataacaatactaaccttaaatgtaaatgggctaaatgctgcaattaaaagacacagactggcaaattggataaagagtcaagacccattggtgtgcagtattcaggagacccatctcacatgcaaagacacatataggctcaaaataaacgtatgggggaagatctaccaagcaaatggaaagcaaaaacaaaaagcaggggttgcaatcctagtctctgagaaaacacactttaaaccaacaaagatcaagagagactaagaaggccattatataatggtaaagggatcaattcaacaagaagagctaactatcctaaatatacatgcacccaatacaggagcacccagattcataaagcaaggtctcaaagacctgaagagggacttagactcctacacaataataatgggagactgtaacaatccactgtcaatattagacagatcaaggagacagaaaattaacaaggatatccaggacttgaaatcagctctggaccatgcggacctaatagacatctaccaaactctccaccccaaatcaacagaatatacattcttctcagcaccacatcacacttattctaaaattgaccacataattggaagtaaaacactcctcagcaaatgtaaaagaacagaaatcacaacaaacagtctctcagaccacagtgcaatcaaattagaactctggattaagaaactcactcaaaactgcatgactacatggaaactgatcaacctgctcctcaatgactactggataaataacaaaatgaaggcagaaataaagatattctttgaaaccaatgagaacaaagacatgacgtaccagaatctctgtgacacatttaaagcagtgtgtagagggaaatttatagcactaaatgcccacaagagaaagcaggaaagatctaaaatcaacaccataacatcacaattagaagaactagagaagcaagagcaaacaaattcaaaagctagcagaaggcaagaaataactaagctcagagcaggactaaaggagaaagagacacaaaaaaacccttcaaaaaatcaatgaatacaggagctggttttttggaaagatcaacaaaatagataaaccactagcaagactaataaagaagaaaagagaagaatcaaatagacccaataaaaaatgataaaggggatattaccaccgatcccatggaaatacaaactaccatcagagaatagtataaacacctctatgcaaataaattagaaaatctagaagaaattgataaagtcctggatacagacacccacccaagactaaaccaggaagaaattcaatctctgaatagaccaatgacctgaaatgctctgaaattgaggcaataattaatatcctaccaaccagaaaaagtccaggaccagatggattcagaaccaaattccaccagacgtacaaaaaggagcagataccattccttctgaaactattccaatgaatagaaaaagagggaatcctccctaactcattttatgaggccagcatcatcctgataccaaagcctggcagagacacaacaaaaaaaagggaattttaggccaatatccctgatgaacatcaatgtgaaaatcctcaataaaatactggcaaactgaatccagcagcacatcaaaaagcttatccaccaccaagtcggcttcatccctgggatgcaaggctggttcaacatacataagtcaataaacataatccatcacataaacagaaccaacgacaaaaaccacatgattatctcaatagatacaaaagaggacttgacaaaattcaacagcccttcatgctaaaaactctcaataaactaggtattgatggaacgtatctcaaaataataagttatttatgataaacccacagacaatatcacaccaaatgggcaaaaactgaaagcattcccttggaaaactggcacaagacaaagatgccctctctcaccactcctattcaacatagtattagaagttctggccagggcaattaggcaagagaaagaaaaaaagggtattcaattaggaaaagaggaagtcaaattgtctctgtttgcagatgacatgtttatatatttagaaaaccccatcatctcagcccaaaatctccgtaagctgatgagtaacttcagcaaagtctcaggatacaaaatcaataggcaaaaatcacaggcattcctacataccaataacagacaaacagagacaaatcatgagtgaactcccattcacaattgctacaaacagaataaaatacctaggaatccaacttacaaggaatgtgaaggaccccttcaaggagaactacaaaccactgctcaatgaaataaaagaggacacaaacaaatggaaaaacattccatgctcatggatagaaagaattaatatcatgaaaatggccatactgcctaaagtaatttatagattcaatgctatccccatcatgctagcactgactttcttcacagaattggaagtaaagctactttaaatttcacatggaaccaaaaaacagcccacattgccaagacaatcctaagcaaaaagaacaaagctggaggcatcatgctacctgactttaaactatactacaaggctgcagtaaccaaaacagcatggtactggtaccaaaacagatatatagaccaatggaacagaacagaggcctcaaaaataacaccacacatctacaaccatctatctttgacaaacctgacaaaaacaagcaatggggaaaggattccctatttaataaatggtgctggtgggaaaactggctaggcatatgtagaaagctgaaactggatcccttccttaacaccttatacaaaaattaactgaacatggattaaaaacttaaatgtaagacctaaaaccatgaaaaccctagaagaaaacctaggcaataccattcaggacataggcatgggcaaagacttcatgaatacaataccaaaagcaatggcaacaaaagccaaaatagacaagttggatctaattaagttaaagagcttctgcacagcaaatgaaactaccatcagagtgaacaggcaacctacacaatgggagaaaatttttgcaatctatccatctgacaaagcactaatatccagaatctacaaagaacttaaacaaatttacaagaaaaaaacaaaaaaccccatcaaaaagcgggtgaaggatatgaacagatacttctcaaaagaagacactggccgggcgtggtggctcacgcctgtaatcccagcactttgggagaccgaggcgggcggatcaggaggtcaggagatccagaccatcctggctaacatggtgaaaccccatctctgcttaacttagaatacaaaaaattagacaggtgtggtggcgggcacctgtagtcccagctactcgggaggctgaggcaggagaatggcgtgaacccgagaggcagagcttgcagtgagccgagatcgtgccactgcactccagcctgggcaacagagcgagactccatctcaaaaaagaaaaaaaaagaagacatttatgcagccaacagacatatgaaaaaatgctcatcatcactggtcattagagaagtgcaaatcaaaaccacactgagataccatctcacaccagttagaatggtgatcgttaaaaagtcaggaaacaacagacgctggagaggatgtggagaaacaggaatgcttttacactgttggtgggagtgtaaattagtttaaccattgtgcaagacagtgtggcaattcctcaaggatctagaactagaaataccatttgacccagcaatcccattactgggtatatacccaaaggattataaatcatgctactataaagacacatgcacacgtatgtttattgtggcactattcacaacagaaaagacttggaaccaacccaaatgtccatcaataatagactggataaagaaaatgtggcacatacacaccatggaatactatgcagccatgaaaaagaacaagttcatgtcctttgcagggacatggatgaagctggaaaccatcattctcagcaaactatcacaaggacagaaaaacaaacactgcatgttctcactcataagtgggagttcaacaatgagagcacatggacacagggaggggaacatcacacaccagggcctgtcatcgggttgggggctgggggagggatagcattaggagaaatacctaatgtaaatgtcgagttcatgggtgccgcaaaccaacatggcacatgtacacatatgtaacaaacctgcacgttgtgcacatgcaccccagaacttaaagtataataaaaaaaaactggcattaaactatataagatgaatagtaaaattcatgctaataatttaaatttaaatttttatttattaacaatactaaatagtaagtaaaaagaccatgctaagtcaagagaaagagaccatggaagaaagaaaaaagcttgatattttagtccttttcatggcatttttttcttgcttttaaacaagagggcccatattttcactttgcactgggactcacaaattatgtagccagccctgttggcaagagcgcagcttcccctctcctatgctaatagcagacactactgattgcatatggtactgttccccactgagccgaaatatgacctcaaaatctttttgaaagcagggttcaaaagtgcaatctgagcaggcatacaagctgaatctatgggcatccctcaaaatcaaactatgcagatggaaatggggctggctttccagacaatgaaaatactggctggtgtgttaccagagtaatgagtaggccaagcttgctaaactcaaactatccactacctgtgaacgtatcatcccagttccaaatgtaaaacaacataacaaaaatcagcttgacaaacaagataattagacttaactttgatcatgtgtttcattagttacagaaacggcccacaatttagagttctttctgattatgttagagtaggagcctctaaaaaaatgaataatgcaataaatggatcaatatttatatggtgctaattatatgccaggtgctatttttaaatgatttgcatacattaactcatttaatccatgtaacaggcccagtgtggtagctcccacctataatcccagcactttgggaggccacagcaggagaatcacttgaggccaagagttcaagtccaagaatttgagtccatcctgggcaacacagtgagacccccatctctaaaaaaaaaaatcaaaaaaagttttaaaaatccatacaacaacctatgaagtaggtactgtggttatctcatttttataggtgaaaaaactgggacagagaggggtttaataactacctcaaggtcatcatctaatcaataacagagccaggtagtgtggatttaaagtttatactcttaaaatctcttgaagaagtcgctgcagaaggtgtccatcacagacttggcaatgttttgctaaagatgttttctcgggaagctctcggttttctctgggttttttcctcctcctatgtgacattgtttgtcatctgtacctcagagcagttctgcgtgagtcgcctcacagtccctgatgagcaatttcacccattttagcccttcccacactaaccgcgaattcaagatcagcccaagaagtaacaacatccatgtcatcagctcagccagccaaaataccctgtattccagcttctgtaaatattattagctaacacctcgcttcaatccttgaaaccacacaccagaatcttagagttggaagggtttttggaaatcatctaatacagggataataaaaaggtttacctcacatgcccattttgatctgatcgattggtagtagatgcctggagtgacatgagaagggttttgataccatttggagtttactgaaataaggtacatgcctgacatgtacctgagagagcagcagaagctcatatgctgtcctagcagtacagtgtagctcttaggaatatgggctctggggttagatttcctaggatcaaagtcttgcttcactgtttgctgatagaaacttgcttaagtttgcactaaatctatctaagttctcttgtttgtgaaatgaggctgatgaaatctacctgataggttggttgtgataatttagtgaaataatatatggaaagtacttattggaatatctagtatgccctaagtactcaacatgctgttaacacatattgatcttaagcaacttgtcgtatctggcatgggtcctggaggtgacagtggcagtaacagtgccatttatatgccatttctgatctagtcctatcttttaaacctacagatggagaagctgaagctgcagaaactgtggggctttcccaaaatcacatatattgtctccttcaaaactaaaggcactcaggaaacataataatcttcttgccctggctctgcctctccctgcgtgcaacctcaggcaaagcactgctctctggacttcggtgtccttatctgtataataaatgagtcagaatccaaatgatcttcacagagtagtcactcccagagggtcctgtatttccagggggtgaggaacacttttacccgtagttcactggacgttacaaacagcaattctttacttccagttttgacagtttcagtgttaactaatcactccagtattccttgcacaaatgcacacgtacattccatttgctttgatctcaaacttaagttttttatgaatgaaggctacagctggacaccaaaagattataccattaatttttaagtatgcctcagagggtctaatgggctatgacccacaatggtcatatcagcggcattccacttcctcttgagccactggccaagctggtattgaggtgcatgtcccagtttatctccagccctcctaatctcagactttctgcacctatgctaatacttgaaccaactcttcttttttttaattgaatccaatgcaatgtacctgggaaccctgcttcaaaatctgatgccaaatctaaaacactggacaaaatccaggtttttattcattttctgatgggcactagctgctaattaagcatccaaacaatgttctaaaaaggaagaaaaatcataaaatatggacttaacattaatcacacagacatacatgtaatatacgttacctttatagcaggaaccaataaaagaatacaatataaaacacatatttgtactagataattttgtataaatattttaaaggtttcttagctcagggattagagcactggttttataaaagagcaggtcacatattcaaatttcacgaagactttcctgatgtctttcaaagaagtataacacacatattaagaatctggactcaggagccacattatctgaattcaaatcttgactttctcacttcctagctggtgaccatgagcaagtcattaaataaattttcttacctcagtttgctcaactgaaaaatgggaataatgatgatctggtaagaattgtttaaaggactcaatacacattaagcgtttagcccagtgactgcccaggtttcaagacaaaggtgaattcaagcctcttgacataatgacctcacttttcaacttatgtattgcctcctattttacagataaagaaactaaagttcagagaagagctgttgcctaaagtaacgttcactgagcaggtcaggacaggacactacttagtagcaaagccaggaccagaacccaatttttctaaacctcagagcactactttcctcaaatcagtgttccttctgcctcatctagggtagatacagatatccatcctctttcttcactgcctgcttctactcagatgggcttcctgagagcaagatccctgtcatattctcattggctggcaccgttcctagcatatagtaaactttattatctaattgagttgaattcattcatcagctctttacattatacacctaacttcttttagatgttgccaataagctgattgtcagttatttaggtcttaaggagacagtccagtagagtggtttagaaaaaaaggctccacagctgggctgtatgggctcaaagagtacttctgccacttcctaattaatttgaccatggccaggttacttcacctcagcttcttcagttataaaatgggacaataacacctctgtcatagggttatgagtgataacttggaataatatgcaatggtcaattgtatgtgtggacttgactagcctataatctcggttactcaatccaacacaactaggtgcagccacaaaagtattttgtagatgtgtttaacatctacaatcaggaactctgactgataaagtatgtaaagctcatacctggtccatcatacttaatgaatgttaactgccaatagtgttagtgatatttccattgttgttgaacacatactgaaagccttaacacaataactttaagtgtaagggtataagtctttgcctacagttctccagaagggattatgcctgcaacttactttcaaacaagtagtttggaattgtgtatagatagatattgatcaagcacatatgggaaaatattaacatttggggattctgatgacaggatatatgggaattctttgaactacttttaaaactttttatgtctgaaatcattattttaaaaaagttagcctgggcatggtgactcacacctgtaatcccagcattttgggagcccaaggtgggcagatcgcttgagctcaggcgtttgagaccagcctaggccacacagtaaaaccccatctctacaaaaagtacaaaaaaaatagctgggcatggtgatgcaccctgtggtcccagctactcgagaggctgaattgggagaatcgcttgagcctgggaggtcgaggctgcaatgagccgtgttcatgccactgcacttcatcctgggcaacagagtgagacccaccctgtttcaaaaattaagtaattaattaatttaattaaaagttaaaattttaaaatcaatagaattaaattatatttaaaatgttccaacagatttactctggcaacaaccaaaggtctgagacaaggattgctgatgtggagtgaaagagattagtcaaaatgcctattgtaaacattttaaaattattaatctatttaataaacaactcaattacccatattttaattgtgcaatattacctctatgaactattaatgaatagacattttaaaaagagagaaagagagattacatcctgtttgggggagattagagagagaatgggtatgatttcactaggaaaaaatgaaagatggaaaaggagggtctctcaggcaatcaaaacaggctaagttaagtcaatctattttagatgatgaaatctatgtctgtttaaactctttttctgtgtaataagtgcccagcagataaacgaccagagtggtgcactgcctgacagaggttcatatttaaaagttcctcctccaagcacagtgctaagaaatttatttagaaaatatctaaatgtctcctgggtctagaacattagagacaatggcaggccctccggctagatcaaagtgcaccccgtggataaacatgcccagactgaaaaggatgaaatcctgggccatctgctgggatgcagctgtgttctaacacctcacttttgattaagagatcgcaaactgacttgttaatattgtaattcaaactttgttggcggctacacaattggaacctcacggacagtctgcctaccctttaaacatgacatttgagttaataccctgtcctttttccaagacacacgttactaaaaatcactggaacctgaaggcagcaaaagttcagcaatcaaaccctgaatcctgatcaccacccttcaatgcccattgtgaggagctctagttaagctgatgaggatgtgtcagcaaaccagagctcatcaccagggtgcctatcggctgcaccccagcgtgactatgaaacacccagaagaagcaaagaaaagtctatgtgtcttgttactttatctaattcccccaatattctgctaccactatcgtccatttgcaacttgttccaaggaaagcacattccatccaaaattagggtcttatagaagaacttatacctctggcttattttaaaacatatatttgaaagcctacaaaatatgtaatgccttattagacactgtacaaagatatatgtgacatcatgcctatcctcagagaatttatattctgtgggagagataaaacataaatattaatcagatacaaatacaaatacaaatatgacatcatcgttggcacacaggcatgtcaaaaaaaaaaaaaaagagcttagaaatggactttgtaggattaaggtgttcaccaaatgttatcgtgtttctctgagtggtcggtttggggatgcttcttgcctttttctctgtactttatgatgtctttcaattttacagtaagtatgaatcatttttacaaaaacaatgatgtttatttcaagatggaataggaaagaaaaatgggttcatggaggaaatgacactttttaaatagatataattcagaggagtaataatgaatttgctggttatctgacccccactctaattcctttggaagtcattaaatgaagaaaggcatctcttccatgagcctgggcaaattcacaactccctgcttcttgctcctaattattctgccagtcaagtccaggaaaaatgcaagtggcataaaagccaagggtctttgcaaccactggacccaatagattgactatacaggaggctactcaggagtagatgttttgagaaatgttgtaatttcccaaaatgtcaataacaagtacagctcatggttctgacctgcctgtgagttttcctccactcagcagtcatagcagccaatggaatgatgtggaaataattcacctctgctctagagaatctgcttgagaaattacatacaacaaaactttcccagacacaggatacctgaagaaaattacttgattagtaagaaccaaagcatttccagaaccaaggcaaggagctaaagtagacagaacacaggacaaagaaactcaagacttaagtttcttcctgactttcacacttagcacaaagtgtgatctttgatccatagaactgctcttgagtttattagcaatattactttgtaaattgggaagatagtaccttatccttaatactataaagggttattttaaagattggtaaataataatgttctttgtatcttgcaaaagggtatgattaaaattcctagagtttagaaaaacattgtgtggttatcttgtttaaagatgaggagaggaccattatccctcagaagtgccaattttacgtctttcccagttttcaacataacaggtcaagtttcaaacagaccatcttgaatcttccagtgactacaagtcaatgaaatatcagctttacagtatgtgtcttgattcatttattcaggaaatagatgatgtctatctactctatgcatattaaaatagaagacccatcctatattacagactcagagacagattaggggtgggccaaccattcaggtaatcagggccccatcaaataggggaagctaaaaaaatggctcttgggatactaaattgtattttaaatgtaatgagatgaagaacatgtgtttcccagtacttcaagtagggataaaatatatgtggctgggaacaattacttaataaactgctttgggtgctctgtgagtccccagaaaggcaagtccaagatgacgccttctaagaagggtggatgtgaagagcctagagttttggttttgctgaggggagaatataaatttggggaccagagcttagacaatagaggtgaggttgagagcttccaccagtgatgatctttcttcatctttaccccatagagtgctcaaattcacctctaaatgaactattaagtacatctcttcaaagagccatcaaattattagcctgcaagagatacccacatgtcttgttaaattgtgaatagtcccttttgtcactcatagtcagtcttaaagtattgagaaacataattaaaacaaaagttcattctcccagtcattcaataatttccatatcccttctccttcacctagaccaccctggccagaactgatgtcatatataaatgctacagagacttagtattttttgttctactttgtccttctcttttacctaaagaactacaaacatgagacatgcagttgttttaatataaagcccaaaagtggacaaaaatattgctttcttgacattatactatacacctttcctacaaaaatagacaatactcccatgatttgatattgttatcaatcattcctttcctcttctgcctctcaaaaaaaaagaacaaatactcaaaccacctagtctagcatgaaaagtgtataaaactgaaatttgcaaatatctgaagtgaaactcagtcctgagaagcaatctatgcatcccctggtgcaagttaaagccaattgcctccaacaagatccacaacacaataaggctggggttctaaacacagagaacacagaaacaagggccattaaacaacctggctgttaggcaaaatatacattacccaaaccatgataactaaaccactaaaacaatagccctgcagtgtttatacacttagaatcagaaaaaaaaaaaaaacagaattattgtcattaaactggggtaaactaaaacatctaacaaagaataaaagaatccccatcccacatttattattttagtttcttctccaaattatttcagtcctttgtgcccttggaaagtcacttcacctctccgggacttattttcctctgtgaaattaagaggttgggttagataatatttacaatattggacagctgtgtactacaacactagggaattagaagacctggtgtctcatgcccgatctgtcatgaaatgttaggcaagtcatttaacctttcctgagtaccagaattcctcatctattaaatagagacaaaatcacctgctctgcttatcttacagggatgaagataatcagattgcaagtggttagagaactgtaaatgtcatacagttataatgaactagaagtatggtatggtttggctgtgtcaccacccaaatctcatcttgaattttagctcccataataccctcatattgtgggagggatccagtggaagataattgaatcatgagggcggtttcccccatactgttctcatggtagtgaataagtctcatgaaatctgacggttttataaggggaaacccctttcacttggctgtcatttctgtcttgtctgctgccacataagacatgcctcttgccttccaccatgattatgaggcctcctcagccatgtggaactgtgaatccattaaacctctttttctctataaattacccagtcttgggtatgtctttatcagtagcgtgaaaacagactaatacaaagtactatcatcattttaacttcccaaaaaacatctaatagaaaagatcttttccccactttagtttccaaagagcgatcactaaataatgattctatggcgctgagcaactttggagcgaatggctgataaaggtactggaaagccaacgtggggtagtgagaatcagaagacaagtcctgacacagactctgtgtgtgacctcagccaaggtatttaatctgattgcctcagctttctgatctcgcagacatggagctgggcaagttataataccagacatctactgaatagttaccatgcagcatgccttctttcaattacacctcaaaatagccatatgacataggtaagatgaccattcccatcttgcaggtggagtgtctggcactgcacaggtatgtaacttgctgagggtcacctaaagctcagtaaaaggcagtcagtctaacttcaatgtccatcttcttgacctctagccagtagttctcaaactttttggtctgaggattcttaaaaattaaactatatttttccaaaaagtaaaatagtaagaagaatcacattgttttaaagttttagaagtctctttaatgtctggcttcatagaagacagtaggagaaatggccattacttccccaccacagcccccaatagcaatcaaacaaaatattatataatcaaattgaaaggaaactggaaaaaaataattacaattaaaacagcaccattttaatatttatctaataagcatcttaagtttctaaattagaaggtcaccatatttagtgaatgaaatgtaataataatcatgagattctaaactgcattttatacttcagtgataatctcagataaatcagccattcccagcaattactgatattttatttttgttaacagcctgaaaaagtttttgaagagaaattaatgattgagagcttgatttgaaaaaaaaatgcacactcctatttgattctaagaaggtgtaatacaatttttcctaagcagaagtatggactaaggaagaaaatgataacctgtgtaggctgatacgtcagtgagatgtatactttgactcctactgagaagatggggatccaggtagcctctgaactcaggtgagtgttctctttggacacctctgatttacttccatgatttccttccttaaacctgtgccagaccactccttcttccatctattccttccactctccatactcaggtaagaccagtctgctttttacaatgccctgatattgacattcaaccttaggaaataggcaaaaatcatattctgaatttctttcactgcttggtccaccaggtaaacatcacctcacactgagacaatatatatttgcccaaaaaatgttttgtgaacaactattatgcacctttatcttctccatgtctttatgcaaacatcatcttagcaaggccttcaagagccatccattaccacaaacaccactaatatcaccacgtctctacttcttccctctcctcccttcctcctttattttgtctataatatttatcactagcacattttaaatttcatttattcatttcatttacttattttctatctccccagctaaaatgtagattccatgaagacaaatattgtttgttatgcttccctcactgttgagtccccagcgcctaggatggagcctgacatatataaatttatttctgcctttattgcacatagtttcttccttactgaagagaatttaagatgcacacgtctctgattggccatcccgatcaatttccccacctgactcaatatgtgtaagctctttaattccagagagagagaaatgggatgagaaaccacacacagaaaaaatgtgttgaatgaatgaaagtgattagaatgaatgaatatatggacaaatgaatgtagcaatctaggtgggatgaaaaagaataatttaagtcatggactatcctctcaaggagcccacagtccaccaatgactctcaaccaggtatgtgtgacagatgacatatacccctgtcacacagttctatggccatgacccacactgtggaagctggcactaataacatgaagtgcagattatgtataattatccctcatgtattctgaaactccacccttttgctcctactcacaaagcatccaagatctagactggacatggtgtttgcataggggtgaccttgaatcagttctattttgtaaaataaattttcttaaaatgtaatactttccctatgattagtaatcagttactcataatacaactctcaacaattggcaacacttcagaatgtccagctctgctttgtaaaactgcttgcctagaaaacaggatgaagaatgtcacttgagaaataaggaaagctacttgctctattagagaaatgtgtaataaacaattggaaaatacttggtataaaaaaatacaaacattgttttcaggtcttattctttgaaatgtgagctcttattctttgtctattttcccaatgcctttctatcacagagcctatcatatacctggaactccagggattatgaataaataaataaagcactggataaaaaactaaattgcagaacaagggaagaataatatattagtcattaagtgatataccagagatcctaaaggcctcaaacctatgcaattcctaactcattctttgaaactcaactaccaccttttagcaaagtctttctgacttccccaacccaaatttcattttcctacatgttgatcacatcatatttttgtagtgtcttctttaagatactcatcacatttcatctcatgctggtccttcattttcagcttcagagttctttcatttgctgatcactactgcaatctcagactggttcctttgatctacatactcatggaaccatgttccattctttcagggcacttatttcagcggtagttacacaattatctttttattcatttggcttgagactatctcaaatcaacaaactgtgagctccatgaccctagtgaccacatatgattttgttgaccaggtattcccagcactagcacagtgcctggccatagcaggtgcttcattaatatttggtaaatgaatacattaatgaataatatgtaatttgagcgcatgcacagcaggtcctcgaataatgctgcttcattcaacattgttttgttatagaattgatcagaggaaaaaaaatcatttcctaacccaggtccactatctgtgtggagctgacacattcccccatgtctgcatgggttttctctaggtactttggttttctctcacatttggaagctgtgcatgttaggtgaactggcatgtctaagttgtcccactcagaataaatgcagctatgtgtgagtgcacattgtgatgggatggggtcctctccaaggtcagttcccaccttgtaccctgagctgctgggataggctccagccacccatgaccctgaattggaattaagcaggttggaaaagaatgaagggatgaataaatataaaccactgtaaaataaaaatttgtgaagtgtacagtgaatatacagatgcctgacaacaaactgtgcagtataaaagcatccagcaaaccccccatatttgttattgtttgtttttgaactgcatggtggttggaggggctcctgacaattttcactttgcatttattccttgatttaacctgccattactacaaccactgtcactcactgattcattaaaaattgggtaaacattatcttgtttttatcattctttcttaaatatatacatagttcacatttatttcaatgcttaatagtagaagtatgatgggaggccgaggcaggtggatcccatcctggctaacacggtgaaacctcatctctactaaaattacaaaaaactatccaggtgtggaggcacgcacccataatcccagctacttgggaggctgaggcaggagaatcgcttgaaccagagaggcggaggttgcagtgagccaagatcgctccactgcactccagcctgggcgacagaacgagactccataaaaaacaacaacaacaacaaaaaaaaaaacaaaaaacacacattttgggtctttaagtagaagtttggtgatgttttgtgaccagaaatatgccatagaaacttaactcttatttatatcaattagtttcattatacattgtttcacttagtgttgtagcttctaagaacctattggctttaagtgaagacttactgtggtatcttcccaaaagacagcacactccttcacctcttgtaacagggaatctgacgccttgaacatgatagtggctccataaatattaacttggatataatttcctaaagctgtgtatatttgtgtatatgtgcatgagggtgtacgtgcatctatgcagcaaggaattgaatgtacctttaaaaatgtatcacagctttctacctttcacctgtgtcttccttcagaagacttcttttttatgtacaaattgaatattcagttaaacaattacaaggttgtcacactgttgacaaaaaacctgttgcagcctttaagacaacctcgaataggataacagccctttatgactttaacaaaaattcatttttattgcaatcaaccagcatgtactagaatcaaaaggaaaaaagaaattctgccagacttggcagtgtggcaggaccagtttgtgcaacctatatttactggtaataatggttatgtaagaggcccttgcatgggaccatcatttactcacaaggacatacagctcacagcctggttcagaacatagtcattattctggatgctcccatttcaattcaactgtatttctgagtgtgcaatttaaaaaaaaaaaaaaccatcttccagggaccattaagtaatacttggacccccctcaaaggacagctgcaatacatttaggcacttagtcatccagttatcacctcttctctcaaaaggccacatcagcaaggagtaaaggagtagactggaaatgccttgctgggtatcctggccagctgcttctacttggcctgatgtattattgtataggccaactatcaacaatcaattctttagtcctctcttagagctgcttggctgcttgtcctgctccatagctcactatcataatctcctctgacacacagtggtgtccaaagcacaatttcacacagggccagggttccagtctgggacctgaagcccctgtccaaaggagagatagcacaggacttgaaatcaccagaagatcccaattctctatccaggctttgcatgtaaagtgggagatttggagcaaggcaagtagcagcacaagcatcccccagtttccttttctgttttcagagggtggtgaatttcatgacttcaaagaatcctttccacattgagcatctatgcctttggtgataccactattttaatgtgtcagctttattttgctttacattctctctttgttgaaagtagttaagcctttcctaagtgaagaaaacttgacaaagattaaccttcaaattggttaaccatgtcatattcctagcctgcctccaatcttctaaagactcatacaagaaaaacaacgaaagtgaccaactacttatagtataaaagcaataattcttgttaagttctactaagtgtccagaactgtagtgtgtgtgtatatcgggggtggagtagtgtgtcatttagaacacaatccaagtctagagagagtcaaagaattgataagaaaattgttgcatgtgaaacattcatgctaaagtactgaacttcatatggccaagtgagtgaatatataagaaggtaaggctgataatagtcatggaagaaatggttagaaaagtaaattttggtgtgtgccttacaatatagaaagctttgataaaaggaaaaaaaaacaaggaggaagttattccatgaatgtgccaatgtttatagagatagaaatgactgaatacatgcagtgcttaaaagtaagagctctgcaattgggtagactggcttctgatcctggttctgtcatttgtagttgggtgttcttgggtaagtcaccacttgtccactctgagcctttaaatttctttgcctataaaatggagatatttagaatggctagctcaggaattggttatggggattaagttaaataaaattaaacaaggtaatacctagcacatagcaagtattcaaaaagctttagtcataattgatatcactatcaactaacatttgtagataacttgttatatgtcaatcactcttaggcccaagaaatacaaataaattaaaactaaagtgctggccacaaaaactctcactctgaagaccaactgacaaatcaataattcaccgtgacacatattgtaccaaagctttgcaaataggaacacagggagcaagcacctaacagtggttggggagaaggaaaggaggaggaaaacagatcacaaagatggtgagtattctaagtctaaaagaatgagtaggagcatacaaacactaaacaaaaaaaaagttttctagatagaatattacatgcaaagatacagatatttaagaaacaatctaagaattgcaaatggtttggtggaagatagagtacaggatatagaggggaaacaataagggaaaaggctggacaattaggaaaaaacagatttgaatttgtttcttcaggcaaaggagtcagatgataatgactaattctaaggaagaagaataaaaaattaacaaggcaaggtggaatatgtaaattattctcagttaatgaagggccttaaatgccaactcaaggagtttgaatttcagcctatggacagttgaaaagtattttcagttctaagagaggggataaatattaaaattctatattaggtagattaggcaggtatatatccaaaatgggaattggaaagagattcgaaataaggtacattcaagaatgatacagtaaggccctggtcctggatttttgaagatatgaatccaagacatacctaaactgaactgatacagaaaataaataagaaagacaatcaaagttgcctggaggaagtaaggtttatgaggtataggtcatgatgaaatgaccttgagtgtagcttgagtgtagatgatttgctttaaaagggaaaagagataacagttgagaagcctatcggacttttggtgttgagctcatttattaatctattcattcactcactccttcaacaagtatttattggtatttctcctgatagggtaatatgaataggcactggagatagaaagatggtataaatatagatcatgccctcatgaacttagagcttactaggggagaaatggaaggtacccaagcaactattaagacaaggtagtaaatgatataattaccaaaagaaggatatcagtgtagtgaaaaatgacttccaactggggaaaccagaaaagtcatgatggagaggtcaggatgtaagctaggctttgaaggtgaggtaagcttattaaacacagagtgaccataagtcccagtttacactacacagtcccagttatgccttttgtcaagcataattgttaacagcaccccagcttcactccctaattttaacaataaattatgcaattgccctagttatggtgaaggggtgccagcctgtgctcaaaaccaatgtcagtgagaaggttgaacagtggagtcaaaaggctgttaataatgtaatacttatagttagggaagtaatgatacagttctccttggtcccaaaaccaactactcactaatatcacaaagagaaaagagaactatgttcaaaggagagggatcgtgatgtaggctgactccaagccatgctaacacttacttcaccagtgaaccctactttgaggaggcatctcatggaaccagtgttctacagaacacacttcaagaaacataaaaccttatgatcaattggtagtgatgttataaagagaaaaatgaatattgaatgaagtattgatggctagtaaggcatttctaaatagaaataggataattgctgtgtcacctacagtgtaatatttatacaggatagatctctctaaattacaagtctcttaataatgtcttggcttgttcaaaggaataatgaaatttttaaaaaatgattttttacagggtagactgtatctatggtcctaaactctatattttaaactccagaacagcttttaaaactctgaccatagggcaccataagcaacagaacaaatggagttctgctttctttttgaaaaggattattgtgcaactcatctctatgaatgtaaaatgccagaaacctccatggctgcagaaaatctagtacctttcaaagttttcttttgaaagctctgaagaatgagattgatgatagaatccctaatgtctcttttttttgtaatccacaccacacaagatttaagagccaagccagaaaacatcaaatgacttgttcagcattgttcaaggagaaacattgatgttttctgccactgacaagaaacactaagatttttataaaaggtaaaatgagatatgaccagcagcatgtctactacaagatgctgttacaccaactaccataagcagaacaatataaaacaaattcatattcctgactgcctgaaaggaaaaagaccctcacaaatccacagtgcatgaaagaaaaatggtgttaacaaaaaaaatgaatataaagctggtcccagtgacctctaagcctgtaaaaatcaaacacacttttacataactttattatttcttgtttacagctagtggtagataactctggtattcactgaacaagggaaagcaaaatactcttatcattttaaggcccaactcagccaatacagacacattttttttctaattgatttttctcttcagtctttaaaaatagaaactacatcaccacctggtaaaataactactaagcacttaactgtatgggattatggtggtcacagggaaaagagaattactaggcatagcccaccggcttagaattctatatgaacaagatatcctaaatttgtaaagactgtatggtctttaagctatttcatttacatggccacatttcagtttctcaatatgcttgtgagatagtcaaggcaggtgatacaacatccaaatcagaacagaaagctgagcatcaccaactcagtcggtcatcatgcctgagaacttccagtaagtacggagtgaggactgcaacacaaggaccctaattccatatctaagggtctttctcccacactatagctgttaagcaatcaagttctctatacttgctccttataacaaagttgttgcttgcctctttcacaataagttttaaaatgaataataacaactgaaagggttaccttcacccagccaaagagtgagtgaaaagtagaaatgggcagcttttgtaggtccctgatatcaaggcagcaaacatcagcctatggactcagacttcagacagccattgtgcacagcagcttctctgtatacaggtgaaatcaatacttaagtaaggactagtccacagaatccaaaggaatctaaatctctttacagattatcatgatagccatggtcatcaggaagacacataccaaaattaggaggagacatgaatctgtaaagataaagcaagaaaaactctggtggtatcttagtcgagggtcacaaatggaaatgtccacagcaatcaggcaggtaacatagtgagggtagtgggctgggtcggaaccagggtgagctactatgtgaaggggacagcactatttagttctaattgagtcctgttatgcaggagaacaggctcagtgttcccaaatcttcccttttatctttaaagagaaactggattattaggaggaatttgattcctggcaacgaaatgaaaaaagtaacatagcatggatccaactaaacatgtctgttgattacatttagccagtatgtcagattcagcctgcagactaacaattttcaacttcaaatttcattattaaaacttctggtttagtcaacaagacatgtttgacaatttctaggttcatgaaaaaatggtatctaattgctcaaaaatgtccaacagagggatcatagaagtaaactagaattttaacctattcactcaataagggttggggaggcaacctaaatatacctactgtaagtttattatttctttaaaacctctggttgagccaggcacggtggctcacgcctgtaatcccagcactttgggaggccaaggcaggcagatcacgaatgaggtcaggagttcaagaccagcctggccaagatggtgaaaccccatctctactaaaaagacaaaaattagccaggcgtgggggcaggtgcctgtaatcccagctacttgggaggctgaggcaggagaatcgcttgaacctgggaggcggaggttgcagtgagccaagatcacaccactgcactccagcctgggtgacatagtgagaccctgtctcaaaaaaacaaaaacaaaaacaaaaaacacctctggtttatattaaaaattcatgtattttttgccttccaattcacaacgcatgtgttcttccttttaatatcaagaaaggtgattttcacccccaaaatctctagtaaagactctccaggacaatgtgccacatttattctgtggctttcaaaacctctgcaaaccatgtttaagaagcatagccctagattaaccagagttctttcaagagtaccaccctttcttacatccagcagtccttggacctaaagctttagctccagctatccatcagactgacagcagtcaagggccagaagttggtgtggcattcacaaagagagacatgcttccaaaaattctcaagacacagcctgctggtcttgcttaatctgatcaacaccctgactactctcagaaacaatggccatgatttttcaggccttctctggcctcttgcctttcaaaacaatgtctccgctgaaatgcccagaagaataacgtatcttcctgtcagggttgagactacaaaacttcctccaaaattgcctcatactgcttttatctttaatgctaaagttcactgagaagtagtgggacatcagaataactcagtggtagagcatcacatggaaattgaagctcccctagcagcaccagggcattctcagagacatctcttcagaggatcaacaaaactataaaatatactaaatatttagaagcaagtatgtttctaagcccatatctctaacaaggtagactcaggaccagcatacataaacatttcaaggctacagacacatagggacacacaatattatatattaaaatgtggtagagcctgaaaaactgtgtgcctcacctacattttgttttttaatcttgtttgatttcaaagaggattcttaagtgtatttctcttgtattcttctatctccagacaccagaaatgccctttgtgtggcaatgattaatggctctcaaaagcaaaagaaactgtctactctgaaagctttctgagtctctagatgtagcctattttttctgtgataaatatcaccatatttttatgcacaatattttccccctagaaactgcataatcatgctagctaaacattggtataggattttactttgaaacctttgggatgtttcctccatctgccaagaggcattctgcagataatcatccttcatggtttcaaaccaaaaggaaaaaaagttaaagattaaaactgccagaaaaccatagagttaacttacttccattcacaggcctgagaggaagccacaaaggaatttctgacaattgcaatttttaaatatgccaataaaatgttaacattcgagactcattaagcagatttgtagcattcacttcacatctgatgtgctagggcctcagaaaatagattttcttacccactagcgacagtaaagaagactctggccactgcagtccttaacaaggcaaaataaagcctattctccatgagttatgagatggcataaaaagaagtaaggatctgccctgataacatccagataatggtggcttgggtataatctgctgtgcctccaaatcaggagttaaatgataacagatagttgtggactttaaaccaccaacctcccttgctatacacctccccactccgtacaccagcaagatattataagaggttgtggtggaatgatgaagtgagaattatccctgggaggcaagtttggttcaacatacataaatcaataaatgtgatccatcatattcacagagtgaaggacaaaaaccatacgatcatctcaatagatgcagaaaaagcatgtgacaaaagtcagcatatttttataattaaaactctcaacaaattagatatagaagaaatgttcctcaacacaataaaggctatatatgacaagcctacagctaacattatactcaacactgaaaagtcaaatgctttccatctaagatcaggaagaagacaaagatggctactctaactacttctgtttaacatagtactagaagtcctagccagagtgattaggcaagagaaagaaatacaatgtatccaaataggaaaatatgaattgaaattgtctgtttgctgaggacatgatcttatatagaaaatcctaaagactccacacccaaaacctactagaactgataaaagcagtaaagttgcaggatacaaaaccaacatgcaaaaatcagcagtgtttctatacactaaccacaaactgtctgaaaaaagaaactaagaaaataatcccacctgcaatagcatcaaaaaaaatacataggtgtaaattaaactaaggaaaaaaaagatgtgtatactgaaaactacaaaacacagatgaaagaaatagaaaatgacacaaataaatggaaagatatcccatgttcatggattggaagaattcaatctaatttaatttaataataccaattcaattcaatccaattcaatttaataatatgaattcttccaatccttggattggaagaattcatattattaaattgtctatagtaaccaaagcaatctacaaatttaatgcaatccctatcaaaattctaacgtaattcttcacagaaatcgaaaaaaaatcctaaaattcatatggaaccacaaaagacactgaaaagccaaagcaatcgtgaccaaaaagaacaaagctggaggcatcacactacctgattacaaaatatattccaaagcaataataatcaaaatggcataggactggcataaaaacagacacatcaaccaaaggaataggatagagagctcaaaaataaacccacacgtctacagtcaattaattttcaacaaaggtgccaagaacactaatggggaaaagatggtctcgtcaataaattgtgcttgaaaagccacagataaaatttaaatgtccttcatctcactcttataaaagaatcaactcacaattagttaaagacttaatgtaagacctgaaactataaaactaccagaagaaaacatagggggaaacctacatgacagtggtctgggcaatgatttcttggagatgaccccaaaaacacaggcaatgaaagctaaacaaattagattacatcaaactaaaaaaaatgattaatagagtgaagagacaactcacaaattgagagaaaatattttcaaatcatgtatcagataagaagctaatattcaaaatatataaagaactcaaactacccaataacaagaaaacaaataaccccatttaaaaaatggacaaagaactttaaaagacacttcttagaggaagacatagaaatgatcaacagatgtataaaaaatactcaatatctctaatcatcagagaaatgcaaattaaaaccacagtgacatagcaactcacatctgttagataagctattattaaaaagataaaatataacaagtattgccaaggatgtgaagaaaagggaacttttatacaccgtcggtgatattataaattcatataaacagtatgggggatcttcataatactaaaaataaaattaccatatgatcaagcaatctcattaccaggtatatacccaggggaattgaaatcagtatgttaaaaaaaagtctacattttcatgttcattgaagcattattcgcaagagtcaagatatgaaaacaacctgtgtccatcaacggataaatgcatttttaaaatgtggtatatacacacaatggaacctattcagccttaaaaaacacaacaggaaattctgtcatttatgacaatatagatgaacctagagggcctgcattatattaagtaaaataagtcaggcacagagacaaatatgtgatctcacttatacatgtaatctaaaaaagtcaaatttatagaagtagagagtagaatggtggttaccagatctgggggtggagaagatgggcagggaaaggtgagagcttggtcaacagacacaaagttacaattagatagaagtgataagttctggtgttctattgcacagcaagtcgactacagttaataataatgtatatttcaaagtagctaaaagagagtatttttaatgttctcactgcaaagaactgataactatttgaagtgacagatatgctatttaaccagatttgtttcatagagctatagttctagagtggatccacagaactctgttatcaatttttttcagagaggtagaaaatgtgagttttattaaaatgtgctatttactgtattatttcattctcacactgctataaagaactacctgagactgggtaatttataaaggaaagaggtttaattgactcacagttccacatggctggggaagcctcaggaaacttacaatcatggtggaaggcacctgttcacagagtggcagaagagcgaatgaatgagtgctgagcaaaaggggaagccccgtaaaaaagcatcagatctcatgagaactcactcactaccaagagaacagcaccatgggggtaactgcctccatgactcaattaactcccattgggtccatcccacgatatgtggagattacgggaactacaattcaacatgagattttggtggggatacagccaagtcatatcatttgcataacataatttctggaatattcttgctaatgtcattaaatctatacaaagacctgattctgaaagaccaggaggttgtaagagatatcaataagcatttgtacaaaaagtttaatattagaagatgttttctctggaaagctgtgacaaacaggttagtgccaaaatggccatcaagaaacccttattaacaagaacataagttcctctagactaaccttactgctgtgtatatccctgaaatcccacaatagcagtaatgatagagtccagtcttcctttgccttcatccgctcctcacttagtcagtagtgagggtaaactctcaccttaatttctagccatttgtcaaagctttctttgctgaggtcttgtccattattcaaagcttatcttactaaggtctaaatatgcaaagacttcaactgagattttctaatagtgcttcccatgttctacattgcttagtattatatatggaataattatgattgtggttatttgtgtactccatctctccaactgtaccttaagctctacaagggcagagtcttgcaccagaagcacaggatttgataggtgcttgataaattaatgtagcttacttgatagggtgaaggaaggagtagggaagaagagaagaaagagaaataaggaagggaagaggaaagacagggagaagaagagagaggaaaggagaaagaggcagaagaaaaaatggatagatgaacagaaacttctttttttttttttaatttgagatggaatctcactctgtcacccaggctggagtgtagtagtgcaatctcagctcactgcaacctccacctcccaggttcaaatgattctcctgcctcagcctcctgagtagctgggattacaggtgcctgccaccacatctggctaatttttgtatttttactagagatggggtttccctatgttggccaggctgatctcgaactcctgacctcaagtgatccacctgcctcggcctcccaaagtgctgagattataggcatgagccactgtgcccggccaacacttttaagcataaaaaaaaaaagaaagaaaaaagattatgtttctcctcaaaaagcttctgacctagttgggtagatagaaatatatttttttataacaggaggtccatattagatgaattataaccacacagtctagtacttggcctctaaaaggaatactataggaattcaaatatgaaggtcagcatggctgcagaactcagagaaggttttatgaaatggaggggatttttttttgctggaacatgaagaaagtggtgaaacggataagcaaaaatgaaagaggatggcaagtcctagaatgttccttgatattctatctcccttctcgtatttgtcattagtgattagtggtttctgctttgaatagcacagtaattgcagcttgactttcttaggcatggagaataattttcaccccaatagaaaataaacaccaacatttaatggatacacttactatgtatcaggtcctgtgctaggaacagaacataaatcacataatcagatccttagacaaaccaccatgattacgtcctctctacagataagaaaactgaacagaggccaagaaccttgctccatatcacacaactggaaacagctgatagaagaatcaaccactgatgcttagaaagtttggaagagcagaagcagaccctccaattacctcacacatttttcattttgatgataacacagagtttacttgacagcaaaattttctgtggttaacctaagtttttgtctttacatcctatatctaagttttcagaagtctggatatgagaagatgagagaccatgctggaaattttcatttagcccttgatatggtttttctgtgtccccacccaaatctcatcttgaattgtagctcccattattcccacatgttgtggcagggacctagtggcagataactgcataatgcaggcagtttcccccttactgttctcctggaggtaaataagtcttacaagatctgatggttttataaggagtttccccttatgcttgactctcattctctcgtctgccaccatgtaagatgtgcctttcaccttctgccatgattgtgaggcctccccagtcatgtggaattgtgagtccattagacctctttttctgtataaattaccctgtctcaggtatatctttaccagcagcatgaaaacagactaatacagcccttcagatccactccccactcttcatcctgctccgtgccccaacaggtgatctgtggagcctgcagcagtgcatctgctctttagcttcccagagaggttatccagcagaatgcacccacaggcaatcaggaaggagagagagaggtcagggtccgtattctccggatacccaccctgctgggccacctcaggttggtgtcctgtactaaaggtggaggatctagaggatcctagtaaatctcgatttctctctctctctctctctctctctttctgtctctcctcccagcccctaccaattcccctgttctccaatgtaataatttttttcctttaacctttccaggcctaaaaatttgcctaccatcagcctctttcaccctttgcttctttttctatgctcaaacatgtatagagtccttttacaccataaaatgcagcaataccacttctggtatacattcaaagggattgaaatcagtatgttgaagagatacctacattcccatgttcatttcagcattactcacaattgccaagatatggaataaacctacgtgtctatcaacgaatgcataaagaaagaaaatgtggtatacatacacaatggaatattattaagcttttgtttttaaaagagaaggaaatcctgtcatttgctgcaacatggatgaacctggaggacatgataagtgaaataagccaaggacagaaaggcaaatactgcatgatctcacttacatgtggaatctaaaacagtcgaactcatagaagcagagcacagaatgctggtttccagggtctgggagggtagaatgagaaaaggggagatgtctgtcaaatgcacagagttttagttaaacaaaaggaataagattttgagatctctcgcataggctggtgattatagttaataacaatgtgtatttttaaaaagagtctccttaaattttcctcaattacaaaacttaagttttctgcagtgagcctgactaacacaggtgataagtttgtgaattagaatagtgatatttaaaataaaaggaaaggtccagatctgaggtacattttggaagaaggaacatcattgaatgaaatactgaaaagaggtaagaaaagcagaataatatcaaaaatcatcaaagatttttgggtccaggtaatctggaaaatgataatactgacagaaataggaatattattaatggaaacttaggagttcttcctgtgaatatctgtctcttcatttgaatgtctgtttggggaactaaaatttttttgttaaaaagaaataagacaagacgataaaattaaagtctacactgctcctactagtcccctttaccagagaaatctatatcataaattgaatatgcattcttacaaactatttttatatgttatttacataaatgtgtatcctggtccaaggacattattattctaacaatacaattataaaatgatatgtggtttatttaataaactacaaatcacgatttccataatttggcaacttaaaatttttactcaaaattatgttttgaagatctatccatgttggcatatacacctctacttcattttttttttaacagttatgcaataattggtcaaaattgctttatctgtttgctttatctgttcctctaccaacaaacttttcactataataaacaatacttcagtgaacctccttctctaagtcaccttaggagaatttctgtagggttcccgtggcattgctgggccataaaaaacaaaatgagtttagaaacttttatttttgaggtttaggctatgtgatcgggcatcaaaatggaattttaacagtagtcattagtaaacattggcctaaagaaaagataaaatgaagataaagatatccgtttgtagtgatatttctacttcttttttcagctaggggatgaaaatagcactgttcaccaggccataaaccaggcaccttgcaatcattatctcatttagttttcacatatacccttcaagagataactgacattcactaatgcctcattgtaggtaatagtttccatctccactataactcccttttcttttaatcagaacaatataacagataggaaattccaactgtttgaagtgtatccttttttaaaatcatcttttccaacgtaaacaaagagtaaagtcactaataaagaaataacgagaaacttgaaggcaacaggaaaagtagaagccgaataatccacaaagtagtcaaaccctggagaaatcaggaactgactctacttgaatccttaaaattaatttgtcctcccaatgagggtttgctggtttgaggcaaaaagatctattcttcaattaactgaagatgtcaaacttgcattagaaaccctcgataactcctgacagtgaaacaaattaggatttaccctagataaacataggccacatttattagaatcctcataataaagctataccatcaggtaaaataaactatatttttccagaacatgatggttttaagacaaaggcaaaacataaaagagaaaaaaaattcagatatttctccaacccgttcagaaaggctgtacctagagggctttgagggtttccttttgtttcctgttgtgttacctcttcaacttcattctaccatcagctactgagatcaatagcccaaggttgggcatggaggagcttcacggacaagcagcagaagctagtgtctctggtgtcactaaactctaagttgagaattgttcttggttttcagataaacagtaaactgtccaggagctaagatttgccaaattttctttctctgatgcccatactgaataaatgggaagataattttccttaggagagctgtgcacagagttaaccttaggaatacaggcagtaataataaaacaataactaatgttttgcagtagtgtgctgttttatttactattcacaacaccctagagaggcagctatcactgaggctcactcacacagctgcctaaggatacaaaatgggcaaatgacaaagttgagactgatatccatggtttctgactcatcattctcctatcagtactatcctgcctagcttttagtaggtgtttatttgatatttgtgaataaaggactctcttcgttgtaatcccacctgtctcctacccacctatctgaattgcctgacattcaatgatcagccattcagccctctagtggaagaaattattccctattaaagcgcaaatatcagggcctagtgtggcaactcatgtcggtaatagcagcactttggaaggccaaggctgaaggatcacttgagaccaggagtttgaggctgcaatgagctatgaaggcatcactgcactccagcctaaaataaataaatgaattaagtgcaaatataaagagctatacttttttaaaaataatgtttgacctagtaattccattcttaggaataattcaaccaaagcaaactactaaatacatgagctgtttggtgtggtattttctgtgataagtaaaagaaaagaaagaaagagataaggaggtcaggaaagagatggaaactagaaaaaacaatttctggaaataacccaaatgcccaacaataggggaataaactatagtatatcgaaggctagaacagtgtttttcaaactgtaggttgctattcataaagagagatgattctggtatgttgtgtttttgttctcattagtttcaaagaacatctttatttctgccttcatttcgttatgtacccagtagtcattcaggagcaggttgttcagtttccatgtagttgagcagttttgagtgagtttcttaatcctgagttctagtttgactgagctgtggtctgagagaaagtttgtaatttctgttcttttacatttgctgaggagtgctttacttccaactaagtggtcaattttggaataagcgcagtgtggtgctgagaagaatgtatattctgttgatttggggtggagagttctgtatatgtctattaggtccgcttggtgcagagctgagttcaattcctggatatccttgttaactttctgtcttgttgatctgtctaatgttgacagtggggtgttaaagtctcccattactatggtgtgggagtctaagtctctttctaggtctctaaggacttgctatatgaatctgggtgctcccatattgggtgcatatatatttaggatagttagctcttcttgttgaattgatccctttaccattatgtaatggccttctttgtctcttttgatctttgttggtttaaagtctgttttatcagagactaggattgcaacccctgccttttttctgttttccatttgcttggtagatcttcctccatccctttattttgagcctatgtgtgtccctgcacgtgagatgggtttcctgaatacagcacactgatgggtcttgactctttatccaatttgccagtctgtgtcttttaattggagcatttagcccatttacatttaaggttaatattgttatgtgtgaatttgatcctgtcattatgatgttagctggtgattttgctcattagttgatgcagtttcttcctagcctccatggtctttacaatttggcatgtttttgcagtggccgataccagttgttccttttcatgtttagtgcttccttcaggagctcttttagggcaggcctggtggtgacaaaatctctcagcatttgcttgtctgtaaaggattttatttctccttcacttatgaagcttagtttggctggatatgaaattctgtgttgaaaattcttttctttaagaatgttgaatattggcccccactctcttctggcttgtagagtttctgcagagagatccgctgtaagtctgatgggcttccctttgtgggtaacccgacctttctctctggctgccctgaacattttttccttcatttcaactttggtgaatctgacaattatgtgtcttggagttgctcttctcgaggagtatctttgtggcgttctctgtatttcctgaatttgaatgttggtctgccttgctagattggggaagttctcctggataataacctgcagagtgttttccaacttggttccattcttcccatcattttcaggtacaccaatcagacgtagatttggtcttttcacatagtcccatatttcttggaggctttgttcatttctttttattcttttttctctaaacttcccttctcacttcatttcattcatttgatcttccatcactgataccctttcttccagttgatcgcatcggctcctgaggcttgtgcatttgtcacgtagttcttgtgccatggttttcagctccatcaggtcatttaaggacttctctgcattggttattctagttcgccattcatctaatcttttttcaaagcttttaacttctttgccatgggttcaaacttcctcctttagctcggagtagtttgattgtctgaagccttcttctctcaactcgtcaaagtcattctccgtccagctttggtccgttgctggtgaggagctgcgttcctttggaggaggagaggcgctctgatttttagagtttccagtttttctgctctgttttttccccatctttgtggttttatctacctttggtctttgatgatggtgacgtacagatgggtttttggtgtggatgtcctttctgtttgttagttttccttctgacagtcaggaccctcagctgcaggttgctggagtttgctggaggtccactccagaccctgtttgcctgggtatcagcagcggaggctgcagaacagcggatattggtgaacagcagatgttgctgcctgatcgttcctctggaagttttgtctcagaggagtacccagacatgtgaggtatcagtctgccactactgggggatgcctcctagttaggctacttgggggtcagggacccacttgaggaggcagtgggactgtaaactagttcaaccattgtggaagacagtgcggcaattcctcagggatctagaactagaaataccatttgacccagccatcccattactgggtatatacccaaaggattataaatcatgctgctataaagacacatgcacacgtatgtttatagtggcactgttcacaataacaaagacttggaaccaacccaaatgtccaacagtgatagactggattaagaaaatgtggcacatatacaccatggaatactatgcagccataaaaaaggatgagttcatgtcctttgtagggacagggatgaagctggaaaccatcattctcagcaatctatcgcaaggacaaaaaaccaaacaccgcatgttctcactcataggtgggaattgaacaatgagaacacttggacacaggaaggggaacgtcacacactggggcctgttgtggggtggggggaggggggagggatagcactaggagatatacctaatgttaaatgacgagttgatgggtgcagcacaccaacatggcacatgtatacatatgtaactaacctgcatgttgtgcacatgtaccctataacttaaagtataataataaaaaaagaaacttacaatcatagcaaaaaaaaaaagggagagattaaaatatttcagttgatcaaagtcagcattttttttaatgaaatgattaagaaagaaaatacacccctccctcaggatattcgcagattggttccaggacccctacatgtaacaaaattcacacatactcaagtcccacagttggcctagtggaacttgggtataggaaaatttggccctccatatactgagtttcacttcccgccaatactgtattttcattttcaatccatgattggttgaaaaaggtccacatggaagtggacctgtgcaattcaaacccatgttgttcaagggtaaactgtagtataaaacagaataaaatgaaatagaaaatatcagactacatcattccttgtgagggtaagaattatctcataaaacctttatttctcggccgggcgcagtgactcacgcctgtaatgccagcactttgggaggccaaggcgggtggatcacgaggtcaagagatagagaacatcctggccaacatggtgaaaccccgtctctactaaaaatacaaaaattagctgagggtagtggtgcgcacctgcctctacctgcctctagtagttagtcccagttactccggaggctgaggcaagacaatcgattgaacccagggggcagaggttgcagtgagccgagattgtgccattgcactgcagcctggcgacagagctagacaccgtctaaaaaaaacccaaaaaaacctttattgctctgtaaatatgaatgtgtttacgtgtatgtataccaagtacaacgtaaaaggtgttttagtatggaaaatggcaaaaaaaatttgaagtgcactggcctaggttattattcattcattagaatttacttgagagaaattctggaggaaatttataataatgttaaagaaaaagttggtcacaaagtggtgtagatattaggatggcaattatagaaaatatgaatgtgtatacataaatgacaggaaaggcatgagaaaacagtcattgttctaagaagatatatgtgattattacccctcattttgtttttttatttctaatctgagacaaaaagatctacaattaactctagtgcagactagccttaaactctgttgtaaattccaataaataaagcaaatcagaatgcacttcaagcaagcaaagaaccaatctactgaggatacttataaatgaaactagtacaccagatacataaaatatgcctggtggatggaacaaaacatttctaagcccaagagcatgtttctttctttatacacatgccaatgctgagagggatagccaactaaatcatctcttgttcatttataccttagcattacttagtgtacctggtcccttccaataaaagagttagcttgtgccaagaatagataaaattgctaatggtgagaagaaattgtaaaaagaggcaatagaagatgctaagttgtttctcttcagcatcttctagtatctctttttaattcataatttgcttaaaattggctgtttcatagaaaagtatcttgtgaccatcataaagatgaatgagacccatatcaagttaaagtacttcatgaagccactttagctagtctggagttactctgggtaagaagctagacttgggggctggatgaggaaagaaaggggcaagggaaatggttaatgaggctataatcagcataagtggaaacagctggagaaagcaaacagcaaacttgagatttcttcttatcccctccaccccactatccaacagagtgagaacaagctgtgctttcagacactaaaagctgtagatgcttaccaacaaactcaaataattgcaagccctcatggtgctagctagcccacagaatctgaattgatcttgtttgtcaatcaaatactgaatgccagtctgcataaatagttacaatttctaaagtatgtggcaggatgaggtgttctgatcccatacgcacttatttcctggtcctcatcactcattgagaaaatacatttggtaaagctgatttaaaatgagatttaaaaataattgtaaatattttacacatttatgggatacatgtgatattttgttgcatgcatagaatgtgtaataatcaagccaaggtacctggggtatccatcacctagaatatttatcatttctatgtgttgggaacgtttcaagatctctcttctagctactttgaaatatatattacaacctgggcatagtagctcatacctgtaatctcaatactttgggaggccaaggcaggaggattgcttgaggccaggagttcaaccatcctgggcaatatagcaagaccttgtctctataaaataaaaataaaaattagccaggcatggtggcttgcacctgtagtcccagctatgtggggggctgaggcaggaggattccctgagccaggaggttacagtagcagtgaaccatgatggtgtcactgctctccagcctgggtcacagtgagaccctgtcaccgccccccacccccaaaaaagaaagaaatatatatcatattattgctaactatagtcaccctactctgctatcaaacattagaactaaaagagaggacttttaaactagtaatgctaaaagaggtggtcaatactaagagaaaatactaaaggtttttttggaagatatgccactcttaacaacaggaaaaaactcagtctctcttcatgtggcacaattacgatgtaccaccactcccagatcaggatcaggaaaaaaggtcatcatgaccttaatgtggggtaggcagataggaacaattactgaaagttaatccacagatccggatgcctcctcaaaaggtagaataatatacaaagtgcatttgtcttctctaaatttcctttagatagtggtaatatgaacattaacaacatatcctatatagaagagagcaaacagaaaggtcatcacttctctacaagctgattttaaaagatgctgattggacgtttctgagatcccacttcatctgtagattcttggtggaaatttcatcagctaatttcttgggtagaaggtgggagatgtcccacacttaaattgaggaaccaaatacctaaaatcaagattgagctctctttcctgttacaccactgaactttctgatccaggacagatgttacccatgaataaagagaaaattacaatggggaaggacatgaagtttttgagtaaggtaccatgcagagtttgctatggcagaatcaaagcttttatattctctatcacacccctatgtcatctacagttacaaacccctgggacaaaagaaaaaggaaatgagtctagactaccatgtgatgaaagtacctctaaattctagtgtaattccccacatttaaggcaagctgctagaaaaatacagcttcatcaaaggttaagtgtaactgttcatatgatttttagaatccttaatatgctgcccttattgactaagttactatcactagttaatgtaaactattatttgcattttataatacattacattttgtaagtactttaagtggccaacataaaaattaatgagacccgtatcaggttaaaccactttgtaaagctacttcagctgatctggagttactttgggtaaggagaggctaaactggaggtgatgggacactggggagtatgtttagcttcttccctaacattacataacagagaagtatttaagaaatcattaaacataatttgtccatgtgcattagacacacccatttacacacaagttcagttcacaaatgagaacatcaactgccttttaaaaatattttcaacttatttaaaatatgtagcctttatttctgagggaaaatatctagtccttgtgatatgggaagaaggcagggaagcactgggtggagaaacgcagggtccccggctagggctcttcccttctggcctgtgcccacggaactaggtgaggacaggcactcctgcttttgcccccaaatgttgcatttttccaagaccaccctggcccaccacacccgccactctgtgcctatgaaaaccccaagaccctcgcgggcacaaatgcagacagctggacctcgagaggagcagaggagcggaagaggtcaccgacaggcaccagtggactctggcaggccatcaacagcaggacgacatggaattcggctgggggcagccagtctccaggggaagatcaccttcccactccatctcccttctgtcctccccatttacctcgctgagagctacttctactcaacgaaactctgcactcattctccaagcccgcgtgtgatccgattttcctggtacaccaaggcaagaaccccaggatacagaaagccctctgcccttgcaataaggcagagggcctaattgagctgattaacacaagcagcctgaggatggctaaactgaaagagtgccctgtaacacacacccactggggcttcgggagctgtagacaatcaaccgtagatgctgccttggggtcagagcccaaaaacgctcctcacgacctgccagtatgatgcatgttcctccgacgggtttgggcgagccacacccgcatcgcaccctctgcgagggggataagggaactttccccatttacctggactagctgagcagactgattatttatttccttgctaatttttcatctttttaacgaattatattctttgcatgtttgagtccaatttctgaatgaaatggtcttatgttttattctcaatattttgatgctgaaactttctagatacgaaacgatatttaaaaaaacataaaaaatctattttgtaaacgactaaattggggcagatctgccatttgggctggcagattttctactgtagagctctatcagtgaaaacagttctggtgtttaaacattggactctggaaacaaaaaaatcaggcatttgattgaacacaaataaatgaaagttattgatatttttcatgaccccgtaatttgcagagctttacacttttcaacatgtctccaaacccattatatgattatgtcacttgattcccacatatgtttatgaggtagatcaggccacagttaacatcatccccaatgtatatgaggatcctgagacacaaagaggttgtgtgacctatacaatgtcacacagaaagttaacgtagaagagggatcaacccaggtctcctggttgctaatttgttttctaccacgtcacttcactacccaacatcaagggccacatctctttagtgtgttcaagaaacgcaagtaagaacaatgattattattccccgggttctcctctctttattgcgcagaataagcaatttccagctactaacatacatagttgctttcctgcaaagttttcccatagaaaccctaaattttcaaaagagttatttattgctagatggaggtgtgaagaagcttttggttttatcttcccatatcccagtttgatctattaaattttgaactcagcgcctctttaaaggtgtttaaaattcagtgctcaaatcccaaatttctcaagggtcagcaagtcaaattcatttacactttatccctgagtttctttcctttttatcctttcttttatatgaaaagcaataaaccagtgacccatgcttttcactcagagactctttggtctgtactttaatcacttcttatctggtatcttcagtatagggtatcgtgctgaaaataagtactaaacaactatttacttctcactggacaattccagcaatttctatcaggtcacttcaatacttactgagattggcagttatcaaatcatgagtccaaatctgtcaccacttggaagataaataaggtcagggatgtgggattgcaaaaaacaaaggaaatctatttgagactttgcataaaacaaagtttgcaaacagctaatgaatgctaggtgaacaaaacaaagctctacttatagttatacatggaaaaatctacagtcattaaagacaatggcatagatctatgtttactgacacaagatattcataatattttatagaagtgtagataatgtgactgcatcttaaattttatccatgcatagaagaaaatctggaaactaattttctctaagcaggggaattatggcttttttatatttttaaatttttgtttatactttctagtttttctctaatgagtttatctttcttactttataagtaaagcctctctgtggaaatgtaactaaagcaaaggttaatagggccatggacctccctttccatctttcaaatgagttacagaatacaacaagtgtaaaggaaaaaaaaatctcatgggacaaaatgacaaattattcctgggaaagaatttaaactatgatacatgctaattaatactcaagaaatcaggtaaacagggacttaagggcagcttcttccttatcttttctggaacttgttttcttagttctcttcctttttcggaggggaagaaaataggtggcttcgtaagacagaggcctgggcttagagtcagaaggccttgatgaccttattagcctctcctcttaattgggtaggattcaccacctctctgagttttgatttctttatcaagaatgaggacaataatacctaattcaggtaagaattccctgagaaaatatttgtgaaaatttggagcacggcattagaaatcaaaaaatgtaacttaaacatgaatctctcccctgatttctcatgctggttttctgctctgtctgaaataaaaacagatacattaagtactcaggttcttggatctcatttccattggctacatggttctaattggtattcaagttgagacggcatgacagctaggcctttctaatcatcctattatgccaaagaagacatggttcccaccaagagcctgtgactattccaaacttttttaaacatccaaaacaaggcatgaataggtgtctttgaagcaggattctcagcttgaacctaagctgtgtccacccttaacattcatggtcaggacatatcagggcggatctggcagataatagggtagggtaaatgagaattcatttgcataagtaaataggaccctcctctccccacaagacataggaatgttctcctgagttctctttgtactcttgaccatcatcgcctctagctttgcctctctttatttacagagagaagagaagatattgcatgcttgaaaaaaggaacaggatacatgaaaaagaaacagagaacaaaaaagagtcatgaagatgtaagtgtcattatccacatttaaaatgccataaaagaggttaatgattcagtcaaggaaactccaaaatatagagccaaaaaaaaatcaaagaaatggaaataaaagagaaaaaaataagaaaatcagagaatgaatccaggaagtctaacattagttccagagagagggactgctagttttcctgaagaaccttttagtaccatttaaatattttaaatgtgtacctatattgctttaataaaacaaagtagttttcaagtactatttatacttattgtatccactttgtcacttctaattcactcattaaacacaccatagtaactacacttattgaagtcaacattgatcttctaaatgccaaatctagtgggcagtttccaatactcatgctacttgagaagtatgtaacatttgtcatgtgaccactccccaaccctcccttaatttctagaatgtcactcttctttagttctctttctccaagagctcaacatcaccactgctgtttttgcttctacattacataaaacttttatgtcccatctttacttattcttttactctacacacttgctggatagccttactcctaagttttgatttccaatctgtaagtcaataattgccaaatctgtatcccttgagcttgacttccagctgtctatatctttatttgatgtcctacaaacacctcaaacagcatatacaacattgatttcattatttacctattttcctccactccccaaacccaaatccacctaatctgctacatttttcattccagctaatggcctgaccaagctaacaaccataaggtcactctcaactccttcctcaaccttcagattagaaagagctaaaagtccggactgctctctccgcctacattgtcactaccttatcttaggcttatcatttatcttcagatgctattctcttcctatccagtccatcctctgcattactgcctgttatattccttatagccacatctgctcctgcttaaaagctttcaacagctcattatcaggataattttctttgcctgtcattggaggcctttgcagtttgactatgacccatgttccagacaatgtgccttaatatacacagaacctgtgccccagacacactggattcttcactggtcctgaatgcctcaggctccttcatcaccccacctggtccaactgcctggaattccccaccttgatttcttcaactggaaaacttactaattcttcaaggccttactgaaatgtcacattgtctatgaagccatgcagggaaaattcttcttcagtgttcccaatatcctgatatcctgtgttgttatctcctgcagcattgtgagtcaggctttggatctctagcaagaggccacacacacatacacaaacacacacacacacacacacacaaaccaccaagttctcatgtatttagcttgtagtaagtacaaaacttaacagaagtagctgcacagagtacaggcacatgcaggaagttttccttggtccttggttccccacagtttgtgcagctgccactgacactgtccatttaggtagggtacagccatgtttgagaaaaaagttgcaatattgttacactatcactcctttatacttgaacttacagcatcatccacctatgagcttcctttttaggaaatgttaacaaacagcagaccctcctgattcttaatttagcccctgtgcagacatatcctcacagaggagagaaagctgagccaggcacaatgttcctaaatagtgtctctgcctgcagacttccagtctcaggaagtccatcttcccacacctctactattaaagttgccaattttgtattataatttatttatgtctctgtctttaccactgaactgtgagctttctgaaaccaaaagccatatattattcatattcgtatgctcagtgacaagcccagcatttggtacctagtaggacacacaataaattttgttagatgagccaacctaaaacacctttcaaaatctggttttctgaaagcttgttagatctcacaatctatttgtaatcctgagtttctataacttggtgaaggatacacactttacaaaaagatatttcaaagaagtaatcttgggcagctaaaattacaggttatttgtgatggtcttgtacaactctgacctaaaataccatcttctttgtctacctgttgggaaaataatcatgatactgcctggcctcctggagtcacaattacacctatgggaaattcaaggccaaacagctggcctaagaaggaaagggtccctctctcaccacagatatcagatagagattgtctggaggaggggatttccaggatgctaccaggaagaggtttgggcaaagtgacttacgaggtcactctagctgggctggctggactgctggttctatactctacccctccttcaacaagacccccaacttgaggtgtcaggaaaacacacagttttgtattaaatgcacctgaagtctcattttggttccacaatttactaactgtatgaccatggcaaactgccaaaatcccatgaatttctattttctcattggtaagatgcaggataattgtgagggcatgagtatttcacatacctaacctagtatcaagtttgtgctaggtaaataatagctgataacagataggaaataactgaactagaagaagaacttactttaccggatggaaaaacactggaccagacttcagaccagggtaataaacagcaacaacgctgtgaccctgggctaatcacataatctttcaaggatatagcttcctcaactgtaaattcaggaaatttgacttgacaatttttttcccagccattattaacattctagatttcacacatctagctttatatccccagtttcaaaaagaacataatttttaacaataaaacaactgagtccaaaatgattaaatgacctctccaaggtcaaataactaataaattatagaagatgggagctaagatatattatctttactatgtactaggttccacgcattattcttggatctcacttcatcttcttgtaatgggtattatagtctctttgttttatgtttttagcaaggctaccaatcctttaaacatgatagttgtgttctttatgattagtacaactggtgatgtccacttaaggtagaccttctttttttctgccaagaaccaccattgaggctccttgtagcctgtagacataatttgaaaagtaaacacatgctcaaaaagttaaacatatagttaccattatgacctagcaatttcattcctaggtatatacccaaaagaagtgaaaataaggattcaaataagtgcctatatatgcatgttcatagcagcagcactatttttttatttaacttttaagttcaggggtacatgtgcaggttttctatataggtaaactactgtcatgagggttatgtacagattatttcatcaccccagtattaagcctaatgcccattagttatttttcctgatcctctccttcctcccatcctccccgctctgataggccccagtgtgttgttcccttctatgtgtccatgtgttctcatcattcagctcccatttataagtgagaacatgtggtatttgttttctgttcctgtgttaatttgttaaaaataatggcctccagctccatccatgttcctgtaaaggacatgatcgcgttctttttttatggctgcatggtattctatgatgtgtatgtaccacattttctttatatagtctgacactgatggacatttaggttgattccatgtctttgctatggtgaatacagcagcagcactattcacaataagcaaaaggtagaaacaactgaaaagtccatcaacagataaataaacaattatggtgtatccgtataacagaatattatttcagcattctattaagtgaaagaagccatatacaaaggtcacatattatatgatttcatttctatgaaatattcggaataggtaaatccatacaaacacaaagcagattggtggtggctagggttcagggagaaggtatgtgggaaataggaagtaagtatttaatggtatagaattttatttggggatcatgaaaatgttttgggaccagatagaggcagtggttttacaacagtgtgaatgtactaaatgccactaatttgttgactttaaaatggttaattttatgttatgtgaatttcacctcaatgaaaaaaactcatgtccactgatatgagaaaactggacatagggatgaaggaaaaggagcattaagaatccaaagtcctcatggcagacatgggatcaagatctcaacccattctgtccaaagtttaaagtaactaaaatctgttgagaaggacttaagtggctgtgatgtggttaactagtaggagagaagccaaaaggttgaaagggaaaactgccttcaaagcagaggagtgtattggaactgttgcccaggctcagcagcaggatctggtttgctgctggaggaagcagtccacagggcactgtgtggctgacgttgcaacacctcggcatcaaccacccaggcactgggggacagtggatatgtgcccattcaacaacaaatccattcactctacacataggtattcagcatttccttagtaccaggcatcgttctatactttaggtaagacagaagtggcctttgttttcatgcaacttacgaaacattgagtaaagtacacaaaagagaagaaaagaaaaaagataaattcagataattgatcacagctatgaagaaaagaaggcaatgcaatcttgtatagacgtgattagaggggatgagagatgcaatggtcaaggaagcatctttgaaggagtaatatgttagttgagaactaaatcttcagcatgaggaccggtgtgtgggagtgataccacagcacagcagaagctagtttactaatacagacactttatctcacaattcctaactctatacagagctaagttccatattctgcacacagtgaacacttaacaaatattgatggaggtcagaatgagagggagtgtctagatggcatccacatgtttgtttagtttggttttgctttgcttttgttccacttttgtccataggaagcaagacatttgccctaaaacattgtttcttctactcaaatataactgctaacaaggctcagtatgaaacacatgtattgtacttgttctattgatcaagtggtcagaaagagtttagtcattttcaaacttccttgaaaagcagaactaggaaagtagcacagtagagagaaaagacccctgacctaggaattatgagaccattgttctggtcccaattttcttctaacattccatacaatcataggaaagtcatttcaactatttgcaccttgattttctctaaataatgggaaaaatgaactacataatatctctgaggtcttgttcttgtatatgatatatatgggggcagaggagagtagggctcagagagaaaggtttagctagggcgtcacagacattgatcagacatggggactcgacaatggctgatccgtgtgagtgtttatgtctctgggacatatttgctcttcctgtctttgcattcatgttggcacttttcagattcagctccttttctaaaagctctccctccctctctttacttacgagaatgattgagacccctgttgataaataaaacaagaggttgtgaataaagcaataacacttgaaagctacatcaatttctttttgtctttttctttccaaaaaataaaaatctcatttataagcaaattagctttacacgccacctccctgcacttggggagacagaataaacagatttttctttaaaatggcatcaagacagtacaattctactctgaagaaaatgataaaagcatgcaaatgcccattcaattcaatggtaggaggaggaatttttctatatcttggaaagtaggagaagataatgaggtcagtttggtacaagtaatgtttatgaaacacaatgttattctccttcctataaatacagactgcagatcttattagtcagacttcgtttcctccctttgcaaatgtaaaattttaattgttctaatcccttccctgttgatttcttgctacaattttacacagcagcagatcacctctttattttctcagaaatacattagcacagtgccatagtcctaaatcatatatattttaattgaatgaaggaaaaaaaaaaagaggaaatcaactctgaaattcagggccctaaaaatagtcttctccaaaaggacacacatttactatttggaagctaatgttaattatctttggctttcatgaccaagaaacaaaaatcttgaggttctgtttttagcaatacctacctacaaagaatcaatgtattgatttgagaatactacctatctgtatctaatatcaaaaaaaaaaactcaggaaaaatttttactgcttgaccactgaaagtcaatatctaatatacacttatatactcatgaagggtcattttctataatgtggtacatataaaaaatgcactgactggaattcaaagaactgtcatttcagcccctattcatctgatagctatgtgattccaatcaaatcatttaattgccttaggcctaatctttcccactgaaaacagttgtaaaatagtagaagaatatcttagtaaagcagttttatgtttctacaaaataaaatgttaaatacttcttaataaaaaaactttgtgttttattaaaaatttgtagatagcataaagctgtgctgtacaatacaatagccactagccacatgtggatatttaaatttaaaataattaaaaataaaataaaataaatgcctcagttgtactagccacatttcaagtgctcaaataactacatgttaccggttattactgtaccggacagcacagatatagaacatttctgtaatcataggaagatttatttaatggcactggtatgaagtgacagaaaaagcactatgctttattatctttacaaagcactaaaataaatgtttcagtcattcaactgaatattccaatagacatcaatctatacattaacacccatgggtacagttattcaactagttacaatctatctgctttttaccattaactcacaaactttctccttcttatttatgagaatgtcatgagaaatattatcacattgcttgctgaaatccaagtgcccactgtctgttgtaacagacatctgtaactctgtcaaaagaaatacagaagagaaagttcttctgtcataatcaattattatttgtttatttttagagacaggatcttactctgccacccaggctagagtgcggtggcatgctcacggctcactgcggccttgacttcctgggctcaagcaatcctcctgtctcagcaccctctgggtagcagggactacaggtgtgcatgaccacatgtggctagtttttgtatttttcattgagatagactcttgctttgttggccaggctggtctcaaacttctgggctcaagtgatcctcccacactggccttccaaagtggtgggattataggcatgagccaccatgcccaaccatcacttattattaagcccatgctagtgcctcgtgccattttcctaagcatgcacaaactatccctagaactgcatcccacctgtcagtgccatgctgatcattctcctttcaaataaaaaaaaatcagaattatatatagatgcttcttttctgttttgtgtctcttgtgtcccaggactcctgaaagatcactaacaatagtctagccaattctttgtacccataaatataatttgtgcatcctagataatttttaactcagttaaaagtaggactgtatatgtcagctcttttttcttcatgcttgttctacttattcaagtttaaaaataatatttcttgacagctttatttcttctatgttaatttagcttttcctctttcttctgttagtgatacatcattaggacttccttccttactcttctttctctaaacacaactatacatagaattttgttcatcttgtctttaaaactttttttgcagattttagtacatcttagcctctagaccatctactagactcactacattcatccttagttaataagatttgtttgttaagacctttgattgttagaagcagaagttcccttgagctaacttcagcaacaggagtctaagaaagtaaggatatgcccccaaaacaagggtatgaatacaaccacttttcaggaagaactaaaactggcagtggaaggggtgtcagatttcaaagagggcaaaagtcttactggttgataaacctataatataaggaaagtaaaaaacaagacagttaaattgaaaagatatttgaattcataatcatgaaaagaaataatttttcagtcctgtcactatcaagagtaactcaatgaaagcggcagtagtcttacctactttcaatctaatgtgtactcaaacttaaatctctaatattcttccctgaggtaagtcactgatacttaaaagagggtaaatgattccacatcgtgaagaagaacaaaattacaatagggttagaaatctactgtgaccaaaaagtaaagattgcttccaaggattccagaggacaaaggagcccatttaagaggtctctcactgaccaggttgtgtctatttaagcaaataataactaattgaaacaagttggatgtataaaaggctatgagcccacagtgatgttcaaacaataaaattaccgtaaagctacaaaaatgtagtgataccaacctagagagctgaaatggctaaaaaccaaacccaggatttcatcctgaaagtggttggttacaaagcaaattgtattcccaacctcacagggtgttgtggtggttaatattgggtgtcaacttgatcggaatgaagaatacaaagtattgatcctgggtgtgtctgtgagggtgttgccaaaggagattaacatttgagtcagtgggttgagaaaggcagacccacccttaatttgggcaggcacaatctaattagctgccagtaaggctagaatataagcaggcagaaaaatgtgaaaagagagactagcttagcctcccagcctgcatctttctcttgtgctggatgcttcctgctctcaaatatcggactccaagttcttcagttttggcgcttggactgcctctccttgctcctcagcctgcagacagcctattgtgggaccttgtgattgtgtgagttaatacttaataaacccccctttgtataaatattatatatattccattagttctgttcccctagcaaaccctgactaacacagactttggtaccaggagtatttctagacgaacagaatataaaggatggagttctttcattggttttggggtttctggagttggctgcttaatatgattagacccaaaaatgggaaggactttacttctaacagtatggagaacagtgatagtccttggcatgaactgtttagagacttacacaaaataaatgcatttgacactcctgattcatcgctcatgaaaggcaaggagtttagtgactctatacataatacctttgaccatacgtggagaaccgaggaacataatgaagcaggttagttgctcctaagttcagtggacaaagtgatgaaagaaaatgatgaactcagggattctatctcctggcttcagaagcagatactgagcttcaaatctgctaagattgccctgagtaagattcttatctcctgtagaaaaagctaaagttgtggaaaaacagacaggagctcttatcatgcgagtgactgacctgcaacaaaagttgcacgcacagcctcaccaggtgtctactgttaaagtgagggcattgattggaaaaatattgggccctgaaacttggaatggggatgtgtaggaggaccctgatgaagcaggggacaccgagtttgtaaactctgataaacttttcttgccagaagaaacagcttccctatccccagtagtggcaacatcccctaaccaatccatgctgccatcagcctttccacctttgtctgaggagatcaaccctgcattgcctggggcaacagtgttggcctcccctgaggcagctgccaggcaagataatgtacattctcctcaggagccatccacaacagccctgtttgcttctagacctatcactaaagtaccgacaggcacttagaagttaggttcagagcgtgacccatgaaaaggtgtgctacactcaaaaagaactgcttgagtttatataaattagagtttatataaattagaaattagaaataatttatataaacagaaatctggagaacgggcatgggaatggatagtaagggtgtgggataatggtggaaggaacatagagttggatcaggctgaatgtattaatttgggcccactaagtagggactctgcatttaatgttccagctcaggcagttaaaaaaggttctaatagtttatttgcttggttagctgaaatatggattgaaagatgacctactgtgagtgaattgggaatgcctgatctcccttggtttaatgtaaaggaaaggatccaaaggcttaggcagattgggatggtggagtggattagtcactttagacctactcatcccagctgggaggatacagaagataaaccctcgaccaatgccttgcaaaacagattcgtgagggcagcacttgcatctttgaagagccctgtaattgcccttctctgcatgtcatatctaacggtgggaatgacagtcactcaactacaaaatttaaatacaatgggaagaattggatcccaaggtggcaggggccaaatggtagcactcaactgtcaaaggcatagtgggtgtacctactgtaatggacagcagaggcaaagcagcaatcagaataatctgactaatgtagagttctggcattggctaatcaatcatggcattcctagaagtgaaattggtaagaagcctactgcattcctacttaatttatataagcagaaaacttctagatcaaatggaaaaaaagactaatttgaattataaaagcagtgaatcatggcccctcaatcaattttcagacttgagccagtttacaaacccagaaccccttgaatgaaggggaggccgggttctcttaaggaaggacaccactacaatactgaaaatttatacagtgaatctttctgccatgcttccccaaggagacctccagccgtttaccaggataactgtgcattgggaaagggaaataatcagacatttggggaaatactgaacactggctctgagctgacgctgattccaggggaaacaaaacgtcattgtggtcctccagttaaagtaggggcttatggagcttaggtaattaatggagttttagctcaggtccaacttacactgggtccagtgggtccctggactcatcctgtcatcatttccccagtgtcagaatgcataattggcacaaacatacttagcagttggcagaacccccacattggctccctgtctggtagggtgagggctattacagtaagaaaggccaaatggaagacattagagctgcccctacctagaaaaatagtaaatcaaaaacaatatcgcatcctggaaggactgcagagattagtgccaccatcaaggacttgaaagatgcagaggtgaatgattcccaccacaaccccattcaactctcccatttggcctgtgcagaagacagatggatcttggagaatgacagtggattatcataagcttaaccaactggcgactctgattgcagctgctgtaccagatgtgatttcattgcttgagcaaattaacacatctcctggtacctggtatgcagccattgacttgacaaatgcctttttctccattcctgtccataaggcccaccagaagcaatttgccttcggctagcaaggccagcaatatacgtttactgtcctatctcaggggtatacaaactccctggctttgtatcataatcttattcagaaagaccttgatctctttttgcttctgcaagatatcacagtggaccattacactgatgacattatgctgattggatccagtaagtaagaagtagcaaacacactgaacttattggtgagacatttgtgtgccacaggatgagaaataaatccaactaaaattcggggaacttctacctcagtacaatttttaggggtccagtagtgtggggcctgttgagatatcccctctaggatgaaggataagttgctgtatttgtcccctcctacaaccaagaaagaggcacaatgcctagtgaccctatttggattttggaggcaacacattcctcaattaggtgtatcactctggcccatttatcgagtgatccaaaggctaccagttttgagttgggtccagaacaagagaaggctctacaacaggtccaggctggtttgcaagctgctctgccacttgggccatatgacccaacagatccaatggtgcttgagatgtctgacaggtagggatgctgtttggagcctttggcaggcccccataggtgaatcactgcagagccctgtaggattttggagcaaggccctgccatcttctgcagataactactctccttttgagagacagctcttggcctgttactgggctttgatggaaactgaacatttgactatgcgtcatcaagtcaccatatgacctgaactgcctatcatgaactgggtgttttctgacccatctagccatgaagtgtgtcatgcgcagtaactttccatcatcaaatggaagtggtatattcatgactgggctagagcaggtcatgaaggcacaagtaagttacataaggaattggctcaaatgcccatggtctccatttctgccaccctgcctgctcttccccagcctgcaccaatggcctcatggggagttccctatgatcagttgacagaggaagagaagactaggccctggttctcaaatgggtctgcacaatatgcaagcaccacccaaaagtggacagctgcactactacagcccctttctaggacatccctgaagcacagcagtgaagggaaatcttcccagtgggcagtacttcgagcagtgcacctggttgtgcactttgcatggaagtgcatatggaatggccagatatgcaattacatactgattcatgggctgtagctaatggtttggctggaaggtcagggacttggaagaaacatgattggaaaattggtgacaaagaaatttggggaagaggtacgtggatgaacctctctgagtagtcaaaaactaaaggtattcgtatcccatgtgagtgctcatcaatgggtgacctcagcagaagaggattttaataataaagtggataggatgacccattctggggacaccactcagcctctttccccagccacctctgtcattgcccagtgggaccatgaacaaagtggccatggtggcaaggatggaggttacacatgggctcagcaacatggactttcactcaccaaggccgacctggctacagccagtgctgagtgcccaatttgccaggagcagagaccaacactgagcccttgatatggcaccattcctcagggtgatcagccagctacctggtggcaggttggttatattggacctcttccatcatggaaagggcagaggtttgtccccaccagaataaacacttactccggatatagatatgagttttcctatcccgctcacaatgcttctgtcaaaactaccatccatggactcacagaacgcctcacctaccatcatggtattccacacagcattgtctctgaccaaggcactcactttatggctaaagaagtgcagctgtggactcatgctcatggaattcactggtcctatcatgttccccatcattctgaagcagctagattgatagaacagtggaatggccttttgaagtcacaattacaatgtcaactaggtgacaatactttgcacagctgggtcaaagttctccagaaggccatgtatgctctgaatcaccatccaatatatggtactgtttctcccatagccaggattcatcggtccaggtatcaaggggtgaaagtggaagtggcaccactcaccatcaccccaagtgatccactagcaaaatttttgcttcctgtttccattacattatgttctgctggcctagacgtcttagttcctgggggaggaacgctgccaccaggagacacgattccattaaactggaagttaagattgccacctggacactttgggctcctccgacctttaagtcaacaggctaagaagggagttacagtgttggctgtggtgactgacacagactatcaagaagaaatcagtctactactccacaacggaggtaaggaagagtatgcatggaatacaggagatccattagggcatctcttaacattaccatgccctgtgattaaggtcaataggaaactacagcaccccactccaggatggacgacaaatggcccacacccttcaggaatgaaggttaggttcactccaccaggaaaaaaaccacaacctgcttaggtgcttggtgaaggcaaagggaatacagaatgggtattggaataacgtagtcattaatatcagctatgaccacatgaccagctgcagaaagaggactgtaattgtcatgagtacttccttcttcttttgttaaaaacatgtttgtgcatgtatacacttgtactaagaaaaatcttcattttatttcctttctcctttatcatgtgacataagatttattgatttcacatcagcatttaagaattgttaactttatgtaatagtatttgggttggggattagtgtgtttcgggttgtatgaaggatagttatattaggcataattatgaccttattattgtccttatttgaaaattatgtatgatctcaggagatgtgtatgggttcaagttgacaaggggtgaacttgtgatagttaatactaagtgtcaacttgactggattgaaggatacaaagtattggtcctcagtgtgtctgtgagggtgttgctgaaggagattaacatttgagtcagtgtgctgcaaaaggcagacccacccttaatctgggtgggcacaatctaatcagttgcctgtgcagctagattatatacaggtagaaaaatgtgaaaagagagactggcctagcctttcaccctacatctttctcccgtgctggatgcttcctgcccttgaacatcggactccaatttcttcagttttggaactcagactggctctccttgttcctcagcctccagatggcctattgtaggaccttctgatcatgtgacttaatacttaataaactcccctttatatatgtatatctattctattagttctgtccctctagagaactctgactaatacaggtgtctactgctaaagtgggggcattgactgggaaggaacagtatcattaaaattgggatgggaacacacgggcagactgacgaatctggggatactcagctcctaaattccaatgactcttctctgccactagaaggggcacacacaataataatgggagactttaacaacccactgtcaacattagacagatcaacgagacagaaagttaacaaggatatccaggaattgaactcagctctgcaccacgcagacctaatagacatctacagaactctccaccacatatcaacagaatatacattcctttcagcactacaccacaaatattccaaaattgaccacatagttggaagtaaaacactcctcagcaaatgtaaaagaacagaaattataacaaactctctctcagaccacagtgcaatcaaactagaactcaggattaagaaactcactcaaaaccactcaactacatggaaaacgaacaacctgtccctgaatgactactgggtacataacaaaatgaaggcagaaataaagatgttctttgaatccaatgagaacaaagatacaacataccagaatctctgggacacattcaaagcagtgtgtagagggaaatttatagcactaaatgcccacaagagaaagcaggaaagatctaaaattgacaccctaacatcacaattaaaagaactagagaagcaagagcaaacacattcaaaagcagaaggcagaaggcaagaaattactaagatcagagcagaactgaaggaaatagagacacaaaaaacccttcaaaaaattaacgaatccaggagctggttttttgaaaagatcaacaaaattgatagtccactagcaagactaataaagaagaaaagggagaagaatcaaatagtggcaataaaaaatgataaagggggtatcaccaccgatcccacagaaatacaaactaccatcagagaatactataaacacctctacacaaataaactagaaaatctagaagaaatggataaattcttcaacacatacactttcccaagactaaatcaggacgaagttgaatctctgaatagaccaataacaggctctgaaattgtggcaataatcaatagcttaccaaccaataaaagtccaggaccagatggattcacagccgaattctaccagaggtacacggaggagctggtaccatgccttctgaaactattccaatcaatagaaaaagagggaatcctccctaactcatttgatgatgccagcatcatcctgataccaaagcctggcagagacacaacaaaaaaagagaaaatttagaccaatatccttgatgaatattgatgcaaaaatcctcaataaaatactggcaaagtgaatccagcagcacatcaaaaagtttatccaccatgatcaagtgggcttcatccctgggatgcaaggctggttcaacatatgaaaatcaataaatgtaatccagcatataaacagaataaaagacaaaaaccacatgattatctcaatagatgcagaaaaggcctttgacaaaattcaacaacgtttcatgctaaaaactctcaataaattaggtattgatgggatgtatctcaaaataataacagctatctatgacaaacccatagccaatatcatactgaatgagcaaaaactggaagcattccccttgaaaactggcacaagacagggatgccctctgtcaccactccgattccaacatagtgttggaagttctggccagggccatcaggcagaagaaggaaataaagggcattcaattaggaaatgaggaagtcaaattgtccctgttggcagatgacatgattgtatatctagaaaaccccatcatctcagcccaaaatctccttcagctgataagcaacttcagcaacatctcaggatacaaaatcaatgtgcaaaaatcacaagcattcttatataccaataacagacaaacagagagccaaatcatcagtgaactcccgttcacaattgcttcaaagagaataaaatacacaggaatccaacttacatgggatgtgaaggaccttttcaaggagaactgcaaaccactgctcaatgaaataaaagaggatacaaacaaatggaagaacattccatgctcatgagtaggaacaatcaatattgtgaaaatggccatactgcccaaggtaatttatagattcaatgccatccccatcaagctaccaatgactttcttcacagaattggaaaaaactactttaaagttcatacggaaccaaaaaagagcctgcattgccaagacaatcctaagccaaaagaacaaagctggaggcatcatgctacctgacttcatactatactacaaggctacagtaaccaaaacagcatggtactggtaccaaaacagagatatagaccaaaggaatagagccctcagaaataataccacacatctacaaccatctgatctttgacaaacctgagaaaaacaagcaatggggaaaggactccctatttaataaatggtgctgggaaaactggctagccatatgtagaaagctgaaactggatcccttcctcacaccttatacaaaaattaattcaagatggattaaagacttacatgttagacctaaaaccataaaaaccctagaagaaaacctaggcaataccattcaggacataggcatgggcaaggacttcatgtctaaaacatcaaaagcaatggcaacaaaagccaaaattgacaaatgggatctaattaaactaaagagcttccgcacagcaaaagaaactaccatcagagtgaacaggcaacctacaacatgggagaaaatttttgcaatctactcatctgacaaagggctaatatccagaatctacaatgaactcaaacaaatttacaagaaaaaaacaaacaaccccatcaaaaagtgggcaaaggatatgaacagacacttctccaaagaagacatttatgcagccaaaaaacacatgaaaaaatgctcatcatcactggccatcagagaaatgcaaatcaaaaccacaatgagatactatctcacaccagttagaatggcgatcattaaaaagtcaagaaacaacagatgccggaggggatgtggagaaataggaacacttttacactgttggtgggactgtaaactagttcaaccattgtggaagacagtgtggcgattcctcaaggatctagaactagaaaaaccatttgacccagccatcccaatactgggtatatacccaaaggattataaatcatgctgctataaagacacatgcacatgtatgtttactgaggcactattcacaacagcaaagacttggaaccaacccaaatgtccaaaaatgatagactggattaagaaaatgtggcacatatacaccatggaatactctgcagccataaaaaaggatgagttcacgtcctttgtagggacatggatgaagctggaaaccatcattctcagcaaactattgcaagaacaaaaaaccaaacaccgcatgttctcactcataggtgggaattgaactatgagaacacttggacacagaaagtggaacatcacactctggggcctgttgtggggtggggggaagggggcgggagagcattaggagatatacccaatgtaaacgatgagttaatgggtacagcacaccaacatggcacacgtatacataggtaacaaacctgcacgttgtgcacatgtaccctagaacttaaagtataattaaaaacaaacaaacaaacaagaaatggaagaaaatttcctcaacctgataaagggaatctacaaaaattccacaactaacatcatacttaatgaaagactgaagcttttcctttcacatccagaacaagacagagatgctcattcctaccacttttatttaccactgtactggaggttctagccagagcaactgcgcagaaaaagaaataaatgatccaaattgtaaaagaagaagtacaaccatctctatttgcagatgagataatcttgcatatagtaaacactaataatacacacacacacacacacattattagaactaataagtgagttcagcaaggttgctgaatacaaattcaatatgcaagatttaattgtatttcaatacagtagaaatgaacaatcccaaaataaaattaagaaaactccccatttataatagcatcaaaaaaataaaatacttaggaataaatttaaaaaggtttgggtcttttgcgatgaacatggtagaaataaataaaagacctaagtaaatggaaagataatctgtgtccatggattgcaagacttaatattgttaagacgacaacactacccaaggtgatctacagtttcaacataaatcctatcgaactctgtatagtgaaaagttaacttcactcagaaagaggactgacctttcacctcaactatcagaagctgatctctacatctctgggatgtcctgcctaataggaatatctttgtttgcctgaagatttgaccactggacagtgaacactgtgatttatgatgggggcttttggatattccatgtcaattccaacctccagaggaatcagagactaaacttattagcctgaccttccagaagggactggagactaaaaatcagccacatggacagtatgtgataaagtcttactaaaaactctgaaaaccaaagctcagtgagcttccctagttggcaataccctttgagctttgagtattgtcacacatcacagctaggatgaggtaacgccatccaggactccatgcagagaatatgactataagtttcctatttgggcccctttcagacttcactttatgcaacttttcctttgcctggttctaatttatacctttttgcaataataaaattgtaattatggttatagcgagtatagcactttcctgggttctgtaagtcattctagtgaattactaaatctgaggatggtcatgggaaccctcaaatttgcagccagctgatgcgatgttcttgaggctatttacccatattttttctgtatgctggattttttatatattatgacatagtatggtaatgagcatttcttctcaactccactttcagtgattcatgttggtaccttgaaatcaaccatgcggaaagtatatcacagaaatcagccaatgctatgaatcagagcttaatttattattttcctaataccaaaactattaataatacagattaaacataaaattttattgtattgatagtcattacattgcaaatagtacaaaaagttgaggaaatattctgtcagtttttaaaaattattatccagttcagcaaagaagttactgacatcattgacaaaagagtaaatttccaatatatgtcctcactgtttcagtttcgtatcagtcattattataaatgaaaagatcaaccaacactcatgttagagctagactcattcatcaactgcaaccatagcttggctatggatataagaattcagaaaaaaatcaataatagcattctgtgagaatcaattggcaatatggaatttataataaagagtcatgtatattttattattaagtgtaaattgtgtgctgcacatctttcatgttgataaaatgtataataaacttatatacatgcatgtgtgtgtgtatatatgtataataaacttatatatatgcatgtgtgtgtgtgtatatatatacacacacacacacatttcttaaggggagagccagttgttaatcatttaccagggcacgactgattttagtgttatcttcctgcaggaaagaggactagtcatatggcaaacaattgcatagtaagtctagctgcacaattgcctttaataatttctagagagaagttaggctgacaagtaaaaaaaaaatcccccctttacacttccaggatctccatcttttcttgaaaaatagtatagaccagttctgcaatgattccagcctactctttaagacagactacagagtttatttgggctatttgaacacatgctcttggcatacgtagttcaataacaagaacttttctgtctcttttagccactcagacattccaaaggaccacacatcctttgcaggaactcaaaataaggagattataaatgtcctaaggcatttctgaaatctctcaactcttcctacaccactgttctcgcctaactcaaaactcttggctctccatcctaactctaatcctaattctaggacttgaactggaatttatcctaattttcatggcatttgacttaattctccataggatacctgggatagaatttatacctctggctttccccttctgagataaacccctgatgcttctcccaaattctagacactgatgtgaatgtaataaaatagggatcttatttatacatcagatgcatctgtaaatccttccaaggactagggttcctctttcttttcccacaaccaacattccttgaaaatcatttttaaaaggattcaggaaactgattcttactccattcttatgtaacttcctgctatccccacctagaactctactatttgtctatttcagttttcaagtagagtttagtattttgtcaagtaggaaaaatcagtgccctttggactcatctgttcctttctttctttcctgctgaaataaagaggaaacatttgactttatcctatattttataaattatttttctattcatatactcccatgtaattatttacattattccttgactttacctaatttttgtacttacttcttccttgaaacaatgtgacactactttatgtagtatatttctccccaaaatcccaaattattttattaatataatatttagttttgttgtcctttcagcagagaatagtataggttatcctcaaagtagagggatatccttagaatagagaaaactctagctgtaaacttttttaaaaaggtttcattgaagaaaataaacctctcaaggaattgagattattagtaatctgtaaagattaaagtcaaggaaacataataggaatagggaagaggaaaaaaacacagtccctgaaaaatagaaaaagcttgcatttcatgagatttcacatgataagcaagtaagagactgtttaatacattcacttgttgacctttaaaagaatccatcctcatgtacagcattagaagcatataatgagattagtatttagagactgttatgagaataggtcaagtcagtcacaagcatattttcattttggttcactgtattttctgccacagcattttgcaaggccatgtgtactcctttcaaataaatgcagcagtgagagtactgtgttgaccttttatctcatttccctcctaatacggaggtaatcatcaataagcactgtgcatactggagttaggcatttgtgtaaacaaaagatttattgaaatggccaagggggagaagaaattgaaatccatctcacttagaagcctttaagaagatctgaccagaaatgcaacctaggttataactgtgccagtgcccagaggataacttgaccagcagcaaaagctggcctcccaggaaaggaagagcaggtgtgcctgaaaatccgacttattcatcaagggtcatttaaatgtcaactcaagcggctcacatctttaattccagcttctcaggaggctgaaaaaggaggattgcttgagcccaggagttcgagactacagtgagctaagatcatgccactgcactctaccctgggcaacagagcaagatcctgcttcaaagcctcaaacaaacaaacaaacaaacaaacaaaaaacatagctattgcacttttatggcacttcatccacagacagtgaagtcctaaaatgtttgggtgagcagaaaagtcccaggccaagagattctaatcatccagcctggggcaatccatagggaacttttgaaactatacgtctccagcacaaaatgaaggtttgggaccttttccactcatccaacaatttgagagctctgggtggagccctaggaacccacatgttttcaaaaattgctcaagcaagaccagagaataaagaatgttgaccaggggttgctgtgtttcattacaatcagcaaactactatgtgatgtttataactgtgtgcatgaatgattttgatatgtattaaaagacaaaagtatctccagggtattctaatgtatagcaaaatttgggggctactttgaagaatgtggttgtttctcttaatcctgggatactgctaactcctctccaaaatttcgcaaggaatagtttgtctgctttatttttctctattgttgagaaacagttttttcactgttaaagaaaaaaaaatggcattatcagctaggtttctgaattcacattgctgcttccatagagttttgacaattccatcacatgtcctacagttcctctaagaagctgagagacatttgacacattgatgtttaacacatattgctgtatagtcacatgccctcacctacactgaagtcttactgagagtaggaatagtgtcttttatttctgtatccccagtctaataggggatatcatatattttgtaatccttaattatttgatgaatgaataaacaatacattgtaaggtatatgaaagcaattactattcattgcaactctttgtatactcgatagtacctaacacaaacagttttctgcttgcttaaggactacaaaatacagataaaggctaatcatcattttatgtgtttgaaaaataggtaccttgggaatcagggaacctcaattagatcagaggttcttaaaactttttgaattacagactgcttaagaatctcgtgaatgctacaggattccctcacagccctcacacacacctccaaggtatacatataattagaggggatttgcaaattgagcccccaaaaagccatccatggactccaggttaagaactactagaatgttcatctcaaagactttctagctccaaaaggatccacaatcccaaaaaagagaaggtagtattttccaatatccagtcccaagaagaactcagagactcaatcaatagaaatgtgaaagcagtcacctccaagacaaagaatactctgacaaagtttgggactctctggaggtaagtgtcccgctgcaaagaggttatttatatccctgagcctcgatcggctatttgtgcaaggctggtagaggggaagaatgtttgcctcgggagtttattgcaggcaaattatccctggaaaatactgctgggaaaggtgctgaacaaacaacatctacatttacacagttagatattcattaaaacagaaaatgcccattaaatttagagagatgctaagtgccagattcaagaacagaccagtgcagaaaagttggtgcaaatttctccccattgtgtaccagggataagtcaggttgcatagcagtaacttttcccaggtaaccctcactacaagactgtcaagtgtaccttgcaagaagtgagttttcttttttcctaaggaacataatgagaaggtcagatagtaggatttcaagcaagaacagtagcaattacatctgaacaaggagttcactcttgatattccaatgggcccgaatgaaagtcatcatttattttgacattattattattttgacataaaacataatcaaacgatattcatgagccctctctgtgaactaaaaacccattttctgtgtatgtagactagttgaatcttggatttgagaatgtacagagaaagggggaatttatttatctctttcattcttatataaaactaggcccagggagttaggtaactttcccaaggtcataaagctaagtgagatagctcctaattcctaatccatcaagccctcactactgaaattgggattcacagagcagtaacagttgcagcatctgggagctagttagaattgtggaatttcaggccccaacccagttctgctgaatcttaatatacattctaaccagagccacggtgatatgtacgcatgataaagttagagaagcactgcagcaggccatagtgcctccttaaagtgaccactgtcttctctctctttttttttttttttttttttagacagggtctcgctctgtcacccatgctggagtgtagtggcccgatctcggctctctgcagcctctacctcctgggctcaagcaatctaggaccacaagtaggcaccaccatacctggctaatttttttattttttcgtagagacggggtcttaccacgtgtcccaggctggtctcaaactcctgggctctagcaacgctcccacctcggtctccaaaagtgctggaattataggcatgagccatagcactcggcccactttcttcttatagtggtagtttgggaaacaaggccaaagaaaagaataagtatgtggcagatgagaaaagaggtgatagaaatgtatgatttggcaagcttgagatactttgggaaggtggaggaaggcagaaaacaatgtgaagcatgggagctttggactctgacagaatcaccaatctttgaagcaagttagagaagattctggatctaggagaagacaaaaatgaaaaacaagagaccagaaataaaatctcctttctttccagtttcccatacatgccttattattaggaatacaaatgcatttcaatattagactttaagaaaaactaatgggaaaggttaatgcctgtttattcataatccaatccactccaaaacacaaataacctgcttttttctgagacttgtaactaatattcagaatgattaccctactctatgtaaaatctacagagatgagtttttcttaccattaggtttcacgtaatttcagttataagtaagttttattttgatttttgaaaaacagataattcatgtgtgatagcttcatttatttttagctaattaaaatccaaattcctaaaagcggaacaaaccacagaattattcttacggtataagggatcttaaaagccatctcggcagggcgcggtggctcacgcctgtaatcccagcactttgggaggccaaggcaggtggatcacgaggtcagcagattgagaccatcctggctaacacggtgaaaccccatctctactaaaaatacaaaaaattagccgggtgcagtgacaggcacctgtagtcccagctactcaggaggctgaggcaggagatgaacccaggaggcggagcttgcagtgagcggccatcgcgccactgcactctagcctgggcaacagagtgaaactccgtctaaaaaaaaaaaaaaaaaaaaaagccatctcctacagtcatgcatgtaatacctgaatccttcagacatctccgttcattgctgagtgccagaatctagcagagtgcttgaaattacttgggtacccagtaaatatttgctgaatgaatgaataaatctctagcaaattttcttccagctcttgaactatgaactcagagaccccattactttgtgggaaagatctccttattagaaattatttgttaatactctgctaaatcctacctctctgcaattcatatcttgtccctcttgttctggccaaaccaaatctgctttcttctcctacatgacctcccttcagctataagcaattacaatgccttctcaatccatacatatattgcttttgtctctgtgcataatgcagggttgactcataatagatatgaagtttatggtcaatttttgccataagcctcctttgacttttcatgtctgcatcaaagattgatggaaaacatattcaaacctcaatccaggaattttgggttctttgggtttcatgatgaatggtttctagttgttttgtattcaagacagttgaggcaaaggataaacataaatcagcaggggataagtattttaagatacttctgtcaaaaggcttcccagccccattcatctcttccttttccccccgtctacagctttaggccctgttacaaagaacctcagcgattccaattccctgagttcaatttttagggcggtatattatgattgatttcaccatgagctaacagagagggaaaatccactgggtctccctgttgtgtcgacttggtctcactgtgaagccccatttattccagcaggcaagtacttgaccttcacagatctttagcacacttagcattctgcccaaaaccgccagcaaagcatttcacctgagaatatcattactgctgagagaaaagaatcgcacgtgtgttctgggaggatttcaaagaaaacctggggaaaagaggggtggatgaaagaggaaaggaaacaaggcagagagggaaggcaatgattaaaacgtgcagaaatgaagggagatggtaagaacagaagagggagcagcacaaaaatggggagctttcagagactatggaggtaaaggaaaaagagggagccacagtctaaaaaaagatggagagtgatggagcctccagtagagagaggcgagggggggaaaggtgaatggagaagtctttagtactttccaaccttccacatgaaatcaacactgtcagcatatgaaaaagtagaacaaaaagtcggtagttatagatagcaccaagactcttggaatttcttttttttttctaattatactttaagttctagggtacatgtgcacaacgtgctggttagttacatatgtatacatgtgccatgttggtgtgctgcacccagtaactcgtcatttaacattaggtatatctcctaatgttatccctcccccttccccccaccccacaacaggccccagtgtgtgatgttccccttcctgtgtctatgtgttctcactgttcaattcccacctatgagtgagaacatgcagtgtttggttttttgtccttgcaatagtttgctgagaatgatggtttccagattcatccatgtccctaaaaaggacatgaactcatcattttttatggctgcatagtattccatggtgtatatgtgccacattttcttaatccaggctatcgttgttggacatttggcttggttccaagtctttgctattgtgaatacaaacaaccccatcaaaaagtgggcgaaggatatgaacagacacttctcaagacatttatgcagccaaaagacacatgaaaaaatgctcatcatcactggccatcagagaaatgcaaatcaaaaccacaatgagataccatctcacaccagttagaatggcgatcattaaaaagtcaggaaacaacaggtgctggagaggatgtggggaaataggaacacttttacactgttggtgggactgtaaactagttcaaccattgtggaagtcagtgtggcgattcctcagggatctagaactagaaataccatttgacccagccatcccattactgggtatatacccaaaggattataaaacatgctgctataaagacacatgcacacgtatgtttattgtggcactattcacaatagcaaagactcttggaatttcttgatcaaaaatcaaggcccacataaatcatctacctaatctttcatttttttataggtgagaaatctgaatcttagaaaaggcaaagtttttaactctgctagcagatgcttggtaccagagccgagataataaatgtctcacctaaaaagctgtttgacagaatttatggtctttttctagccattttgaaaatgacaaaagctatgtgccacacctacataaaaattattttagaaaataaactattgccacatacagtgactaacttattgtacagaaccagatgcttccttataacagtcatgatacaggatgcagataaaaagaactacctaccaccaccaccctcttttcctgtatacctaacccagcagaatgatcatatcaatcggagatggaaatagtcctataataagcaataatttccccttccctgatcttaagttagtcagctagccattaggccttctaaatatgatggctcagcaggaatcagctaatgacccttttttttccacctgaagataagcagctccgcactatgctaggaaatcacatttagctctattcagggaaattgagggtgcatgaaatataagcttcctttggcacattttaaaaaaatgaagcatttttaactaagtttaatcacaatgttgaatatcagcatttccgtacataggtatagctcctacccactcctttgaacaaacatttcttttaatctaatctgaaatctttgaatgcagaattaaatttcaccctagctaatcaggcgaagaaaagctgctgttgagaaaagggataagataaatatctttctcataagccatcatcatttgcagaatttctcacccaagagatgggggttgatttttttattggcagttttcatatagttacaagtagtgtttcatggattgttttatagaagttctttgcttcagtttagtaggtggaaaataagcaatagtaatcttctgggtcaaagtgcttaggcagatgagctatttcctcagaatcacctagaaaactcctacctcacaagaagtcattttatgtccatatgtgcaagtggttattttcttattccccttcctatccctcccacacaaaagggctagtgcagaaatgagcaaagtttcctgtgatggacaggacaataaatattttagcctttgcaagccatgcactccttcttactacaactcatctctgacattgtagttcaaaagcagccacagtatacaaacaaatggtaatggctatgttccagtgaaattttctttacaaaaacagtcaatggaccacatttgatccacaaactagaacacagtttactaatcctggcctaaaaacattagcaacttcctaaactagatctctatagacccataaggcagaaatcaccaaatctcacatttggaaggacctttacacaagggtcatatcaactgtgcgtttacttacccaaattcaattctacatgctgtaagttcaaaaagagaaagggaaagagaaaaaaacttaacaatttaaagagcataggacattaacctatcatcccatttagttgaatttatgccctggtacgagagagacctgaagttagaggagtgaaatctcacgtttcaacaatcattcacagttcctaacgctggattctctggagttccttaagagctctggaactctctggaactttcctcacatgagcgttttgccctacagagaggtgttcttgttgtagtgtttaaagatgctgtattactttcttactatgggactcataaactacttcatctggtgctcaaataaattaacagcaatcatgtccagccctggaggggaaagaagaatcactgaacctactgagagcatttacagccccataatggagtcttcttgagggatttttcaaaggtaattctgactatacaccattttctccttaaacatgcacttcaaaaccttattcagcataggattcaatgccagtatacctagcccagccctactcaatctactcaatgcttgcaacacctctaccacatccccacatggtcactgagccaacataatgacacagtcaccataataggaagctaatgacttctggaggcaacatgttcctctttgaaccacgtcattaggaatttcttcctcagactgcgccaatatatctgtccttccaaaattttgcatgtactatagataatccccaaacaggaagcaaccatccccacttggcacaattaaaatctatggccatatactactatctcgaaaattcactgatattgcaatttggggtgaggaagactggtagtttcctacacatgggcttgctccctggcctgtggacgtgtagtcctagaggtgcctagaggtaaagcagagtggtgatgaataggggccaacgaagttctgcttgtttcagttgatgccatgtctgagccactgatttacttgttataagaaatgcatcacctcaatgggtacatatttataacagttgatttcatttgcatatcttccatatttaaattttagcctctggagatttggtttactgatttataggtttaaatatgaaaaacaaagtttagtgaattctgctgctaaacaaatatcttaagattagtaattgttctgataattatctcaactttatttttatttatttatttattttgcaggggtcaaggtctgtgtctcccaggctggagtgcactggcgtattatagctcactgcagccttgatctcctgggctcaaccaattgtcttgcctcagcctcccaagtagctgggactgcaggggtgtgccaccatactagctaattttttaaaaaaattttgtaggccaggctcagtggctcacatctataatcccagcactttgggaggccgaggcaggtggattgcctgagctcaggagtttgcgaccagcctgggcaacacggtgaaatcccgtctctactaaaacacaaaaaattagccaggtgtagaggcaggtgcctgtagtcccagctacttgggaggctaaggcaggataattgcttgaaccggggaggcggaggttgcagtgagctgagattgtgccactgcactccagagtgagactccgtctcaaaaaaaaaaaaatgtgtagaggcagggtcttgctatgttgcccaggctggtctcaaactcctgggctcaagtaattctaccacttcatcctcctaaagtgctgtaattataggcatgagccactatgccaggcttcaactttatttttaataagaaaaagaagcaacagtgataccactatgaaaagatgcactgggaagtttgggcatgcttttgtatcatcatagctgggctgaggagtatattgctgccccagacaaaaagagctccatctcttctgttcttaggagctcagggaggtagcaaccagataggaggagacccctgatattatcaggttccataggctttagctgtctccctgtgccccaaaacggccagcaaactctttctgctctcttcgaaagtgacagactatttcctctggaacaccaaggggacaaatggccttcacacctgaagtccaatgtacagcctgcttcgtcacacttcaacagaggattaacgtctggtgggggcctcatcttttagaatcgctgttctcaagaaacagtgtagcacagtctgtcagtctaggggtttcatgcaacagagaacaagcaaacacatgactatacacacacacatacatgcaaatatatatttaaacacatataaggaaatgtataatgaatataaatatatatatcaacatataatagataaacattaaaatatagatatttatacatgtaaatatggagtgctgctgctagtctggggtgcttctccctacagggaagaagaaaaacataaatatacatacacaatatatatatatacatgtgtgtatatatatgtatatatatgtatatgtatatatgtatatatgtgtatacatgtgtatatatgtatatatgtatacatgtgtatatatgtatatatgtatatatgtgtatatatacgtatatatgtgtatatgtatacgtatatatgtatatatgtgtatatatatgtgtgtgtatatacacacacacacacacacacacacacacacacatgcaagtatatagagcagaggtgtcgaaacttttggcttccctggaccacactggaagaagaagaattgatttgggccacacacaaaatatgctaataatagctgatgagctaaaaaaaaaaaaaatcacaaaaaaatctcataatgttttaagaaagtttatgaatctgtgttgggccacattcaaagccaacctgggctatatgcagcctgtgggccatgggttagacaagcttgatatagagaaaagatgcactgggacaggtacgacaactccaggcataactgaccttcccatgtaagcatggtaaatagccatttctatcatctcaaaattctcctgtacttgctggatggtttctgaaatcctgctaatgggaaacaatgacctttgttccccaattcagttcaagtattaatatgatgaaaatacaagcattcataatgtaacctcacatcaatatctaaataaccaatattcccgagaccagactatgggccataaaggttaataaagattaggatcatacagaagcactacactggggaagggagcagtgcaaagaacacagaactggaaaaattttaatgtttgaaatgaacttagaaatttgcctggcacaaagcagtgagagataggaaagggtttattcaagaagtcactttctggacagtctagaagagcagtctggattttgtttgtttatttgttttttgaaacagggtctcgctctgttgcccaagctggagagcagtggtgcaatctcagctcactgcaacctccacctcccaggctgaagcaatcctcccacctcagccacccgagtagctagaactacaggcacaggccccaacacccggatttgctttttttttttctttttctttttctgatgtctcgtcatagtgtccaggctggtctcaaactcctgggctcaagtgatcctccctcctcagcctcccacagtgctgggattacaggcatgagccaccgtgcctggcccagtgtggtttctaaaacagaagtgacagtatgtggatcagctccataacttatctcatacatgagcttcaatacaaataacttacttctataaatcaaactgtctacacttggctagaccaatgcttcatgcagcccaaggctgtcctgaggctagtaacaaccattaattcagcccaccttctgcacccaaccccacctctcaaacaaaaccccagacacttaactccaaaagcgctattgagtaatatcattgttactgatggactcatggatagacagaagaaaacattttcagaataccttatacatccctagtctctctccctggcagagatatttggtatctggtcagcttgcagtctccacccaacacaataaaagctagttgtttggcataagctaagcaaaaagcctggtcctaaaccaagccctattcttctgagaactgcaagcgagctctcagaaccctgcaaagttacagctacaatcacttctgatcctcaaaaagtttaatggatacatatatcaaaacatcatgttgtacaccgtaaatacatacaataaaatttttaaaaaattgagcagaaacatatatttgatcaattacttgaggattttcttttttttcttttttagagacaggatgtaactctgttgcccaggctggaatgcagtaagcaatcatagctcactgcagcctcgaactcctggaatcagcaattctgccactttaacctctcaagtagctagaactacaggcacatgccactatgccgagctaattttttatttttattttttgtagagttaggatcttcctatattgccccagctggtcttgaatgcctggcctcaagcaatcctcccatgttggcttcccaaagtgctgagattacaggtgtgagccacaatgccccgccttgtaggttttttttttttttactgtatttccagtttttccactgttcaatgacagaggaactccttataaataaaaaatatattcaagccctaaaaaatattaactttcttatttaccattttcattttcactttttgcctatggatttcagttaaaaactggtgttatttccttatttcaacataactacattaccattcacctcctttgtatagttattgtaaaacatattccatttctgtatgttgtattcagcaacatgattgtatagaaattattgttgcctacaattgcttttagaataatttaatataaaattttttaaagaaatatatttttaagtctgttaggaggcagggaggtcaagttccatctttatcttactgaggaaattggagcttaggttaggactcccgcctaaggcatcagatctgtttgcacaatttggacaacaatccacccattcattccttcaacttgcaaagagtcaggcagttggggctagtgacccaagtctagttgaacactgtaacatggactatggcagaattaaatggaatggcatggcaccaaacctagactgagatgtccagaaaggtttctcagaggaggaggtgactcctgagctacatgtggtagaatgtgtggaggtatccaggaagtggggcagagctactccagaaagaactggcagcatggagaaaggcatgatggtggattctgggtctgaattacagtgtttttattctccttcacaaccatcacataaagtgactctaatcctggggaaactaacctcaccaggaacccactaggaagctttccacccatcaatggaatttcattcatttttcatttattcacttaaaatttaaagaattaccactccagcatgaataataagatagttaacacttattgggcaccaactatgttccagtcactttgcatacattatttcatctgatccttgccacaaacctacaagctggggactattatctctgttttatagatgaataaatgagtttcattgccattaagtgagttatcaaaggtcacatagctatgaagtaactgaaacagaattcaacctctcgttgatctgtcccccaaacctgggctcttttgaggcatccacactgcctcattcatctattcaaaaaaatatttcttgattgcctactgtgtgccctctgctgaagaaaacaggtccatagactgataatttttaaataagagtttttctaagaactgcattgtaggaggaaagatgaggatgctcaccagccaatatctgggcaaccaccgcatcccacttccagaatacatcaaaattacagctttttttgatatatgactgcaacttgaagtaagaccctctctgaaaattgtcatatggtcagcaaggaaggagatcactgtaaactcaggtaagggaaaactgctggggctcagcagagaaaggagatgtaccttttagttttatgttggcagacttcaaaaaggcaatttgaaaggaacataggtgacattcattcaaaggggtgcacagggtttgctgaggaagacattagggacctatcatcttgttgagacatcaaccttctttctatagctcctgacatgaggcatgcttttgtgatggagggctgactttctcacccctgcaggccagtcctatgccaattaaggtactgtgcttaggttcatgtgcagaggaaggaagccctgtggtattaatgacatgaaacaggtatggtagatatttgctgcctagattcagacactctttccatgtttgaggaatctccacttaatgagtcctaatgagggaaggggagcaaaaattccttcttcatatgaatggaaaatgctacgtacttgcttttcccagctcctttaggcatgcgatgttctcatgtcaaacacggacgtaggagctttgaagcaaaaggaaggagataagggacggctccttccctcctggcagcagtaagttacagaaaaaccacattcatggtgagaaaatagcggcagtacaaacttccaagatttagtggtggcagcagcaattttctcttcagatcagttctatgatgtgatttggggctcagctttaaacctggctcctagccttcacaacaaatctgtttcccaacattaatttagtaaactctttcatgcttaagcagccagaatcagcctctgttgattacagatatgaaccctgtcagtccgaagcatccctgaacctcttcttcttgtaacatcacaccatttccagaggggaaatgccctaacatcaaattaaacccaggaccaaaaatcaatttgcccatcaaagaggctccccaagaccttcccctccacagatactcttcataatcaaacaccaagctaatcatggtgtccctttcccctgaacacagtaattaccccaggtataacacttgaccaaagctgggcccagcagtctagttaggaattttgtttttcatctgaaagtaagaaagaaaccttgcacaccagagtacaaaagtaacttggcttatgaaatttaaagtataaaacagcaaaatgccattgccttcccaccaccataaagtagcctggtcctgtacatctgacttaagggttcctgcagaacagaagaaaggagtcataggaattttaatctagcctgtctctcaaatttgacaaatgaaaaacacaaggcctgcagaagggaaacaacttgcaacaggtcacacaacttttataaactggaatgaaaattctctccatctcctgccaacactcctgtactctttctatctcctaccatgtttcaactttgtagaactaattagtacctaatctaacgttatctatatttgctagaatgaaggctctatgagagcaggggttttctggtttgttccccactatatcttcaatgtataaaacagtatccaatacagttcttcctacacaactggaacagaaaggcatctatcaataattggttttattcaaacagaagtagactctagaattgaccacttctaccttgtcaccaagctaaaaactgtttagttttctgggtgttaatcccacaagaatgatatttctatatttaagtcatatatcccatgctgtattttgtatttgcactctctgggcctggcagccctgcccaatacctggagtaaggaaatttaatagactatagaaaagcatttatttcatttaatctattgccctaattgctagacaacccaagcgaattcaatccatttgagttcaactcaaagagtgtatctcagtgaatattttaaataaattaatactttttttctagttcccagttgactaagtgcaaacttgaatgagtaatgctgctgattataaaatgcatgtgtcttcatatgcaaatgtatgccatcattaaaacattttcacagcctttcattttgttcaaagttgatccagagagaagacttggacacatctgtctgcatctttgagtacctataggatcattcagtgtctggagactaacttcttacccttcatcctcctggctatgaagttaatcaataatccccttaccctcagatgtgtctaccccatttaatttcttggtgtttggtcttatcacagggataattcacagaataggttatttagcatcacagacatctccaattcagaattcttacttctctagctcactcactgctgggccagttttttagatgtgctggtcatgttccttaagctagtaaccacttcagggaagaggcctttaccttccctcctcacttcatatagtattagcccttgacagtcacttgaggttgctttccaagtggctgtcattatccataagtttatgatggaatatttatcaacattacaggtattttattctgttccatttcatgtagaaagtgatttacttctttccccaaaatatttttaaatcaatagttctcttcttagttttatatcacaatattttaccctcaggatcactttctcagaatcacatatcactggaagggcaagagttgacttctaggtcatcctgctgtaatgagtccatggatttcttcttccctgtgttcttctctctaatcatcagagtgatttacattttgtttcccttatagctctgcttatctctatacgcttctttatttattcctttttccagcataaggcaattaagactttaagttcttcccacagaaatgagacagacaggcatctattagtaattacttttattacaacagacataggctgtagaagtgactacttctaccctgtcaccgagttaaaaactatttagcctctggatgctaatcccacaagaatgatacttctgtactcaagtcatatatcccatattgtactttgtattttcagtctctgggtctggcagcgctgcccaatatctggtatgaggaagtttaatatatcacagaaaagcatttatttcatttaaactagtgccttaattgctagacaacccaagataattcagtccaattgagttcaattcaaagagcatctgccctgtgccaggtgttgtacttggcatcctttgcaattaccaagaggccacaaacacagtctctgccttcaaggaacttattatggtctagatgattaaaagataaacataaaatacaaggcagtatgcagtaagttacaatggagatataaacaaatgttttgtatagtttccaaagttcctcttgttattgacttctagttttatttcattgtgttcagagaagatacttgatatgatttcaattgttttgaattttttttgaatgtttgcttgttttgtgagctaacgtggtctatcccgagaatgatccatgtgctgaggagaagaatgtatattctgcagtcattggataaaatgttatataaatatctattaggtccatttgttctataagtacaaattaagtacaatgtttttgttgattttctgtctggatctgtccagtgctgaaagtggggtgttgaagtctctagctattgttgtattggggtctatctctctctttacctctaataatgtttcctttattcactcagactcacagatagatatgtgctcatatatatctgggtgctccagtgttggctgcatatatatttacaattgttatatcctcttgctgaattcaccactttattactatataaagatcttctttgtctctttttatagtttttgtcttgaaatccattttatctgatataagcataggtacttctgctcttttttggtttccatttacacagagtatccttttccatccctttattttcagtctgtgtgtgcctttatatgtgaagtgtgtttcttgtaggcaacagatcgttgagtctctttttttatccactcagctactctacattttttgattggagaatttagtctacttacattcaatgttattattgataagtattgtactgtctgtgtcttgaaaagttgttgcagtttttttatcagttcatcttttcatctttctacttcgatatgaatagttcatacaccacaattacagtgtaataatattctgtgtttctctgtgtacttactattaccagtaaggtttgtaccttcagatgacttactcccgtcatgttgttatccgtttgctggttgttttgcagtctcctcttccttctttcttttcttcctgtcttccttttagtgaaggtgattttctctggtggtatttttttttttattttttgtgcatccattgcatgttttttttatttgaggttaccatgaagcttgcaaataatatcttataatccattattttaaactgaggacaacttaacactgattgcataaacaaactaacaaaccagcaaaaaaaccataatacaaactctacattttaacttcattttgcccagttttaaaccttttgttttttctatttatatcttactgtactatgtctcaaaaagttgtagtttttttttgatcagttcatcttttcatctttctacttagatatgaatagttcatacaccacaattacagtgtaatactattctgtggttctgtgtgtacttactactaccagtaaggtttgtaccttcagatgacttcttattgttaaataacatccttttcttaacccttttcagattaaggaactgcgttttagcatttcttataggacagacctggtgttgatgaaatccctcagcttttgtttgcctgagaaagtcttaatttctcttttatgtttgaaggatattttcactggacatactattctagggtaaaagtttttttcccagagcactttaaatatgtcatgccattctatcctggcctatacagtttccactgaaaagtctgctgccaaacacattggagcacaattgtatgttatttgtttcttttctcttgcttattttagaatcctttctttatccttgacatttgggagtttgattattaaatgccttggggtagccttctttagttcaaatctgtttggtattctttaaccttcttatagttaaatatcgatatctctctaggtttggaaaactctctgttatcactgcttcaaataaactttctacccctatctctttctctacctcctctttaaggccaataactcttagatttgcccttttgaatctattttctagattttataggcatgctctattctttttctttcttttttgagacagagtctcactctgtcacccaggctggggtgcagtggtacaatcttgactcattgcaatctccgcctcccaggttcaagcaattctcctgcctcagcctcccaagtagctgggactacaagtatgagccaccacacccagctaatttttgtatttttagtagagatgggatttcaccatgttggccaggctgatctcgaactcctgacctcaagtgatctgcccgctttggtccattctcttttattcttatttcttgcatctcctctgctgtgtattttcaaatactctctcttcaagctcactaattctgtcttctgtttgatcacttctgctattaagagaccctgatgcattcttcagtatgtcaattgcattttcaactccaaaatttctgcttgattctttttcactatttccatctctttgttaaatttatctgataggattctgaattccttctctgtgttatctctaatttctttgtgtttcttcaaaacagctattttgacttctctgtctgaaaggtcacatatttctgtctccttggaattagtccttagtctcttatttagtttgtttggtgaggtcatgttttcctacatggccttgatgcttgtggatgttgtttagtgtctggacattgaagagttatttattgtagtcttcacagtttgggcttcacagatgtacccatccttcttgggaaggctttccaggtattcaaaagaaattgggtattgtgatctaaatttttagtcattgcagctgtatctgcttcagggaacaccccaagcccagtaatgctcagattcatagagataccaccttgatggtcttaggtaagatccagaagtgttctgtggattaccagacagagactcttgttctcttcccttactttctcccagacaaacggagtctctctctttgtgctgtgctgcctggagctaggggagggtgacacaagcacccctgtgggtaccaacactgaaactacactgggtcagacacagcactggatcttgcccagtaactactacctggctaccacctatgtttgttcaaggccctctacaatcagcaggtgggaaagccagcaaggcttgtgtccttcctttcaggtcagtgagttctcccaggccctcggtgggtccagagatgcagtctggtagccagggcctggagttggaaaccttagaaatctacctggtgctctattctaccaactgagttggcacacaaatcgtaagacaaagtccttcccactttccctcccctttccatggggagtggagtctctctccatagctgtcaccattataggcccacagagagtactgccagactaccaccaatgttcacttagggcccaacagctcttcagtcagcttctggtgaatgctgccaggcctgacactcacccttcagggcagtgggctcccctctgatctagggcaggtccagaaatgccatctaagagccaagacctagaatcagggactccctcaaagcctatttggtgccctaccccactgtggctgagctggcacctgggttgcaggacaaagtcccctttactcttccctatgctttttctcaagcagaatgagtctcttctcatagccatcactgctggaaatgtgctgggtcacactggaagccagcacatctcagagtttcacccaaggcccacagcatgtattaccgggctaccactgctgatttttcagggcccaagggctctttagtcagcaggtgattaatcctgcccaggactgggtcctttctttcaaggcagcagtttcccttctggtgcagggtgtacctagcaatatcatttgagagctagggcctggaatgggggcctcacaactctgtctaatgccctatcctgttgtggctgagctgatatccaagttgcaagacaaagtcctctttactcctccctctcctctcctcaagtggaagaaaggagtttcttttggagcagcaagctgcgctacctgaggttgggggaggagtggtaaagcactctcttggctgccctgtctggtgtctcactaggttgcatgtcccccagatccactggctctgagcccagcacatgactaggacttgactaggacttgcagtccttgtggcctagactgcctttcaagtttatttaggaacccagagccctttacccagcagtggcaaggcttaccaaaactcaagttctgattgctgagatgggtaatgcccctcttgctagggcctgtctatgcttcctccgtggacatcagctgagttcagcttggtgttgctttctactgtgacagcacagcactgagtttcaatgtaaagtccttcagtcactgcattgtcctcccacaagcatacatattctgtcttcatgccatgcggctgttgccagaaggatgggagtgaggtggtgtcagtaattcaagggtgtctttcctgccctcttcaatgcctctttcagtgatatgaagttaaaaccaggtactgtgatcactcacctgattttttgttcttatgaaggtgcttttttgtgtggatagttgttaagtttggtgttcctgttgcggggacaatcagtggaggcttctactcagccatctcactgtgcctccctcataaaaaaaaaaaggttttgaaagtaatgaaagaaaaatgaaaaatgtggaatgcttcacagaactacaaactcatcacgttagtgcccattgctggcaccctaaaaatgtaaagttcttatttagcccaactgaaggaagaaaaatgcccagtatggatcaaaaatgtacaaatgtctgatgtaaagtcattgggtgttgaactaagcagcagcctgaaaaaaaaaatcactgtctactgctacacctaggaaatgtagcctccactcttctcccggtagactgctagggtttccgggtcactgcactttgcctattgaagagaagagaaacaaaaacactccaacaaccaattatctctccttgtttttattgtaccaaagcagacttaatctccttgcccctttttaaccttccttttcatgcagatgagagagagagagagacagagagagagagaaaggaaggaaggaaggaagggagggagggagggagggagggagggagggagggagggagggagggagggaggatgggaatttataaagactttataaagatgtaagaaaatctctccaatgtatctctcaaagacctattacaggatctttcttctatctctttgttgatattctggttttcttgtactgacatccaggatactgtccttggacccactttctcagacatttctgtaaaggaacagtcttccagctcctttgtatgagaggaaattgaagcctatgaaaggtaagtgccatgctcaaggtctagagtgagtggggcagagttaaaacaacatctgggtttcctaactgccactccctgttctttcaattttaccagtccacatcataaagggagatcaagatgtattgttaggtttgaacctgtttcttaatttccaacatcagtcttctaatagacagccatcatcttatatttttctatgaattaccttggaaaggagtggggaagaccatatattttccatttctacagccctgccctggaacacacacaagcctgtactgagaatcacctgtgagaagccaaacagaaagtcagcaaaactgttagaaccactggctatttgatgaatagcttgatggtactgattccctcctcaagtagggaacaacaaatgggtaacttgttccccatattcatatagataatagctccagctttggctaatatgtccctccctaataacggtgtgggactttcaggcataacaagaaaggcatgtgaaaagaccaaagtctcccaattacaactgaggaggtgggagaaatacctggttacaagctgtcccaggattcctaggatggtaatggaccttgaggacagctgtccagggcaggagattaacactgagaaggccatgccagtgtccaggaggaagtcaatttcctggccctcaatggttaaacgtacccggggctcagtgagggtgatgacatgagctggcgcttaccccaggcaccctcagttctgttgttggatcatccggttgggggcttctggcccaaagaaactttgccctctggggcagtgcgccttccagtgattgccttggcatagtggacatgggcgagggggcagcttgtttctctttggacaatgttttttaaggtgtccttgcaaaccacaatgataacaagccctaccaggttattggcctgctccattttctgtcctctctgaaccaccaaggtttgtttgtctgagggccatgactaaggctgcagcctttctctgatttcacttttcctttttgcctgctcctcttggtccctattatagaacactgaggttgccaggtttaataatgcctccagatttttttcagggcccagggcttgcttttggaactttctcctgatatctgtgccagattggataataaacttatcttttaggataaattgacccttgagtgagtcaggtgacaggggagtatattttcctaaggcctcccatagccactcgaggaaggcagaaggattttcttcctttccctaagttatcgcggacatcatcgaataattcatgggctttttcctaattctccttagtccttctagaacacaggtcagcagatgtttatgaatccagtccccgtgatctgagtctaggtcccagtggggatgcatactgggaacagcttgctcactggtagggaatttgtccctttcttcagctgtcattctatcatttacttgactaagataccaggtatctccaaattctcaggctgcagctaaagccgcattcttttcattaaaggccatggtttgatctaacaatagcatgacgtctctccaagtgaagtcgaagatttgccctaggtctaccttggcaagatcaggtctaccttgatctgctttaaatcagagagagagaaggggacatatacccgggttgggctaaattcccttccccttacagcttgaagaggacacaaccaatagcccagggatttttgtggtcccttggagatttctttacttatttccttctgggtgggggagattaaaggaggcttatcattaacaggaaggggagctgtaggaaggctaggatatggaggtaagctgagaggtcctcctgtgggatgtagattgcaaactttgcatagttgtggattatctttcaatgaaaagaagggttggacataaggtatttcactccatttgccttccctcttacagaaaaggtcaagctgcaggatagtattgtaatttatacttccctcaggtggccatttttccccatcagagagagaatattggggccagaccatggtgcagaaaaaaatgagccacttctttttcaaagtttgtgggtcaaattggccccaatggcttaggatgcatttcaagggtgaacctgttgatgcctgagtgtttcccagctgaaaaaaaaaatgcccgtggttttgatttgtttgtttcccccccccccccgagcaagaacctgcaatggtccctggaccctgctgatcagaatagttgtgctcactgatgcagtagcagatccccctcttgcccaagaacccataacagtccctggaccctgctgatcagaatagttgagctcaccaatgcagcagcagaaatgctagttttcctcctagaccacaaagaggaccaatgaaggtcagatttagtggcccttaccaacacattctcgaagacctgcacccttgtctttcctcttagaccacaaacaggacagaaaaatcggatttagtgacccttactgatgaattctcaaaacctgttagagtcctaagcattttcccctgttagtactgggaccttacctttctcctataagatgatatgcctcaaaatggagcagaggaccataccatgagggagggaagggatctccagggttggaggagtgatgccttttgtccacacttctcatcatatgaataggaaggatataatttctgagaattcccatatcctagcttcatgaatagcctttgttaggcctgctagtctgagaagggatcctaaaattccagatagtccccagcaacagggccttgggcaaaaattatatctttctaattggtgatcccaggtgcctaaagaagggaacagagtcccaaaatttatactagaaatcattcttataggagaaactagaagagcaccagagacaggagtggtttttagaagcatgactagcctcagagaagagaggcagaaggaagtttgtctgacaggcattaggacccaggaggcaagggtcagaacagataggacagatgggcgagtctcacttgggtgatgtaactttaagagttccacttatggctgcagggccaaccaactttttttcgggacccgagagctgaatggcttccctctctgttgaccctcagctcagtccagaagtataggaaaagcagaagctggttccaggcaaaccaatgcttccaactctgaagagtcgggggtggttagagagccctttcccagaaaggctgacacccatgtgtttagtccagcggctgcactagtcacttttaactggccaacaggtgtctgatgtttagcctccgaattctaaggaaaaataggacagaacagcaagcaaaagggttctgatggtactcaccacgtggcgataccccggataagcccccaagatgtgtctggagttggttccttctggtgggttcatgatctcactaacttcaagaatgaagccacgggcctctgtggtgagtgttacagctcttaaaggtggcacagacccaaagagtgagcagccgcaagatttattgtgaagagcgaaagaacaaagcttccacagcatggaaggggacccaggtgggttgctgctgctggctggggtggccagcttttattcccttatttgtcccctcccatgtctgtttctgtcctatcagaatgccttttttccaatcctccctgtgactggctactcttagactcctgctgaatggtccattttataaagtgctgattggtccattttacagagtgctgattggtccattttacagggtgctgattggtacatcttacacagtgctgattggtacattttacaaacctctcactccctacagagcactgataggtgtgtttttacagagtgcagattggtgcattttacaaacctcttgctagctacagagcgctgattggtgcattttacaatccccttgtaagacagaaaagttctccaagtccccactcgacccaggaagtccggctggctcttcacctatcagtagcagtggcaactcagacaatacaccctgcctatttcttctgcaaggagcacagcagaaaggtcaaagaagcaagcgctaagatttgacttatatttatctgagaatgatgaggtaatatatctcttgctaactactttttagatacaggaggaagatagagcaggcatctctttgtcacttgctaactactttttagatataggaggaagataaagcaggcatctctttgtcacttgcttcttggaaagcccagcatgaagtacagtattccaatgatagagagccatagtcttatccagttctgtccagagtcttatacatgcatatttattgtgctcataaaagtttaaaactcccttgggcacttggcactgaccattacccaatacagagcctctattttcagggagtttacagtgtggcacactatatcccttcaatcagaactagatatttgttaataggaattaaagaactcctctctttccaaacatgatcacaacccccatgtggtctgaaccttaaggactacactttggaactcgtggacaaactctacatttattactgactcaacctgcccaaaaacatatgcaaaatttcaatttaattgtgtctctaccctgcctaaaaactttcgatgacacagatttgcccaaggataaatataaaactctttagccttgagttctgagcctttaataatgtgatgagagatgaacagatctgccatctccagctccagctctgctcagaagcaaggttggtcttcacatcactaatcattaaactattagtaggtggtcaataaatattttatgcaaatgaattgcagagtgggataaaattagcacagtggttaaaaacatgggcttcctcttcacttacagaatgtatacttttatgtgtacatattacatttcaattcaaaaagtttttttaatgagttctcaagcaactttgggtaaaaatctctattttgccactttctggtaattatattgagcaagtcatttcatactttatctctctaagattcatctgtaaagaggagacattatattacccagtattgtggtgaggatttcatgagatacatgtgaagcacttagcacagtgctgaacacccaataagagcttaacaaatactggttacagttgatataaatgaatgaatatcaatttccatctaaactctggacatttcttccactaattgagcacatgctatattcaataaccatggtagatattgttccagcaacgtattggttaaacccctgctgatagcttgagtcccttctaacatctgctgtacaagtaataatatttttctctctcgggaaaaagtagatagaaaactgtaattgttgtctcttttcctgaagtaaggcaaagatgtctctatgcagctttcccagaggtaaatattgcattgtataacagatggaacagataatgctggcaaattcacatgtgaagattctatctacaacagctgctattaaacttcagcttccaccttaatcactattataggttgaattgtgttcctcaataaaatgttgaagtcctaatccccagtatctatgaatctgactttacagaaataggagttaacaatgatcaaattaagatgaggtcattagagtggctcctcatccaatatgactagtatctttataaaaaggggaaatttggacacaaagagaaaagacaatgtgaagacacagagaaaaggggccatgtgactggaacgaggcatctacaagacaaagaacaccaaggattgccaacaacaccagaatcccagagaggaaaaaaggatccactagagcctttagaagaagcatgcccttgcagacacctatatttcagacttctagcctccagaactatggggtgaatctcttttgttttaaccagtttgcgtacctttttactgaagccctaacaaactaatgcaatcaccgttaccaataccccgtttggggctgacaatctgcagtgatttaaaagctcctgtagcatatggccatcatgtagggcttgtgcaaacggcatgctcaagagtgaggctaaatgataaactgtgtgctttttaaataaacagtatagtatcaggcattaaggactagctggagagagatgaactatcaaacttcagcactgcaaaagcctcgttaaaagaactactcagcaagagagttttccttgagaggtttttaactaaaaggttctaaattaaagaggttctaaaatgatgtagaacatagattttcaataagaatgagacaaatgccaagcatttagatgtgggagaggtgagaatggaatacaatagggattggcaaactatggcctgcagaccaaatctgccccccaccccatctgtttttgtaaagttcaatggaacacaatatgctcatttatttatatattgtctatggctgtttttgtgctacaacagtaaagtcaagtcatccttacagagaccacagggcctgcaaagcctaaaatatttactatctggctagttacataaaaagttgactgaaccctagagtgggaaaatgatctatatcaatggttctcaaactttagtgggtaccagaatcacctggaggccttgttaaaattcagattgctgagtgccctagattttctgactaaaaatatctgggggtagggcctgagcatttgtatttctaacaagttccaatggccacactttgagaactgccgctttaagtttatgctgaccaatgcaccaatttaagcgtgatgtaagacaggagtggggaataaggaagggcagttaattttaaaattgcatttgattttgaaaaatgaacacagttggaagatttacactattgatttaaaacttcctagtaagcaacagtaatcaagacagtgtagtattgtcaccaataacagacaatagatcgatgaaacagagtagagagtctgggattaaaccatcacatatatagtgaactaaactttgacaaggtgaaaagataattcagtgaaaaaagaattgtcttttcaacaaatgatgatggaacagttggatatccattaacaacaacaaaaaaacgaactttgattcattccttacaccttatatttagtacaaaaaggagaatagccagctttctcttcatggtttgtaggaaaaataaacccagaagcagatgaagtcagtcactgttgcatgaactacatgtcaacatttttataagatggaaaagttgaaaaagtttgaagaaggtggcaatgtagtgctctatgccattcacccaaactctgcatttgcatcagaagaatactgctgagactctaacacgaagacttcaacagaatcttaatctcaaattcaaattttgttaaaaagaattattcgatgcccttaaggagagaggatactttatggctgaataaacaccttgctccttataacagtttttcacccccatcatgcagaattttgctaactactaaggattttgccaccatcagcagcaaggagtattgcagatgctctgcgatctataccaggattctctaatacacaaggaaatcccctcatcatgcatttgacaaaatgatggtcagcacacatgagtctataagtaggtctccagaacaggcgataaatcaaaaaggaaagggtaaattaactttttgaggtggtggttagctaacagttagacttgagtttcatagatgtgtttacatgggccaaagaaacccaagggtcatctgaatcattcaggccaaatgattacatctaaattagaccagacaattatgtcaaaaataaattaatattttttattgtttacttgcctggacactgaaatacaagtgtctctattcttaggagaatctgaatgtagatgagaaaatagataaccctctgatatggaagcacaaagaggcagtactcaacattgccctggcccaaaaggcttcaaactaacagcaagttttaaagaatgactgatgttccagataaatgggcttgtgaggtggggaggagatggagttgtaggctgggaagcacatgctacacacaggaacagcatgttcagaggtaagaaaaagcacaagctaagttcaggaaaaagcaagttcttccatatacctgaaacatcaggtaccagaaggtgtagagaggaatgagacagtagtccaaccacgatatccttctgtgccagtcagaggaaagcatactccaccctttgaggcaccttaaatcacttttaagaagtgatgctatcaaatgtatgttttagaaagatcacattgaaggcaatatgacgggttgaatgtggcaagaactgaggcagagactggttagaaagtttctgtaggaaacagacttcaaataagacagtagccaatgcaagtagggggatggaacgaaaaatacttaaatgaaatcttgatttgatttcaaatatttagaaaattcaattagcaatacatagaagttgattgaactttgcagacaaagggaaagagacgttattaaagatgactcccagatttccgttttggggaaactgagtgaatagtggtgtcagtcccacaattaaaaatacaaggagagacatgcaggaaatatgataagcttgattttagacacgttgagtttttaatgtctataaaatttaca

SEQ ID NO: 14 - DNA, 280542 bp, Homo sapiens
ggatgatgcgctttttatagcaatgtaacacaacaaaatgtgacaagatatggagcagaaaaaacagatataaaaattacttcaagggtgcagtgctcactcttgtaatcccagctgcttgggagactgaggcagaggaatacttaagtacaggagtttgataccagcctgggcaacatagcgagctcccatctctaaaaaaattatttttaacttagctgggtgtggttgcatgcacctgtagtcccagctacctagaaggctgagacaggaggatcccttaagcccaggagttcaaggctgcagtgagctatgatcatgccactgcactccagcctgagcgacagagccagactttgtcacaaaaaaagaaaaaaaaaattactttgcaaaaaaaaatctacattctcaattatccatttcactgatactaggtgtacatgctgaagctccttaagaagattgtactgacacatgaagtattcacttttaagcatctcatgccaacttatttatttgttgtctacagttgatatcttaaaaatcacatgcatggcaaattgcctattggctatggaaattcaaatgttcatgagcaattataagcatcttagcaaatgtgctcaaattctatcaaaaaagaatagcaaaattgtatcatggattttctaattcattaattaatctctaaataagtctttattgagctcctaccatttgtcaggggatacaagaaaacaaagcagacttgtttcttgccctctttgaatttatgtttttgaaggacaactagataataagttaaataattagttaatttcagtttatgataagtactataaaaaataagagtactgagataagaatactttgtgtgagagagagaaggtagcctattccttcccccgcctccccaaccctccctggcccccacccacggctatctacagcacattctagatcatgctattatgaaaagattcagtcccctggtgctggctttgtagcaatagctgactgtactctgatgaggatgctttgttacttaaatatcttcctagcagaggactcacagcagttttcaaatggcatttccattcatcactgcagcactcctgagaggcaacagaggttcaagcctcattacttctatttaagaaagaggaagggcaatgactggagaactaccctctgccaaatattaaggagcaaagcagctgtggggttgatgttgtggctcagctcagatccccctgttgctagctttttacattagaccatttaattctatccttcagtgtaagttgggaactaacatatgcccgaaggttttagaaataaaccaactcaatcccaactcaacaaacagggcatatttgttacgctaagtaaattgttttcaataattattaatatgaagtttatttgcctaaactcataaaatttcctgtgtgagaaaatctagtcaacagaatcacaaactgaataattttgttgactgtttcagctggctttttcttcctttaaaacaacaaacaagtaaccttacaatggaaatttctttcacatgaattcatgaccacatcaagtggaatttgttataaggcagccatcatgagccacattcagaagaacagactcagttatttaaatactcaaagaacatatgagaataataaattaatgttctggaagggttaaagaagaatcacttatatcaagcccttaacattccagacatggtttaaagccaagaaaagtgaaatcacttatcaaaggtctcacaacttttgagaaagactcaaattctgttttctttagtccaaatcctgtgctctggtacaggtattaggaagtctccttaatagtcagtacatccttgggtttcccaattgacatatatagacagagatatcttggcgtaagaattctgagggcacttcacttatctcataatgacacgatccatcatggaggtaagcaagcacaaagacccaatgactcaaaacaccgtacaatttttgtgcttttaaaattttataataattttaaagacattcaggaaaattacaagaataatacaaagaattctcatatactttttacccagatcttccaaatgttaacattttactacgtttgtttcatttttctctctgttctgaactctttaagagcaagttacaaacacgatgtccatttatcgttaaatacctcaatgtgtaattcctaaaacaaagaatgttctcttacatgaccacagtacaatttacaaaatcaggacaaataatatgaatataatactattatctaatctacagcccttatttggatttatctaattgcctaacgatgttctttatagcaaaataaaaaatctaagattaagtgtttcacttagtgttcatgtctttttagtttctttcaatctggaatagttcttgagtctttctttgtattttgtgacattgacatttttgaagagggcaggccaagattactgaatgtccctcaatttggttttgtcagatcttttttcaagattagattccagctacacacttttggcagaaatatcacagaagtgatgctgagttcttctcggtgcatcatatcagaaggcacatgctacagatatatcccatatcccataagccaattaggtcatttggttaaggtggcatatcaggtttctccactataaagttattcttttaccctttgtaattatctcgtgagggaaatgctttgagactatgtaaatatcctgttactcctcaaactttcacctactggttttaagagtcattgaatattcttgtctggattagttattattatgatgtttgccaaataatgatttgataatttcatcttcctttctatatttattagttggactttgactataagaaagagttttccattttcatttgtttgttttttgtttatctatggactcatggattcttataacactttattcaatacattataatcctttattataattatttattttggttcaccagttgtctcagatttggctattgggagttccttcaagctggcacctgtgtccttttgacctgtccctttgtccatcattatttgagcactcaaagaaattcactcataagaatttatagaagttaggcaactaagctataggaagcagaccctgagaaaaggatccaaatacgagtatttggatttgggaggtaattctgggagccatggggaaggaaatgaggcagtgaaatgggaaagggaaggaaatcaggaaagggtatttattgagcaagtaaccaatatgaacagctagggctaaatttcacttggagaccgtgaaaaccgcagaacatatgcttcagttacacacttaaagaatgaggaaactagaatattcatacattgtggtaagcagaataatgtccaccacccaccaaaagatgtccatgccgtaatctccagaacctgtggatatattaccttacgaggccaaaggaactttgctgacaagattaagttaaggacattgatactgagatggtgagattagattggattagccgggtgggcccaatgtaatcacaagggtccttaaaacagggaggcagaagagtcagagtcagggaaggaaatgtgaccgaggaagcagaggtcagagcaatatggagccacagaccacagaattctagaagctggcaaaggcaagaaggcagattcttccctccagaaggaacacacccctgccagcctgttgagatagcctggcgggacctgtgtccgacttctgacctccagaactataagataataaattggcagagtttgaagccaccacgtgtgtggtagtttgttacagcagcagtaggaaactaatacatatgcccactctcatcagccatttttaaaggaccgtttcggggatgtttattcaccagcacttccactctgcaggctgtgactggaggaagcctcaggcaaagagacacaggtgtagacatctatactcagactggtgtaaattcaacaacataagggcagagcactgactgcctgtactaccagacttcctaatcccctccaaccctgtcttctgttacaacaattcagtcatgaaataagcagtgaggagcattaccgaaagaggccaaagcagcacactttgatgtgtctctctgtggatctcacctcaacgtgttactttcttgctgtgggttcttggcaatttgagagatagaggaccttgtctattatgactaaaaaaggccccagagaaagatagaggcttataaaattttggtatcattggtaaaacttagcttcatcatatactctgcaatatttaacatagttaacaactatcacagataagaccaaaggtcagtttacaaacatctacactgcaaacccaagggaaagtgaatttatactagaataatgaaacactataaaaatgttctttaaaaaacttggagaatgttattttatggaattctctatagaagaaaatacaggatgtaagcagtatgtaaggaaacaattcaaggagaaatgaaggacaagatgggtttgaaatatccactaactctcaacctctgatcactaagtcagatgcccagtgtgaatccctgaagttccttttgagcatcctctgcttatccattgtgccttcttctacattttgccttcattttacatgcatggcaggagggaagtataatagtgagatagaataggcgggctactcctttattctaaaggctgtaattcttacagcaaccaatatatgtataaaccattgtacttgtccaaaaatgccaataaattttaataaataaagcatgatcacttccagaaattcctgaaagagaaagtgcatatttgattggaaacttaccactgaatctagtttctgtttttaagtcaattaagttcatgttattgtattagtccattctcacactgctaatgaagacataccagagactgggtaatttataaagtaaagaggttgaattgtctcacagttcagcaaggctggggaggcctcaggaaacttacaatcatgatggacggggaagcaaacacatccttcttcacatggtggcaggaagaagaagaaagagagccaagcaaagggggaaaccccttataaaaccatcagatctcgtgagaactcactcactatcatgaaatagcatgagggaaactcccccatcattcaattaccccccatctggtccctcccagaacacatggggattatgggaactacaattcaagatgagatttgggtggggacacagccaaaccgtatcggttattatctacccaacaccagcctgactctacatgggggtttaagaaaagtaaagagcatattgtccgatcatgttattctcctgcttaacaacttgtagttatttcctactctttataggatatagtctatcattctagggatactatattaggcccttcacaatttgacccctgtccacagtcatcagccttatttctcaccattccccaagtggctcccttattcttcctcccatctcattctcataccttcttaccttgtatactctgccctcagccaaaccatcctccttcatgcaccatgctgctgcaaatgcccatccctctgctgggatgccttttgcctcccagctcctgcttggaaacttatttgtacgtacagaagtctgggaggattctgtacacaccttcgttaatgctcatgcctgtaaggatgagttttcaagggactgagataaggatgcttcatgcctgagcccttgagatgcgaacatattcctcttcatacttcagtacctagtacatgtgtggcacatagaaaacattctgacaatgtctgttatatgaaggcaagagtaaatatttcaagagatgtttaaaatctaatttggaaggcaagaggcaccttgatctagtatccaaagtcttagtctgagtgtgagcagatctgccctctaattctggtgctgccacttacctgctgtgtaactttaggcaagtcatttatatgttccaggcctcatcacacttattccaaaattgactacatagttggaagttaagcactcattagcaaatgtaaaagaacagaaattataacaaactgtctctcagaccatagtgcaatcaaattagagctcagggttaagaaactcactcaaaactgcacaactacatggaaacggaacaacctgcttctgaatgactactgggtaaataatgaaatgaaggcagaaataaagatgttctttgaaaccaatgagaacaaagacacaacataccagaatctctgggacacatttaaagcagtgtgtagagggaaatttatagcactaaatgcccacaagagaaagcaggaaagatctaaaatagacaccctaacatcacaattaaaacaactagaggagcaagaacaaacaccttcaaaagctagcagaaggcaagaaataactaacatcagagcagaactgaaggaaataaagacacaaaaaacccttcaaaacatcaatgaatccaggagctggttttttttaaaagatcaacaaaattgatagactgctagcaagactaatgaagaagaaaagagagaagaatcaaatagatgcaataaaaaatgataaaggggatatcaccaccgatcccacagaaatacagactaccaccagagaatactataagcacctctatgcaaataaactagaaaatctagaagaaatggataaattcctggacacatccaccctcccaagactaaaccaggaagaagttgaatcctgaatagaccgataaaaggctctgaaattgaggcaataattaatagcctaccaactaaaaaaagtctaggaccagagggattcacagccaaattctaccagagataaaaacaggagctagtaccattccttctgaaactattccaatcaacagacaaaggaggaatcctccctaactcattatatgagtccagcatcatcctgataccaaagcctggcagagatacaacaacaaaaaaagagaattgtagaccaatatccctgatgaacatcgatgcaaaaatcctcaataaaatactggcaaactgaatccagcagcacatcaaaaagcttatccaccacgatcaagttagcttcatccctgggatgcaaggctggttcagcatacgcaaatcaacacatgtaatccatcatataaacagaaccaaagacaaaaaccacatgattatctcaatagatgcagaaaagacctttgacaaaattcaacagccccttatgctaaaaactctcaataaactaggtatcgatgggacatatctcaaaataataagagctatttatgacaaagccacagccaatatcatactgaatgggcaaaaacagtttccctttgaaaactggcacaagaaaaggatgccctctctcaccactcctattcaagatagggttggaagttctggacagggccatcaggcaggagaaagaaataaagggtattcaattaggaaaagagtaagtcaaatggtctctgtttgcagatgacatggttggatatttagaaaaccccatcatctcagcccaaaatctccttaagctgataagcaacttcagcaatgtctcaggatacaaaatcaatgtgcaaaaatcacaagcattcgtacacaccaataacaaacagagagccaaatcatgagtgaactcccattcacaattgcttcaaacagaatagaatacataggaatccaacttacaagggatatgagggacctcttcaaggagaactacaaaccactgctcaatgaaataaaagaggacacaaacaaatggaagaacattccatgctcatgggtaggaagaatcaatattgtgaaaatggccatactgcccaaggtaattcatagattcaatgccattcccatcaagccaccaatgactttcttcacagaattggaaaaaactattttaaagttcatacggaaccaaaaaagagcctgtatagccaagacaatcctaagccaaaagaacaaagctggaggcatcatgctacctgacttcaaactatgctacaaggctacagtaaccaaaacagcatggtactggaaccaaaacagagatatagaccaatggaacagaacagagccctcagaaataacaccacacatctacaaccatctgatctttgacaaacctgacaaaaacaagcaatggggaaaggattccctatttaataaatggtgctgggaaaactggctaggcatatgtagaaagctgaaactggatcccttccttacaccttatacaaaaattaattcaaaacggattaaagacttacatgttagacctaaaaccataagaaccctagaagaaaacctaggcaatatcattcaggacataggcacgggcaaggacttcatgactaaaacaccaaaagcaatggcaacagaagccaaaattgacaaatgggatctaattaaactgaagagcttctgcacagcaaaagaaactaccatcagagtgaacaggcaacctacaaaatgggagaaaatttttgcaatctacccatctgacagagggctaatatccagaatcaaaaaaaacttaaacaaatttacaagaaaaaatcaaacaaccccatcaaaaagcaggcaaaggatatgaacagacacttctcaaaagaagacatttgtgcagccaacagacacatgaaaagatgctcatcatcactggccatcaaagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattacggaagacagtgtggtgatttctcaagggtctagaaccagaaataccatttgacccagcaatcccattactgggtatatacccaaaggattataaatcatgctactataaagacacatgcatacgtatacttattgcagcactattcacaatagcaaatactttgaaccatcccaaatgtccatcagtgatagactggattaagaaaatgtggcacatatacaccatggaatactatgcagccataaaaaaggatgagttcatgtcctttgtaggaacatggatgaagctgggaactatcattctgagcaaactatcacgaggaccataaaaccaaacaccacatgttctcactaatatgtgggaattgaacaatggaaacacttggacacagggaggggaacatcacacatcagggcctgtcatggggtggggggaggggggagggatagcattaggaggaatataattacattatttacctaatgtaaataatgagttaatgggtgcagcacagcaagatgacacatgtatacatatgtaacaaaccagcacattgtgcacatgtaccctagaacttaaagtataataaaatacataaataaataaaatgatagacttggacaaatgatgtctaagctctcttagttccaactttctaaaatcttagcattttaggaaatcttgcagccccaaaacctctagacaccatgaaatcaaatactaaattgtgtaatctagattcctatattggtagttcagaggaagagagaatggatggggaattttgcagaaataaaaagaaaacatcaaatgcggctcttccatgacctgctaggatctgcttctaccaaatcatggatatagaaataggcccagctgcacaccactctttctaattatcctgttcttccaattcctcttttatgcattttttttgcccactctctctcgaaacacagtagctctgggagttgaaaattaagttttaatgaagagattaaaagaagtaagtttattcctaaagaaataaaattgagagacagcaaataaccgtactgatgtaagaatagatggcagacttctgcactgcacattttcagtaaatcctatttttcacaaaaatgatttgcaaagctggcatcttgaaacacgagagatgcccaaaatgagagttctgtatttaaaacccccattttagtagctgcattcttaggattatgggctctggagtcaaactgtctagggtcaaatacaggctctgccagttactaactgagaccttggacaagaatttaacctcatctgcaaagctgagataataatagtaattatccctatgggatactactataaaaatctgaaagaaaatgaatgtaaaataaccaacacagagcctgcttataacctatatatctagccaacatttatcaggcatgttctaattttgaggtactgagctagcctttggagatgcaattataaggaagactcatctttccccataaggaatccatcctttaataatgaaaacacctatgttccctactataatatgatgctatggtcaatacaaatataactgtatatgcagaatgccttggagagggaaagcagagactgaataattcaatgaagacaatgagaaggttcaaaaaggagattattttattactggtcctttaagaaaagcagaatgtcgctgtttggaaatgtaaggatgaaattccagttgacagagcagtacagccaaaggacagagatgtgtaagtaaattgtgtgttcttggacatgcagatagtctggcatgactacagcatggatttcaaggtggggagtgttagaaataaggctgtaaaggtaggcttcctctaagtagtggcaaattgactgattgattcagcaaatatttattgagtacctgagttagatcagagacgtactattatctcaatttacagataccaaaactaacattcaaaagattaaatggtttgctcaagggcataagcaaattctcctttcagcccgcttttttatttcaatttttattttagatgcagggggtacatgtgcagggtacattgtgtgatactgaggtttggggcacgattgatcccatcacccaggtaatgagcacagtacccaataattagtttttccgccattgttacccttcctcaccccctcttatagcagtctctggtgtcttttgttaccatatttatgtccatgtctattcattgtttagctcccacttataaatgaaaacatgtggtatttggttttctgttcctgtgttaatttgcttaggataatggcctccagctgtatccatgttgctgcaaggaacatgattttgttcttttgtatgcctgcatggtattccatggtgtatacataccacaatttctttatcccatttgccatttgtaggcatctagattcattccctgcttttgctattgtgaacagtgctgcaatgaacatatgagtgcatgtatcttttggtagaatgatttatgtttctttaaacatgaaaaaaatgatcaacatcactaatcatggagaaatgcaaatcaaaaccacaatgggatagcatctcacaacagtcagaatggctactatgaaaaagtcaaaaaataacagatattggcgaggctgcagagaaaagggaacacctatagactgatggtgtgtatgtaaattagttcaacaactacggaaagcagtttggagatttctcaactcttgaatagaggacagataatccactaggccagcctgggaagaagtcttgtttgggaaatctaggaggccttcacttttggtgacacctacctgaattacaagtccagtatctgcaaggaaccaaccagttcccaatctaggaatgaatgtactttgcaaagtacattttgctgagtaaagataaacatcacaatctgaatatcactgacaatagccgaaacttaccagttacatcctacattcaaggcccttagtgtaaattatttcctttaatcctcaccacaatttgataaaatagattaagatgccatgcaattggaaggattgctactattaactctgtcacacagatgagaacatggagaacaaaaatagatttagtgatttgcccaatgtcacactgaaagtggagaaaggtaggttggatataggttttctgattctagaactgaaaactttcaccaatgggccatgttccctctggcatctctgcaatcatgtggcttcacaaccttgagacccaggaatattataagaacacaatttgttctcaactgacaaaaaatcatgagcagtgccaactctgtgtggtgccaacccagctctttcccctgacccagtggggaaaaggtatttatggtagttaggtgaagataaaggcatttaaggaaggaatagggttctaaggcatcctatgcttccttctacttaaagacctttctcctccccccttctataaacaccccaagatctggctttaccccttactactagttcttattacaggcttctacagatccctgtcactccccattattcctggagatcttaggtcctgacttactgctgctttctccagtactactcctgtcatcattcctgatgtgtttaatattgatgtagagaatccttccagttgcatggcatcttaattccttgacttccttcctgtcttccaatgaccttgtcccacacacaatctcagccacttacccaacagtcattctctggacctcatcattcctaacaaccctccatactctcaatttcaaatattccactctggaaagcagatccattgcctcctatgattcttcattcccaaccaggacaagcagtccactattctaaagccattttcctgtcctttaaacctcgtatgtcctcacttctttattacccagcttctatgtcaggtgtgtcattccttgatgtgtatacaacccccacttctttgccctttattgttttcatattctccaaccaaacgctactctaggtaaatccaactttttaccaaccctgaatttatacctgtgtagctgaaatggctggggaaagaaaactacaaccattagaaatgttctgcctttaagttaacgattgtgaaccccaaaagggttatagcagtacccagtaatcctactgcatcccccagtgcattccctctccccgtttcctaagagaggtatttcacgctttctgtttcccctgacatcacaactcctcccattcccttactcccagctaatgaatgccctttctccttatttcatggagaaaatagacacaatcagaagagaaattctgtatgttctcatagccacatctaccctcccacctgcatttgtgtccatatgccctgccttccctcctgttactcctgtttgcttcctggacttgtccttgcttctacctaaattaattccccacaattgtgcagtagatgccatccactcttgcctacttcaggatatttccctagcaattggtccctctctttcatgcataattaaattttccctctctactgaattatcctcgtcagcattcaagtgtgctgtaatttcttacatctcaacaaaaaaaaacaatcttgacccacttttccctctagctaccacctcatttctcagctgccctttaaagcagactctctagtttatcccctcccataaatccacttttgaatctacttccctgaaactgatcttgaaaaagacaccaatggtttccatgctgctaaactgaatgattttgctttaaaggcctcatcctacttgaaaggtgagcagcatttgacacagttgatcattcccgcctcctggaaacagtttcttcccatggcatctgggactccacaccctcttgattttccacctgccttacagaacagtctttctcagcccttttgctggtttctccttatctccccaaactcttcgctgtggagtactccaagactcagtccccacacctccacccacacacactccagtctcagggctttgattgtcaccagcacattcatggttgaaatttctacctccagttcacacctctctcctgagttctagtctttaatatgcatctgtaccctcatttctaataagccttttaaggttaacatgtttgaagctgaactcctgatttttccccaaaacgtactctacccccaaacttccccatatctgttaaaggcaaatccaccttcattttgtctgagtctcaaatcttggactcatcctggcctcttcttttcccttcatatcattcatctgctctactggcaaatcccgttggctctaacgttggtgcaaaatcagaatccgacactttcactacctccaatgacacaaacccaatccgtaccaccatcacctctcacttgaaatattggtgaattctcttgcctctgccttaaaaatatccagactctgattggtttggatcaattcactatcatctcttgcctggttgactacaagggactcctaaatggtccccttgctcctgcccttgaccctaagctagaatgatccccttaaatgtaagactaagcatggaattccctagctcaaaaccttccagtgatttcccacctcactctgagtgaaagcccatattcttacaactgcctttgaggcctagttgtgctcctatcattgccagctacctctgagacttcacgacctccaattctctcagtcagtcctctactcttactgtgccggtcttcttgccactgttcaaacacttcacaccctctttcctctgaaagcctttgtgcactggttagttcctctgtctatccaatagaactctctatcatgatggaaatattctagatttgtgctgttctagatctgctctagatctgttttaggtacagtagctaccaggcacctgtggcttttgggcacttgaaatacagccagtgcaactgaggaattgagtttttaattgtatgtgttttatttattttaaatgtaaacagccacatgttgctagtgcataccatattagacaaagcaggtctactgtgctcttccttgagatatctgcatggctcattccctcacttctttcaggtatctgcttaaatgtcactttaatagtgaggctttcctgatcaaagtacttaaaagagcaagtcaccgccacctggcactcttcatccaccttccctggtttgcttaatttctccatagtaattagaaacataagcatactatatgtttttgtttgctcatttatttgtaatctatatctccaaactaaaattaaaagtccatacaggcaaagattttagtctgtgttgcttttgctgctataccaccagtgcctagaaaaatacctgggacatagagctcaggaattgcttatagattctaaaatctcctttccatcactaacttcttggctggtcttgcacaagtaatggtccatctcttggtttcagcttttttctttctcctaatgtcctctaatattgagccctgtttgtttccttcttagtacttacaacaatttataaattctgtttgtttacttgcttattgcctgtctcctcactgaactgtaaactcccaaatggcagtgactatgttcttcttattaatctaatgtcatcattgctcaataaataaagagtctttctgggatgtgaggcaataaaatctgccacccaataggtgttcacccagtatttaagatttgcattaattatttaatattcaaagtgaagagttttaactatttggaatgtaatcaactagttggattagaggcctactatctaccactgtatcagtgagaaaatgtagttatattaatccatatttggatgcttttttaagatctgtaggatgctactgaataggtgtccaataaggatttgttgaagattgcattaattatttcttcttcaaacatgggtcaacataatggcacagacagcagaaaaggccaactctagagtgccatactcttgtagaattgtgggctctgaggagccctggaggctgggagggtcctcaggaagggttggcattgtgcccacctgtcagatgtgactgggggcctacaatctggcatttttccattttttcactctcctggctggtttttgttgtggtggtgttttgtgatagtggttttgtgaaaaggctcgggagggcatttctgcactgttaatacagccatcttcgtaacacctgccacctgtgttaaacggccaccctgcccagtcccttgccctcattcggcccccatccacagctccaatggggcagttcctattaaaaggcccttcctttctttactacacgaagcattagaactcggcagagacaggacactaaatcagcagtaaacttgtccattcacctttaacatttcaagtccataaagtatcctttactgctagcagagagtggggagttttcctattggcttgacataattttttacagggatttaacattttcgaaaagacatccgctaagctctcaatagatcttccataaaaaagaactgagttctaagattatcacctttggttagaaacccagtttatcagcatcagtattatcacttgcttaattgtttaaaaaaaatgtacaatcacctcccagtcattttactttaggaaaagttacactgggcctcattttgatatcttccaaagttacctttcttcttcttatgaccttaatacttctagcaagaatcaataattaaacagatatttgtgatgtgttttttttagtgtcaaaatttaactttatacattgctaagttatgtttctaattctgaactgaggctctcactttttatcgttaaacctgtctatcaaaagctcaaaatttcaaggagcctaaattttgtctttgatgctgtactgatgaattgcaatgtaaattttcagagacaacagaaaaggaccatcacttatacatgtccattttcaaagggtaatttctgcagctctccctcttcactctgagagtctgagtgacagtctatgcccttggttaaccaacctcagggatggttgttagcacttccagttatttactgtcactaaagtgaaagccgtctttaaaaaatgtgtccttataaatccagcaggaaatccaagtttcctattggtcctccttctgattcttctctgatttcttattctgaaaaattacggatagtagtgtactaattaagtttttaggagggagacccttaatgatgaattaagatagcatttttgcagtgttgctaagtggctttagtctacaatggactcagtgatcccaaaataaatttaatcttgtctctcactgaaatagttgaaatcttggtgcacaatgtaaatctggaaaaaaagaaaaatacctgtggttccagctacttgggaggctaaagttggaggactgcttgagcccagaaggtcaaggctgcagtgagctatgatcatggcactgccctccgtcctgggtgacagagtgagaccctgtctcaaaaaaacaaaaacaaaaacaaacaaacatagaaagaaagaaaaatagataaattacagaatgtaattaataattaggatcttcttattttcaagggtaataatataaattgaagttctaacagtattgccaggcagagaatggatcaaacctactataatgaaaactcaaaaaccacctgtaattagaaaatgaattttcttatatcacatggaaaaatttgttcttttccaggcaccacaactcatcacaaattccttaaaactcatcacaaattgtggggacaagtgcctaaggttttaccttactttgcattagcttcttggtaggtttcctaactgaatcggctacccaggagacatttcaacccccttagcctgacacagggaaagaacagaaggtggggagaaagaactggggaggcggaactgtcaatgagtaaattcgtatctggcagactacacttatttagcatgtctcttgagctttttttttagtttatattcatgtaacacatcaggacagggtcaagagagatggtatagtatagtgaaaattaccctggtttcatcaggagaccttgactctagtccctaacaggctctcactgccctgtgactcagtgtcaacatctggctgccatttccctcatctactaaattagagaggttggaaaatctattctctaaaagtctcttttgaccctaacattccatgattcaatgaaatataattactaatgtaaaaatacaagataattcattcaatcaaattatattgcctcaatctaaatgattttgcgtttcaaagttcaaatgtaattacagagaaatgaagaggacagacatgagttgccactgaaagctaacaggcatcacaggcagcagctcgctttctggaaatgcacattgacaattagcaattaacgtcttctggagacaagcaaatgatcaggaagcctcttggcagaagggagtcataaagtttcatcgtaccacttaacagatattttatcatatgataaattaggtacttttccatccactgtaataatatattccctacaataattaaaggtgattccaggcctgatgcactctggctgggtgtgatcctgatcgtttgttcaatcagattttggtaggtttgtgccaaaaagaagaatagaatcatgatctcctcttttcttttggtgctcagaaacagaaaactgaaccctgcaaaaggaacacatgcttcaattatctgcaaagttcagccgtaggccttgacctcagacagggctggattcaggggatatcacaatgtcagtaagacacagtccttccctcttttggctctcctctgttctgtgttgttttattcccagattccacaagcagcaatgtggctgactgctacaagctctgagtctgcatcttcccaggttcaatttcagtgcaaatgagtacttgttttcctccaaagtcagaacaaaaatcctgagcctcattactactggcctgaattaaatcacatggtcaaatctgaaccaagcactgtggcccaagaatacaataagctgatcagcctggtcctgggtcccatgccagccctggaggtggtggggggagcagaggtcagccaccccaccacacacaccctgccaagtgagagtgagggtttcctcagggagtaaccttagctagaagctgggggatggcagagttataagctacagatctctatttcatgcctgaaataacatgagaccctagagtacagtcatcaacttagaaattatcctaaagatctgagtcccatctctttatgtaaggctgaaaatgcagagtcttgaagaaactgaggcagtgaagcatagtggttaaactcataggctttggaatcagacaacctgggctttgagttctgattctgccactttactagttttgtgtctctgagcaagttactttacagactggaacctggttctactcatctgaaaataggatgagttgtggtacccagctcacaggggtgatgtgaagattgagataatgaatgtatagcacttagcagactacctagcactcagtcaaataaatgacagccattactggtaaagagaggaaaacactggcccaaatgcacatagctggttcatggaaaatctggaactaaaatgggatctcttgacttctggttcaaagctagtagtgaatcaaggtgaaatttaatagcacacaagacagttatatccaaaatatcacagaaaacatcagtcttttttcccaaattgctacctggagcttcatggatcccatttcacagagccatataattttaacatcaccagaccttctttaaagaagtcaagacaggcctgtcattttactccgctgactatgaccagatgcattcaagaaagacacaattgacctaacaaacacaagttgagacccttgggaagatacggccactggtctcagcagccaagtatttgctaagaactctctgtgaatccaaaattgtgtggaatatgaaaatagaaaatacattctctgcattgaaaggccttactcttgttgggaaatgggtcaagtggatggtagagactaaaagtgttgaaagtgctaaggcagaagggatcgctgtgggaaatgcatggctgactggggcagatgtgattaaggaggacacaattgggaaagggactccaggtaaggagtgcagcattagcaaagactagcaagaagacaagtgggagagtaggaagaggagcacccaggacagaggaaggagaaggaaatcaagccaggcagtacaatggtggctctggattgaggactgaagaggccacacatgagtggatgaaggctcaggcatgcaaaactgtgaaagcaatgactccaagtcactcatctctttaaaacattaattgggtctccagttctttaccttggtccccaagaccttccctgtactgacgccatctcccacttcattcttccttctcctcatgcccacgactctgctcactctttgcaaaacgtgtctgagacactgcagtcttttctcatttccatgttccatttctcatacttaaaatgcatttcctctctcacgtctgcctccatagttctacagactctaatgcccaagtcatgtaaccctatttatgattaatcataccttgaaattgatgatagaaagtacagttaatgaaggccttccattattcactacctcatgtcaggagacttcccagagtccttcacattccaaactagtgatctctccctcctgtgagtcccatgtagtagtagcagcagaaataataataagagtgataataccaccatttaataagcactaagcactttacttatattgtctaatttaatatttataccaacttcatgaacagttctggcattcccatcatgtagataagaaaactgagactcataaggagcaagtaaattgcccaaggtcacaaaactagtaagtagcagagcaaaggttggaactcaaaagctaggttcttaatccattgtactatcagagaaatttgttcctctctaatggtatggattacatattgtctttgatagttgcagtagtcaccatttatccatggggaatatattgcaagacccccagtggatgcctgaaactacggataggacaaaaccctgtatatactatgcattttttcccctgtacatacatacatatgataaagtttaatttataaattaggcacagtacaagatttaccataataactaataataaaatagaacaattagggacaataaaggctacttgaacacacaagcactgtgatactgccatagtcgatctgaccactgagatggccactaagtgactagtggatgtgtggcagctacggcatggatattctgggcaaagggaggattcacgacctgggcaagatggagctggaccgtgtgaaacttcatcatgctactcagaacagtgcacaatgtaaagcttatgaattgtttatttctgaaattctccatttaagatttttggactgtgattgatctttggtaactaaaactgtggaaggtgaaaccaaggataagggagaactgctgtatttatttatgtcttaactccctaagacttcaaggtccttggtggtgtagagcatgtgttattcatctgtattaataataaataacatttgtctagcaaattagtaatttacaaacccctttaacacactagtgcatggaattcttactacaatctcgtgaagcaatgttcttgtttccacttcgttcataagaaaatgaaattcaaaggacttaagtgatataatcaaggacctattgctggtaagttgcacaacatccccacctgcatttctcaaccaaaatctgatggttttggagttgcttcataaataccccagctctctcactcttccagggagagagcagggaggtgtgtgttctacgctagttcccggagttctccggtaggaatgagcttcagttacccacagtggtaatttctttaatcgcacagcctttactgactccttctgtttttctcttccccacgtctagactactgtttcctgggatcaccttccaaatcaactacttgtactcaatttctttcctcagagtttgcttccagagaaaccaaaattaagacattcttctaaaagcactgtttctcctaatcggttggatgagtgaggttaaggaggaacctaaataaatcaggaatttttgactatgtgatttccattttaaatttttcaaacaaaagggagagggagctgctataaagagaacagtcatttaatagcctgcagcctgttaaattcattgcaagtccaaacttctgcttaaagggacccaggtatcaaattggcagttgccttggaatctaaaatagaattggttagtatggactagagaaaaatattttgcatttctctggttatttccattacagacagaaatattctgacacttgctcctttgctctgattacagcttaaggcaatttcagaaattcttaaattgaactggaacccccacttataccaagtagcatagctccttctcagtgtctcaaagccttagcatgaaatcaaggatttggatgtggtcaaggggtattaacagaaaaaaatgagaacaattaaatttgaagaaggagtgttcaaggaaacagagataaaaatgcgtgggcataaatgcatgcacagcaacccccaagtccgtagaataactaacgttgttttgagttcacagggcattttcattttttgtccaggaaattgtctgaatccaatggtggcttcattattctcataacatttctgggcctctccccagaggggaaagctgcaacacagaaattttaagtcaagtggcaaagctaggctgatgccttaaggtagatggtttatgaagattacttcaggttttgagaaagcatattcctcaaaatcttggcctaattttctattaatgaatgaggaagtactttcatatctaaaaaggtgctgtataactataaatatttttattttatatggtttgttaaatcatctgtccaggtagagtcctattcttaattggaggtcaggaactggttaggagcgctggttaagatgtcaaagatgggcagggcgtggtggttcacacctgtaatcccagcactttgagaggctgaggcaggcagatcacaaggtcaagagatcaagaccatcctggccaacatggtaaaatcctgtctctacaaaaaatacaaaattagctgggcatggtggcgcatgcctgtagtcccagctacttgggaggctgaggcaagagagtcgcttgaacacaggaggtggaggttgcagtgagccgagatcatgccactgcacttcagcctggcaacagagagagactctgtctcaattaaaaaaaagatgtcaaaagatgaaagatgatggtgactactttggagaagagaaggcttggcacggagctgacaggtggtgttcatctggccctacagctgagccagtgatagaactgagagtaaaaccttcatatcttcaaaaatccctgggatagcctggcaaagagtgagagattttgtaccctgtgactctattaaaattttgaatggtatcagattctaagagatctttattcagaggattatctcaacatgtgatggtttcatttattctcaggatatccctaatgggtaaactatggataaaagacagtacttttcccctccaaggaggaaacagggaagagaaattgcaagaaaactatcatggtcccaagtgggagtgtgaatggcagagtcatgaaggtctttttttttttttttttttttaactgctgacactccatgtcaccacaagccaaaaattcttaattctggaaaaaaaaacagaaaaagaaggatttgggaatctagaaaagctaatgtcagagaaaaggtaatttttttctcattgtattctttggagagataaaagaagataaagcaaatgtaacttgctcaaataaagggtttattggtctaatctgtgttctgccatgctaggatgggctttgtttatgatgggcatgcccaccatgggcaaagccaagcctgtgttgtgggaaatgttgaaggcatactcttgggcacaccttgtattccctcactcaattatcctcagctgaatagtttaacttaaaaatgacctgaagcttttctcatcttaagcaagatactctctgtcttcttccataacttacagagaactgggaagcaggagtcagcacttacataaaataatctaaagaaatgcatctaaaggctactgtcattaagaggaagccctaacagagttcaaacatttcactcaaaaccagaatggttttctcagtcttatcatttattaaatttatgtttatcatatgaggtaagctggttaggttacactactttcattttagaggtgacaaggctatggcttatattaattaaaagataccaagtaatttcttaggtttaattacacctagctgcatagaaaatatcttttactaaactgggaaaaaacatactgtttttttcattttttagctaccaagcagagaaggcaaagaaatgccctagatggttgatattgacatttctgttcttatcataggttgtgatgctggctctttccatcactgacttctccacctgttttcaaaggtggacttgtaatagtaattgccaaagtaattcctctattattgctctgctcttttgggtgcccttttcttcagctaaaggttattgcacccactaatcagaaatacggaaaatgccctcaaaggtcatttctgaaactttgtcttaaagagcaatctcttttgcaacctagtcaggatattttgccagttttcccaagaaaagagttttacggaaattgttcttacttgtgagaagtttccaatattaattgaaaaattttttatagggggagaatcaagttgggagtcaggaaacaaggtgctatggtctgaatgtgtccctcaacacaaaattcatgtgttggaaatttaatccccattgcaatagtgttggaaggtggggtcttttggaaggtgtttagatgatgagggctctgccttcatgaatagattaatcctgttataaaagggcttgatagagagagttttgttcctttttgcttttccaccttgtgccatgtgaaggtgcagcgctgtacccctccaaaggatgcagcattcaaagtgccatcttggaagcagacagcagcccttatcatatgccagagtcttgatcttggacttcctggcctctacagctgtgaaaaataaatttctgttctttatcaattaattaatctgtggtattttgttacaacagcacaaacagactataacacaaaggttctagatttacagctgccacaaatagctatatgttgttgggtaaggcatttaatcactccagttacaaaatctttcatttgcaaaataagagaattggaatggataatctctgaggtatattccagttctaaatccattataattccatggcaaataatgtcaggtaatatttttaaagaaaaatatattataaaaatttttatttaaatattgagataaaaaattattgcctgtctcttgggctatacaggcttttttatggtgagggttttctccacagacagaagaacaggaagaagggaaagtttgggattggataaaaggaagatttcttttcctcaccttggttactaatcctttacctagttggtaggtgcttcattcaccctggagatctttgactaaaaggcaggcattcaggaccaagcataatccatctcttgcataaaacatgggacgctttggaggatgcctggtgttcaaaatggtaatatttctacccctttgtcaaaagtaacatcatattccatatcactgccccccctccacctgtcagaaggggattagaaagggtgttgttccagaaaataaaagtttcaaaaccaacaaacccaggtcagatacctataaaaccttataagacaagaacaaattgcaattaaagaagacgcccaacaaagaagaaatgaaatgaaatattgatagctgtttaagggagttcacattctatctgtgtaagtgggaaatgctcaacctcctgagactcctcctatctctaaaattctaccactctgtgcctttatgataattctagattattttttaattttcatttttttattatacgtaagttctgggatacatatgcagaacgtgcaggtttgttacataggtgtacacgtgccacggtgttttgctgcacccattaacctgtcatctacattaggtatttctcctaatgctatccctcccctaaccccccaccgcctgacaggccccagtgtgtgatgctcccctccctgtatccatgtgttctcattgttcaactcccatttatgggtgagaacatgcagtgtttggttttctgttcctgtgttagtttgctgagaatgacggtttccagcttcatccatgtccctgccaaggacatgaactcatccttttttatggctgcagagtattccatggtatatatatgccacattttctttatccagtctatcatcgatgggcatttgggttggttccaagtctttgctattgtgaatactgccgcaataaacatacgtgtgcatgtgtctttatagtagcatgatttataattctttgggtatatacccagtaatgggattgctgggtcaaatggtatttctggttctagatccttgaggaatcgccacactatcttccacaatcgtttaactagtttacactcccaccaacagtgtaaaagcattcctatttctccacatcctctccagcatgttgtttcctgactttttaatgattgccattctaactggcatgagatggtatctcattgtggttttgatttgcatttctctaataacctgtgatgatgagcttttttttgtatgtctgttggctgcataagtgtcttcttttaagaagtgaatgctcatatatttcacccactttttgttggggttgtttttttcttgtaaatttctttaagttccttgtagattctggatattagccctttgtcagatgggtagatagcaaaaattttctcccattctgtaggttgcctgttcactctgataatagtttcttttgctgtgcactgcagaatttcttcagtttaattatatcccatctgtcaattttggcttttgctgccattgcttttggtgttttagtcatgaagtgtttgcccatgcctatgtcctgaatggtattgcctaggttttcttctagggtttttatggttttaggtcttatgttcaagtctttaatccaacttgagttaattttattataaggtgtaaggaaggcatccagtttcagttttctgcatatggctagccaattttcccaacaccatttattaaatagagaatcctttcccatttcttgtttttgtcatgtttgtcaaagaccagatgattgtagatgtgtgacgttattactgaggcctctgttctattccattggtctatatatctgttttggtaccagtaccatgctgttttggttactgtagccttgtagtatagtttgaagtcaggtagtgtgatgcctccggctttgttctttttgcttagggttgtcttggctatacgggctctattttggttccatatgagatttaaagtagttttttccaattctgtgaagaaagtcaatagtagtctgaaggggacagcattgaatctataaattactttgggcagtatggccatttttgtgatattgattcatcctatccatgagcatggaatgtttttccatgtttgtgtcctctcttatttccttgagcagcggtttgtagttctccttgaagaggtccttcacatcccttgtaagttggattcctaggtattttattctctttgtagcaagtgtgaatgggacttcactcaggatttgcctctctgtttgtctattattgttgtagaggaacacttgtgatttttcatattgcttgcacattgattttgtatcctgaaactttgctgaagttgcttatcagcttaagcagattttggctaagaaaacagggttttctaaatatacaatcatgtcatctgcaaacagagacaatttgacttcctcttttcctaactgaataccctttatttctttctcttgcctgattaccctggccagaacttccaataacatgttgaataggagtggtgagagagggcatacttgtcctgtatcagtcttcaaagggaatgcttccagcttttgcccatttagtgtgatattggctgtggatttgtcataaatatctcttattattttgagatacattccatcagtacctattttattgagagtttttagcatgaaggggtgttgaattttatcaaaggctttttctgcatctattgagttaatcatgtggtttttgtaattgattctgtttatgtcatggattgtttactgatttgcatatgttgaaccagtctcgcatcccagggatgaagctgacttgatcatggtggataagctttttgatgtgctgctggattttgtttgccactatttcattgaggatttttgcatcaatgttcatcagaaatattggccttacattttcttattttgttatttccctgccaggctttggtatcaggatgatgcaggacccagaaaatgagttagagaggagtccctctttttgtcttgtttggaattgtttcagaaggaatggtaccagctcctctttgtacctctggtagaattcagctgtgaatccatctggtcctgagctttttgttggttggtaggctattaattactgcctcaatttcagaactcattattggtctagtcagggattcagcttcttcctggtttagtcttgggagggtttatgtgtccaggaatttatgcatttcttctagattttctagtttatttgtgtagaggtgtttatagtattctctgatggtagtttgtatttctgtgggatcaatggtgataccccctttatccttttttattgtgtctatttgattcttctctcttttcttcttaattattctggctagtggtctatctattttgatattcttttcaaaaaaccagctcctggattcactgagttttttttgaagggtttttcatgtctctatctcattcagttctgctctgatcttagttatttcttgtcttttgctagcttttgaatttgtttgctcttgtttctgtagttcttttaattgtgatgttagggtgtagattttagatctttcctgctttctcctgtgggcatttagtgctataaatttccctctaaacactcctttagctgtgtcccagagattctggtaggtcgtgtcttcattctcattgatttcaaagacatttatttctgccttaaattcgttatttacccagtcgtcattcaggagcaggttgttaagtttccatgtgtggttttgagtgagttttttaatcctgagttctgatttgattgcactgtggaaagactgtttgttatgatttccattcttttacatttgctgaggagtgttttctttccaattatgtggtcagttttggaaaaggtgtgatgtggtgctgagaagaatgtatattttgttgatttgggttggagagttctgtagatatctattaggtccatttgctctagagctgagttcaagtcttgaatatccttgttaattttctgtctcattaatctgtctaatattggcagtggggtgttaaagtctcccactattattgtgtgggagtctaagtccctttgtaggtctctaacaccttgctttatgaatctggatgctcctgtattgggtgcataagtatttaggatagttagctcttcttgctgcattgatccctttaccattatgtaatgcacttctttgtcgtttttgatctttgttggcttcaagtctgttttatcagagactaggattgcaacccctgctttttttgctttccatttgcgtggtaaatagtcctccatccctttattttgagcctatgtgtgtttttgcacatgagataggtctcctgaatacagcacactgatgggtcttgactcttcatccaatttgccagtctgtgccttttaattggggcatttagcccatttacatttaagattaatattgttatgtgtgaatttgatcctgtcattatgatgctagctggttattttgcccattgcttgatacagtttcttcacagtgtcaatggtcgttacaatttggaatgttttgcagtggctggtactggtttttcctttccatgttcagtgcttccttcaggagctcttttagggcaggcctagtgttgacaaaatctctcagcatttgcttgtctgtaaaggattttatttctcccttgcttatgaagcttagcttggctggatatgaaattctgggttgaaaattcttttctttaagaatgttgaatattggcccccactctcttctggcttgcagggtttctgcagtgagatccactgttagtctgatgggcttccctttgtgggtaacccgacctttctctctggctgcccttaacatttttccttcatttcaactttggtgaatctgacgattttgtgtcttggggttgcctttctcgaggtgtttccttgtagtgttctctgtatttcctgaatttgaatgttggcctgtcttgctaggttggaaaattctcctggataatatcctgaagagttttccaacttggttccattctccccctcactttcaggtacaccaagcaaatgtaggtttggtcctttcacatagtcccatatttcttggaggctttgtttgtttcttttcatttttttctctaatattgtcctcatgctttatttcatttagttgatcttcaatctctgatatcctttcttctgcttgatttattcagctattgatacttgtgtatgcttcatgaagttcttgtgcatgctttaggaagttcttgtgctgtgtttttcagctccatgaggtcatttatgttcttctctaaactggttatcctagttagcaattcctctaaccttttttcaagattcttagcttccttgcattgcgttagaacatgcttctttagctgagaggagtttgttattacccaccttctgaagcctacttctgtcaatttgccaaactcattttccatccagtttttttcccctgctggcaaggaattgtcatcctttggaggagaagaggccttctggttttggaattttcagcctttttgtgctggtttttcctcatctttgtggatttatctacctttggtctttgatattggtgacctttggatggggtttctgtgtgaacgtcctttttgttgatgttgatggtattcctttctgtttgttagttttccttctaaaagtaagtcccctctgctgcaggtctactggagtttgctggaggtccactccagaccctttttgcctgggtatcaccggcagaggctgcagaacagcaaagattgctgcctgttccttcctctggaagcttcgtcccagagggtcatctgccagatgccagctggagctctcctgtatgaggtgtctgtcaacccctactgggaggtgtctcctagtcaggatgcacaggggtcagcgacccacttgcggaggcagtctgtcccttagcagagctcgagtgttctgctgggagatccactgctctcttcagagccagcaggcaggaatgtttaagtctgctgaagctgtgctcacagccgccccttgccccaggtgttctgtcccagggagatggtagttttatctataagcccctgactggggctgctgcctttctttcagagatgccctttccagagaggaggaatctagagaggcagtgtggctacagtggttttgccaaggtgtgttgggctctgcccagttcaaacttccaggcagctttgtttacactgtgaaggaaaactgcctactcaagcctcagtaatggtggatgcccctccccacacccagcttgagcatcccaggtcaacttcagactgctcttctggcagggacaatttcaagccagtggatcttagcttgctaggctccatggggatgggatctgctgagctagaccacttggctccctgacttcagcactctttccagaggagtgaatggttctgtctcactggcattccaggtgccactggggtatgaaaaaaaactcctgcagctagattggtgtctgcccaaatggctgcccagttttgtgcttgaaactcagggctgtggtggtgtaggcacccaacggagtcacctggtatgcaggttgcaaagactgtgagaaaaacctattatctgggctggaatgcaccattcctcaaggcttcccttggctagggaagggagttccctgaccccttgcacttcctgggtgaggcaatgccccatcctgcttcagcacatcctccatgcactgcaccaactatctaaccagtcccaatgagatgagctgggtacctcagttggaaatgcagaaatcacccaccttctgcgttgatcttgctgggagctgcagactggagctgttcctattcagccaccttgtcagctacccacttctagattacttaatggatgaaatggttacaattctttggggacaatgtgaatctaactatagctcccttgttcattcagacatatgcctcttttagggtatttttttgttggccataaatcactagaataacaagacaatagatttaacccaaatacattaatagtgtgaattttcaagtcattccctgtaaagttgaagctatacagaagactcattggcctaagttcatttatcatatttactaactccagtgatccattttacaaattattattacccgtcgttttaataatccagttgatttgggtggtattttccttagttagttggaaattcaaacttagatctcagagcaaaggctcatatggtgcaatagcttgattttctataataaagtagataattatcctttggatactatttagcatgaactctgattcagcttttctctactttgtcctaataaagtgaaacagtcccagattttcagttttccttaaagtttctttggtttgctaataccattttaagaaggtttttaagaatgtttttaacagtgttttatatatttaaaagtaaaatatataaaaggaattgcattgtcttgttttaggctaggaataaattagatgtttgtgaaagccattgtaaatggtagagtacttcaccaatgttaattataataatttgacacaatgtagggtagtggtcaatagcataggttttgaagtcagaacaacccagacttgaatcttgccttgcctgctactaactctctaactttggcaagtttttcaacgcctgagtactccctttgctggcctataacatgcaaacatgcaaataatatcaatatctacctcccagggtcatctaagtgctaagtggagagagtatatgtaaagtacttatatagtgcctgctcaatatgttaaatattattattaattgtattagctcaataaatgtttgtttagagtaaatctactggttaattaatcactggattattgtaaggactaaattagaaaatgtacacaacagacatagcacaaagcctggacaatgccctgtttcattttttctaagaaatcatccattataagatgcaccgttgaggcatgtgcttctacaaaagaaaaaaattatgtcaattaattgtaaaaaaccatcaaacatgagacaaagctctattgcagagaagtaaaaatgtgggggagaaaaagcaccttagaatcaatgaactccaacagctttaaataactagtacaatgataaaagatgaaggagagaaggaaaaggcaaaataaaaaatactcatcaaactaatttctcagtgttcttggagctatttgtgaatttttatctcattcacataccccaaattatcattcttgttagtgaggaagaaaaattaagaaacttgccacagggagccaaaaaagaatcataaaataagatcatagtgaattatgataaatctcccataatattcatggagtccttgcagagaatgagaacttatcagtcattagtcccctttcttacccaaagcaaggatctcttctacagcacctctgaagtgtaccaacgatatttattttgcatttcatttcagggcccctttcaaggagtcttggagttgctcttgtgcaaatgcagacccctttacacagtatgacgctagggtaggcggggaatgagtggcaggatgtaggggtatgctaatcatcactgtcaaccttgacgggaaggtgggtgacaaatggggaagtagcatttgaagtataatttagaaaagatctggaaaacaaatgacagaagaggagaaagagctctcatttatttcagaaaactttcccactaacagcaataggtggcagagaagaggatgaagatgtgtgggaaaaacaggaatgtctttgagtctttgagcaaaggaactgagggaaaacgaagcagttgctgctatttggggggaaactcagcaactgaaggtcgcaagttttttaccctaccagtcagcacatcagtcttgaaaagtcaatgatgaccaagcacataaaacctaaacatgtagaagccaccagttctttttgattagctattcaaagccagacttttccttccttgggaacaattcttattcatttctatatttcaatcactcctaaataattattaccaacagtttttgagctcttactatgtagaaaatttaatttacttgatcctaagaaaagaatttttttgtgaggtactattattatcattcccattttacagatcaagaaatcaagccccctatgagataagaaacttgtttcaagtcccagagccagaatggtacccagagaggctatattcctagccactatgtcacactgcctccaccttgacttcatttctgtgatcagtgcagactatatatattggataatttggaataaatgtacatcatcccagaatggtgttcaaaaagaattattcaggcattaattatctctataccttaactgttcttactctctctttacattgtctgacatttaactattggacgtctacaaagtctgaaaatgtgaattttatatatgtttatgtgcacacacacacacacagactgaagttgtcctgaacaacattatattcattcattctcctgtgcttctgaacttataggcaccctgtattttcccctaattgggggcagttacactatacatagaattcaggggtcaggatggagagtatctgataataccactgtccttcaacaattatagttatttggaaaatattaattacacttgtggttcactaggtgttttctctgcctctaagtttctctgcattttatttaattttatttttattttttattttattattgttatactttaagttttagggtacatgtgcacaatgtgcaggttgcttacatatgtatacatgtgccttgctggtgtgctgcacccattaactcgtcatttagcattaggtatatctcctaatgctatccctcccccctccccccatgccacaacagtccccagagtgtgatgttccccttcctctgtccatgtgttcacattgttcaattcccacctatgagtgagaatatgcggtgtttggttttttgttcttgtgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccacaataaacatacgtgtgcatgtgtctttatagcagcatgatttatagtcctttgggtatatacccagtaatgggatagctgggtcaaatggtatatctagttctagatccctgaggaatcgccacactgacttccacaatggttgaactagtttacagtcccaccaacagtgtcaaagtgttcctatttctccacatcctctccagcacctgttgtttcctgactttttaatgattgccattctaactggtgtgagatggtatctcattgtggttttgatttgcatttctctgatggccagtgatggtgagcattttttcatgtgttttttggctgcataaatgtcttcttttgcgaagtgtctgttcatgtccttcgcccactttttgatggggttgtttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtaatgtctaggttttcttctagggcttttatggttttaggtctaacatttaagtctttaatccatcttgaattaatttttgtgtaaggtgtaaggaagggatccagtttcagctttctacatatggctagcctgttttcccagcaccatttattaaataaggaatcctttccccattgcttgtttttgtcaggtttgtcaaatatcagatagttgtagatatgcggtgttatttctgagggctctgttctggtaccagtaccatgctgttttggttactgtagccttgtagtatagtttgaagtcaggtagcgtgatgcttccagcttcgttcttttggcttaggattgacttggcgatgcgggctcttttttggttccatatgaactttaaagtagttttttccaattctgtgaagaaagtcattggtagcttgatggggatggcactgaatctgtaaattaccttgggcagtatggccattttcatgatattgattcttcctacccatgagcatggaatgttcttccatttgtttgtatcctcttttatttcactgagcagtggtttgtagttctccttgaggaggtccttcacgtcccttgtaagttggattcctaggtattttattctctttgaagcaattgtggatgggagttcactcatgatttgactctctgtttgtctgttttggtgtataagaatgcttgtgcatttttgtacattaatactgtatcctgagatttgctgaagttgcttatcagctcaaggagattttgggctgagacaatggggttttctagatatacaatcatgtcatctgcaaacagggacaatttgagttcctcttttcctaattggaaaattaggaaattatttccttctcctgcctaattgccctgggcagaacttgcaacactatgttgaatgggagtggtgagagagggcatccctgtcttgtgccagttttcaaaggtaatgcttccagtttttgcccatttagtatgatattggctgtgggtttgtcatagatagctcttattattttgagatacatcccatcaatacctaatttattgagagtttttagccctaaaagagctcctgaaggaagcattaaatatggaaaggaacaatctgtaccagccactgcaaaatcatgccaaagtgtaaagaccattgaggctaggaagaaactgcattaactaatgagcaaaataaccagctaacatcataatgacaggatcaagttcacacataacaatattaactttaaatgtaaatggactaaatgctccaattaaaagacacagactggcaaactggataaagagtcaagacccatcagtgtgctgtattcaggaaacccatctcacatgcagagacacacataggctcaaaatgaaaggatggaggaagatctaccaagcaaatggaaaacaaaaaaaagcaggggttgcaatcctagtctctgataaaacagactttaaaccaacaaagatcaaaagagacaaagaaggccattacataatggtaaagggatcaattcaacaagaagagctaactatcctaaacatatatgcacccaatataggagcacccagattcataaagcaagtcctgagtgacctagacttagacttagactcccacacaataataatgggagactttaacaccccactgtcaacattagacagatcaacgagacagaaagttaacaaggatacccaagaattgaactcatctctgcaccaagcggacctaatagacatctacagaactctccaccccaaatcaacagaatatacatttttttcagcaccacaccacacctattccaaaattgaccacatagttggaagtaaagcactcctcagcaaatgtaaaagaacagaaattataacaaactgtctctcagaccacagtgcaatcaaactagcactcaggattaagaaacactcaaaaccgctcaactacgtggaaactgaacaacctgctcctgaatgactactgggtacataacaaaatgaaggcagaaataaagatgttctttgaaaccaatgagaacaaagacacaacataccagaatctctgggatacattcaaagcagtgtgtagagggaaatttatagcaccaaatgcccacaagagaaagcaggaaagatccaaaattgacaccctaacatcacaattaaaagaactagaaaagcaagagcaaacacattcaaaagctagcagaaggcaagaaataactaacatcagagcagaactgaaggaaatagagacacaaaaaacccttcaaaaaatcaatgaatccaggagctggttttttgaaaagatcaacaaaattgatagaccgctagcaagactaataaagaagaaaagagagaagaatcagatagacgcaatagaaaatgataaaggggatgtcaccaccgatcccacagaactacaaactaccatcagagaatactacaaacacctctacgcaaataaactagaaaatctagaagaaatggataaattcctggacacatacaccctcccacgactaaaccaggaagaagttgaatctctgaatagaccaataacaggctctgaaattgtggcaataatcaatagcttaccaaccaaaaagagtccaggaccagatggattcacagccgaattctaccagaggtacaaggaggagctggtaccattccttctgaaactattccaatcaatagaaaaagagggaatcctccctaactcatttgatgagaccagcatcatcctgataccaaagccaggcagagacacaaccaaaaaagagaattttagaccaatatccttgatgaacattgatgcaaaaatgctcaataaaatactggcaaagcgaatccagcagcacatcaaaaagcttatccaccatgatcaagtgggcttcatccctgggatgcaaggctggttcaatataagcaaatcaataaatgtaatccatcatataaacagaaccaaagacagaaaccacatgattatctcaatagatgcagaaaaggcctttgacaaaatatttaattttaaatatatgaaattctatggattttgaactcagattttagcaccattgatagctacaaagggagaaaacatatagttgggaatcaacaatactgcaggtgagccaggcatgagacatacttatagtaaaaataattatttattgtttatctgaaattcaaatgtaactgggtattttgtgtcatgtctggcaaccctagtagaagtggtaatgtgtgatttcagagcctgggtcagaaaatgcactgtggcttcctccttctctcttggatcactcactctagcagaagccagctgccatttcgtgaagacattcaagcaaccgtacggtgaggcccatatggtaaaaaaaactgagccctccggataatggctagtgaggaactgagacctcctatcaacagccactctcaagtctttagatgactgtaacccaagctgatattttgaccataacttcatgagagacactgaaccagaaacatctaacaaagcagaattccagactcagagaaactgtgagatactaaatatgtattgtttaagctgctaagtttgggggtaatttgttatgtagtaagagaaaacgaatacagccatattacttaagtagatggacatttattcagcgttctagtcaatcttcctggcatacaattaatctttttgttcaaagaaaagttttcttgcctttcgtttgaaagtgtcacatctcctgtgaaatagcccttaacctgatatggtttggctgtgcccccagccgaatctcatcttgaaatgtaatttccataatccccagcgtgtctagggagggaccaagtttaaggttgacggcatcatgggggtggtttcccccatggtgttctcacgataatgaatgagttctcatgagatatgatggtttttataaggggctcttcctcctttgcttcacacacacaccctctctctctcacctgctgccatgtaaaacatgcctttgcttctctctcaccttgcaccatgattgtaagtttcctgaggcctccccagccatgcagaactgtgagtcaattaaacctccttcctttataaattacccattcttggtatgtctttatagcaatgtgagaagggactaatcacagccctaccagaggaagacccaatatagcactcactgaggtaatttaaggaacatttgatagataatatgttttcagaacaaattttaagtaaacaaaataagaaaattataatatataatagaactgcactgtgacttatagattgcaaactttcacatttatcatgttatttgattattaaaataaagtaagagtattacctagcttttacaagtgaaaaaaacaatagaaggtaagtttttagaggtttgatgatatctccaaggtcacagagctaatcacacagctagaattctaacacaaatcgtcttaacacccagtttcttctaaggttctgcctctcaaatatgaacagtgttatctctttcattctgacactagtcattgatcttaaatggtgttctgttgcaggtggttttcaatatcaaaaatgtcaaaatgaagggtggaaaaatggtcatcaggctgggcgtggtagctcatgcctgtaatcccagcgctttgggaggccgaggcaggtggatcacaaggtcaggagttcaagactggcctagccaagacggcgaaaccccacctctactaaaaactacaaaaattagccgggcgcagtggcaggcgcctgtaatcacagctactcgggaggctgaggcaagagaattgcttgaatctgagcggtagatgttacagtgagccgagatcatgccactgcactccagcctgggcgatagagtgagactccgtctcaaaaaaaaaaaaaaaaaaaagtcatcaatcatctgacatgaaatcacaaaagtgagcatcttttgacctctgaaaaatgagttttaattgttctcattaattcaacagccatggttgacaataccatttgtggttgactcaatcattcagcaagtcctgtcacactatttgacttcacatttcccaacatgagaaatgattctcaacaacaacaaccaaaagacaaatattgggacacatttatcacaggcaggaaatgcaacacaaagaaaagcaaggcaaaaagtggaattctcatacttccactcataggaatctaacacatgactcctcaactccctgcccaggaatattgggtgttgatcaaacttaaactgtgttcgttttgctataaaactcatcattagttgttcatcaattatactactaaacccccagttaagagtccatattggaaccttatttttgaagtcaattccaggaaaagttttgtttcttttgtaaaagcgttacattttgaaagggcagcattataaatagaaggggaaataactgtatacaaagagggaacgatatcaaagtttggtagtagaaataagaagagtaaataaattcagttaaataaattcaggtcaggagtcatggttaaataaggaaataatacagtgggattaatcaaagtaactttgggatggtttccattcttttgactaagaacacagtatgaagctgaacaaatgaaaatgtggtgtttgctaaatgcttctctctggatacttcattcctgcttgtcctggcattaaaataagaaaaaccacatgccaataaagcaaacagtaattagaaatggagccacagtgatctagtatctccttcttgagaaaaagtctagggaggactttgggagatttaaaacttcaggaaggagaataatttagttatatacaaaaaagttaacttgatatcatactattaagtggatttctagattctgtagacctgttgtttctctcactgatgctggttaagtcattttaggcaaaaaataaggtcattacaattcagattctttcatctatttcacttgttagcattgctacttgaaaagaaatcccagtagcctaggattagaaaagggtgaatactcactcatctggtgccctgaataagttcagtaaaatgaaacaattgcacaccctgccattaccatttcccaggaatggtgtgtctgctctaaggtggggaataagggatagagccaacactggcttcttcctttctggcaaggaaagtgtatcaagtggtcacaaaacctcaaagatcctacatgttgcacttctctcttttgaggaaactgttacaagaagatgcttactcagaggtttggcatgctttttccactagaccaggtcgaattagccacacctggttgaactggtgttctatatgctgggaaataacctctagggttacttgacttgagaactgtgcccaacagaaatgctccatattgaacagtgaccaacaattccaaccagttctcctttcttggggaagtggaatgcaagatatacatagagaattgtcaatcaactcagtaagggagtagaagtaaactgagagaaaaaatctgaaccatgaaggcagctgacttaagggttattcttgggttactaaaaccgccatatacattcaagctacgaacaaggcatgcctctacagttactgacaaggtttccactgttttcttgccttctggaatattctaacagtaaaatatcacaggaagtaaaataaatatgtatccttcttgccaccagaaggaaactggggaatctcataatttttagtgaatctcataatttttagtgttgccatttttgtcttggcaaccaggaagctcttagccaaacttatgtttaacaactatataaaatccagtggtcacagttttgctgcttcttccatcttgatcctcattttatattccctatatataaagtttgagtgtgtgcgtgtgtgtttgagacatcaaaagtttcaaaaaactagtttctcagtctttggagggtcaggtagctaagaaaccaagacatccagcctttaaaggtacctcctaaaatctgccttctcagatatttttatgttggccttcaaatgtcaaggtctttcagttttagcaatttctaatttatattacaaagaaagaaatggaagtaaaagtaacaaacatctttccaaagttcagacacaatcctacatgaataattctgattccagacaaagatgggtgatgactaaatataagaataaaagatggatacttgcttatcatcccattcttagccattaattgttgagttgagatcaaaagccttctgcaatgctgttttagttataaatatcatggtaatcaggtaagtttacatctatattatgcattgttctaaggaagggagtaaaatctctgataatttaataaggcttttctttttctttccttttttttttttttttttttttttttttgagacagagtctcatgccgttgcctaggctggagtgcagtggtacaatctcagctcactgcaagctctgcctccctggttcaagtgatttttgtgccacagtctgtcgagtagctgggattaaaggcatgcaccaccatgcccagccaatttttgtatttttagcagagacagggttttgccacgttggccagactggtctcgaattcctgatctcaagtgatccacctgccttggcctcccaaagtgctaggattacaggtgtgagccaccacacctggcctaaaaaggcttatcctaaacatttccataaataggatttgaaatttttctagttcaccttccttttctctttgctgtgtctttacatgtcatttgatttcacatgtcatttatcagagagcagggagtgctttatcactctccaaagttcatagcctcctcattaataatcaaacctgaaggggtgatagcctaaacctgaaaaaaattataccacatatttactatcaggcactccaaagaactcacatattttcaaatacttctgtttaatagagggccagctattacctgctttcctcaagcctcagtgctaacttggatgaaaacattttactgaacacaactattaccttgtttcagccatgacttgtcaaatgtccccagatagctgctctcagtcatcactgtaggcaagaatgggtgcctctcaggaccagaatcagacacagaaacaagcaaagcccaaagtatgtaagcgatccactgaggtgagttcacacataaaaaagaagaaaataaaatgcatgtatactactctgcaatccactctcaggtcatttgaaacaaagtcaaaggagagaaggagttagggggatgatgtatatgactgtggattctacaaaaattttatttgatataaagcattcaacgcatctaaagtcatagaatgttataactggaagagtcttagagacaaagcctagcatcctcactttatagatgagaaaggtaaaaaaagagccaggaaataactgtccatgccaccatgctggtaccaggaagagctttggggtttggcaatctggggtgaggttccaactctgccacttattttatcccacttagcttcaatttcctcccaggtaaaataaagatcctaatcatgcctagatgacaaggtgagtgtaacaattaaatatgacatgcacataaagtaatcatcacaatgcttggcacatagtaagtgctccataaatgttagctattagaatgattatccatgatagagatccatcctagaacacaaattggagccagccataatatgtggggaaatcctccccttcagttcacctcctagacactgggccagaataggtcctggaggcatgaggtgaagatggggaatgggatctggctgtatttccaaaatcttccatatatagacctgaaagctgaaaccgaatgctaccctatgagattcatctcagagttccctggggatattagaaaataacaatcaccaaatttgaaggtaaagagactgtaaatcatagacttttatgctgaaaaatatctcaggtatcttgtagtctaacataccttgattttggaatcctcaagagcaagaccttgctcctttattattatttagtttttggagaggcagagatcccattacaaggttatacatacgtcgaactcaatgaatgcttgtgcaaggtgggaagatcatcatttattggtctttaagccttgtctctgttatatggggttacctttgtccatgaattttgtgaagcaatcattcagtagcacattctaagcttgtattgatggtaacaatagccagcataaagtgggcagtttctaaccaggcaatgagcaaccactttacatggaccatatccccacaacaagtcactcactaaggtcatacaactagtaaatagtgatgccaggattcagcctagggaatcttgggctgattttgtgctcttagtacatttttggtctctaaatatgacaaaagaatttataatatttctcatactttcttactctggtaaccttctgcagtcctttttccttgaccagaatttatacccttactcaataaaataggttgtggataccacagtcagaggtagttacttgaaacacctgtgtgcatgagtgcgcacacacacacacacacacacacacacacacacgcacaagttatagcacatggggcacaatgagaacaaagagagaatgcagtaaaacaattgccacaactgtacattgtcttctgtcaaaggaaatcaaccaagtcgagagtacttgcaaaagcacagcaaagccatgtgtttaccaacacttgggaaaactgaagtttaaacccaaggccaggcattaaatattattatgtaaggcaccagttctgtatcaagtcctttcaaggcttaacagccaaattagcaataaattctgatagccccatctatcagctctgttcagccaatccaatggcaacactgtgtttctttgcaggtccagggaacacacgcttgcaaaggaaaaaaatgcacttgattagatttggttttgaataattggttcattgaaattcttgagctgaagaaaaatggcatttctaatttatagaaatcacaatttgaaatatagttatgactgctcagagaacccctagaagtaaataaatttaagtcagcacatttaagaaagccattaagaggtaactaatgacagccccaccaattgtctctccaatagagcctgtgtggaaccctgccaaaagccagctcccttgttctcctggctgaggctgtgtgtggcttgatgcttgagagctcagctttggtgtatcaaggccacccacctagcaagcccaggaacctgatggggcctgacatggtttggctgtggccccacccaaatctcaacttgaattgtatctcccagaattcccacgtcttgtgggatggactccggggaggtaactgaatcatgggggctggtctttcccgtgctgctctcctgatatgattaagtctcatgggatctgatgggtttatcagggtttctgcttttgtttctctcattttctcctgctgccaccatgtaaaaagtgccttttgcctcccaccatgattctgaggcctctccagccatgtgaaactgttaagtccaattaaacctctttttcttcccagtctcgggaagaaaagcagcatgaaaacggactaatacagaggctaagaaggagaagggcagcacattctggacagaaaaggagagaaggaaaaatcgcttccattagcaactccagcacctctttgggaggaatctttcataggtgcacactgcatgcttgcaaatatccccactaacctgcactgggtatgctgggcactcagttatcctagcatcttagagagccaggaaagactactccagacctgtctgaccattgcaaggcaaggtggaatgttattatgtatgatatctgaatgacaaaggagaatctatgcttctcctccagccttgtttcatgggcacattagtgtggtttagattgtgtaatatctcttaattattacatgcaaattcaggcaagcagtatgggacagaaaagatctccaggtcactttagtaacctaggcctctgcagatgagtcagtgagtcagccaggatccctgaatgagaggagtaaacttttgacctcaagaagcttactgtgatctggtgattaccacagcagagcccaatccatcagctttgaaaaaacaatgaactctggtgacctggtttggccaaacctcactgctgtgataaaaagcatgactcctgtcttttgatacaccatggcccatttttaaaattgcttctgagaaagtaaatgagaccccagtttgaaagaaatgaggccagactgaaagatgtccttccataagcatttggcaagcatggaaatgacatctgtgggcttatcattcccaggcccctatccatttcactcaaataggtccctgctcaccacttttagtaacacccactggacacaaactaggatatgggtagaattgggataccggcagaatttgcctttggcatcactgtggtagacatagaaaggcatggtccaggcccccttcaaggaaggccttgcttccctgccacagggagtatcaccagcagacagcctccagctgtcagcctctgcaggaccaccttagctgcagagagctggctcaaagaggtcatgcccttcccaggatagcttttatccactggctgagaaaagtggggctagacaggtcttgccattcagcctgtagcaggacactatgcagggcaatgctcactgcagcactccctgccaacctggccatgggtttcttgggcctgcatcacagtttaacttattcctctgtacaattttgcttgctgttcccctttgcaggtgttgaaacccaagaaatgtcttgcatctcaaactccattttagcatctgcttcttgagaacccaatctgtgacaatcacctttttctgttctgtgatcttaactcctcttaattgcatccccttcagcccaacactccaaaataagttgataaaaaatacttaattggttggaagtttctggtcctacttttacatattgtccaaagcatgatgtagtaacattaacacaggctttggaaacagagctctgggttcaaatcccagctctgtgttatctgggtcatggtacctaatctctgtgagcctaaattttctcctccatcaagtggagatattgccatctacctagtacgtttgttgcaggaattaaatacaatcacatatacaacacacctaacacaatgcctcgtacacagtaggtgtctagtagttggttatatattgttatgggtcctttggcacttcacatgtactctacttgtattctaatttaactttttgggtatttcttccttgcttcttctatgaaactctgaattcctggagagcaagaaacatgctatttacttaatctggattttctatataatgctctgatggttaatactcagtgtcaaattgattggcttgaaggatgcaacattgatcctgggtttgtctgtgagggtgttgccaaaggagattaacatttgagtcagtgggctggagaaggcaaacccacccttaattaggtgggcaccatctaaacagccaccagcgaatataaagcaggcagaaaagaatgaaacacttgaggaggcagtctgcccattctcagatctccagctgcatgctgggagaaccactacactcttcaaagctgtcagacagggacatttaagtctgcagagtttactgctgtctttttgtttgtctgtgccctgcccccagaggtggagcctacagaggcaggcaagcctccttgagctgtggtgggctctacccagttcaagcttccaggctgctttgtttacctaatcaagcctgggcaatggcaggcagccctcccccagcctggctgctaccttgcagtttgatctcagactgctgtgctagcaatcagggagactctgtgggcataggaccatccgagccaggtgtggggtataatctcctggtgcaccattttttaagcctgttggaaaagtgcagtattagggtgggagtgatccaatattccaggtgccgtctgtcacccctttctttgactaggaaagggaactccctgaccccctgggcttcccgagtgaggcaatgcttcgccctgcttcagctcgcgcctggtgcactgcacccaccatcctgcacccgctgtctggcactccctagtgagatgaacccggtacctcagagggaaatgcagaaatcaccagtcatctgcgttgctcatgctgggagctgtagaccggagctgttcctattcggccatcttggctcctcctcaagtgggtccctgacccctgagcagcctaactgggaggaaccctccagaaggggcagactgacacctcacacagccgggtactcctctgagacaaaacttccagaggaatgatcaggcagcagcatttgcggttcaccaatatccgctgttctacaaccaccgctgttctgcagccaccactgctgatacccaggcaaacagggtctggagtggacctctagcaaactccaacagacctgcagctgagggtcctgtctggtagaaggaaaactaacaaacagaaaggacatccacaccaaaaacccatctgtacatcaccatcatcaaagaccaaaagtagataaagccacaaagatggggaaaaaacagagaagaaaaactggaaactctaaaaagcacagtgcctctcctcctccgaaggaatgcagctcctcaccagcaatggaacaaagctggatggagaatgacaagttgagagaagaaggcttcagacgatcaaactactccaagctacaggaggaaattcaaaccaatggcaaagaagttaaaaacattgaaaaaaaattagatgattggataactagaataaccaatgcagagaagtccttaaaggagctgatggagctgaaagccaaggcttgagaactacgtgaagaatgcagaagcctcaggagccgatgcgatcaactggaagaaagggtatcagtgatggaagactaaatgaatgaaatgaagcaagaagggaagtttagagaaagaataataaaaagaaatgaacaaagactccaagaaatatgggactatgtgaaaagaccaaatctacatttgattggtgtacctgaaagtgacggtgagaatggaaccaagttggaaaacactctgcaggatattatccaggagaacttccccaacctagcaaggcaggccaacattcagattcaagaaatacagagaatgctacaaagatactcctcgagaagagcaactccaagacacataactgtcagattcaccaaagttgaaatgaaggaaaaaatgttaagggcagccagagagaaagatcaggttacccacaaagggaagtccatcagacttacagcagatctctctgcagaaactctacaagccagaagagagtgggggccaacattcaacattcataaagaaaacaattttcaacctagaatttcatatccagccaaactaagcttcataagtgaaggagaaataaaatactttacagacaagcaaatgctgagagattttgtcaccaccaggcctgccctaaaagagctcctgaaggaagcactaaacatggataggaacaaccggtaccagccactgcaaaaacacgccaaaatgtaaagaccatcaaggctaggaagaaactgcatcaactaacgagcaaaataaccagctaacatcataatgacaggatcaaattcacacataacaatattaaccttaaatgtaaatgggctacatcctccaattaaaagacacaaactggaaaattggataaagagtcaagacacatcagtgtgctgtatacaggaaacccatctcacgtgcagaggcacacataggctcaaaataaagggatggaggaatatctaccaagcaaacggaaaacaaaagaaggcaggggttgcaatcctagtctctgataaaacagactttaaaccaacaaaaatcaaaagagacaaagaagaccattacatagtggtgaagggatcaattcaacaagaagagctaactatcctaaatatatatgcacccaatacaggagcacccagattcataaagcaagtcctgagtgacctacaaagagacttagactcccacacattaataatgggagactttaacaccccactgtcaacattagacagatcaacgagacagaaagttaacaaggatatccaggaattcaactcagctctgcaccaagcggacctaatagacatctacagaactctccaccccaaatcaacagaatatacatttttttcagcaccacaccaaacctattccaaaattgaccacatggttggaagtaaagcactcctcagcaaatgtaaaagaacagaaattataacaaactgtctctcagaccacagtgcaatcaaactagaactcaggattaagaaactcactcaaaaccgctcaactacgtggaaactgaacaacctgctcctgaatgactactgggtacataacaaaatgaaggcagaaataaagatgttctttgaaaccaacaagaacaaagacacaacataccagaatctctgggacacattcaaagcagtgtgtagagggaaatttatagcaccaaatgcccacaagagaaagcaggaaagatccaaaattgacaccctaacatcacaattaaaagaactagaaaagcaagagcaaacacattcaaaagctagcagaaggcaagaaataactaacatcagggcagaactgaaggaaatagagacacaaaaaacccttcaaaaattaatgaatccaggagctggttttttgaaaagatcaacaaaattgatagaccgctagcaagactaataaagaagaaaagagagaagaatcagatagacacagtaaaaaatgataaaggggatgtcaccaccgatcccacagaaatacaaactaccatcagagaatactacaaacacctctacgcaaataaactagaaaatctagaggaaatggataaattcctggacacatacaccctcccaagactaaaccaggaagaagttgaatctctgaatagaacaataacaggctctgaaattgtggcaataatcaatagcttactaacaaaaaaagtcaacgaccagatggattcacagccaaattctaccagaggtacaaggaggaactggtaccattccttctgaaactactccaatcaatagaaaaagagggaatcctccctaactcatttgataaggccagcatcatcctgataccaaagccgggcagagatacaacaacaaaaaaagagaattttagaccaatatccttgatgaacattgatgcaaaaatgctcaataaaatactagcaaagcgaatccagcagcacatcaaaaagcttatccaccatgatcaagtgggcttcatccctggaatgcaaggctggttcaacatacgcaaatcaataaatgtaatccagcatataaacagaaccaaagacaaaaaccacatgattatctcaatagatgcagaaaaggcctttgacaaaattcagcaaccttcgtgctaaaacctctcaataaattaggtattgatgggacgtatctcaaaataataagagctatctaagacaaacccacagccaatagcatactgaatgggcaaaaactggaagcattccctttgaaaactggcacaagacagggatgccctctctcaccactcctattcaacatagtgttggaagttctggccagggcaattaggcaggagaaggaaataaagggtattcaattgggaaaagaggaagtcaaattgtcctggtttgcagatgacaaggttgtatatctagaaaaccccattgtctcagccccaaatatccttaagctgataagcaacttcagcaaagtctcaggatacaaaatcaatgtacaaaaatcacaagcattcttacacaccaataacagacaaccagagagccaaatcatgagtgaacgcccccattcacaattgcttcaaagagaataaaatacctaggaatccaacttacaagggatgtgaaggacctcttcaaggagaactacaaaccactgctcaatgaaattaaagaggatacaaagaaatggaagaacattccatgctcatgggtaggaagaatcaatattgtgaaaatggccatactgcccaaggtaatttatagattcaatgccatccccatcaagctaccaatgactttcttcacagaattggaaagaactactttaaagttcatatggaaccaaaaagagcccgcatcgccaagtcaatcctaagccaaaagaacaaagccggaggcatcacgctacctgacttcaaactacactacaaggctacagtaaccaaaacagcatggtactggtaccaaaacagagatatagatcaatggaacagaacagagccctcagaaataatgccgcatatctacaaccatctgatatttgacaaacctgacaaaaacaagcaatggggaaaggattccctatttaataaatggtgctgggaaaactggctagccatatgtagaaagctgaaactggatcccttccttacaccttatacaaaaattaattcaagatggattaaagacttaaatgttagacctaaaaccataaaaaccctagaagaaaacctaggcaatatcattcatgacataggcatggggaaggacttcatgtctaaaacaccaaaagcaatggcaacaaaagccaaaattggcaaatgggatctaattaaactaaagagcctctgcacagcaaaagaaactaccatcagagtaaacaggcaagctacaaaatgggagaaaatttttgcaacctactcatctgacaaagggctaatatccagaatctacaatgaactcaaacaaatttacaagaaaaaaaaaccaaccccatcaaaaagtgggcgaaggatgtgaacagacacctgtcaaaagaagacatttatgcagccaaaaaacacatgagaaaatgctcatcatcactggccatcagagaaatgcaaatcaaaaccacaatgagataccatctcacaccagttagaatggcgatcattaaaaagtcaggaaacaacaggtgctggagaggatgtggagaaataggaacactttgacactgttggtgggactgtaaactagttcaaccattgtggaagtcagtgtggagattcctcagggatctagaactagaaataccatttgacccagccatcccattactgggtatatacccaaaggattataaatcatgctgctataaagacagatgcacacatatatttattgcggcactattcacaatagcaaagacttggaaccaacccaaatgtccaataacgatagactggattaagaaaatgtggcacatatacaccatggaatactgcagccataaaaaatgaagagttcatgtcctttgtagggacatggatgaaactggaaaccatcattctcagcaaactatcgcaaagacaaaaaaccaaacaccacatgttctcactcataggtgtgggaattgaacaatgagaacatatggacacaggaaggggaacatcacactccggggactgttatggggtggggggcggggggagggatagcattaggagatatacctaatgctaaatgacgagttaatgggtgcagcataccaacatggcacatgtatacatatgtaacaaatctgcacattgtgcacatgtaccctaaaagtataataataataaaatttaaaaaaaagaaaaaaaaagcattaaacaatgatgggcctagcctcccagcttacatctttctcccatgcttgatgcttcctgcccttgaacatcggactccaggttcttcagtttcggcactctgactggctctccttgctcttcaacttgcagacagcctgttgtgggaccctgtgattatataagttaatacttaataaactcccccttatatatatcctattagttctgtccctctaagacaaccctgacaaatacagatgccaagattgattgatgttgtacacgatatataaaatttttgtcaattaaaaaaaattgagaaaagaaggaatgacttgaaatatagcaaaggtgtcttcaacacagtaaccaagctgaaacttggttcttggtgtgcacagttacaatagcaagcctagtacctactagtagatatataaaggcatcaaagtagattttgccttctattcaccactgcaagaccaaatacataatagctaataatggacagcagatagatgattggcacccgaagaacaattgcagaaatgattaagaaacctaagtagacattgcatgagtagactcatgtctatcccatcccacatgatcagtccaatttaatcaccctattcaatcctctgggggctcagctggtccaaggaggggcacgggtctttggcccaaacagactgaagagaaggaactatattatgtagttggctaggagatttttcttctctctcacattggatgtgaaaagcatgacgcttcaatttacataaagtctccaggagaaccagcaaaggatgaagctgatgcagaagatcacagagcagagagacgaaagttattgggttcctgtgacattgttgagctgctgaatcactgaaatataaagcctgcgctacctcttatcttcctgttatataagaaaataaatgtcctttaggccatttcagtgtaggattctattactttgaatttgcagcagaaagtatcctgagaggtaaggcaaatattcaatatacaatcacaactatccagggtttcttttatgcttagagccacatcagaatttttactttttttttgttttagcagaaagaggccacctaatctgaactcatttacggattaggaaactgaagttcagaaaggctgaatgagttgcctgagaaggcagaactcagaaatagtagagtcaggacttgacatccccaactcaggcattaatctgttcatccaacagcatttatgggtatctactatgtgccaggcactgtgctcttttgtcagcatcaccccagttccaaaaacatatcatggaaatgaactcttaatacagtatttgcaactggagccaatgaacaataataaatgtttcacaagaccctgttaagacagaagccacagatactcttcaccaaccaggaaataagagtcacgtaaggaagagatgggaggaatgtcaagctgattggagagatttatcagaatttaaaaaaaaaattccagtacacccagagaagacaggtatgtaataagattacctgggctcattcacttttttcctagctataaaactataaaatgtattcctgtaaaaatcatataaaaaatgaaagataaggaaaataaatgccattttactcaaggcatatgtacttgagctcaagtcaggagtgccacagtccatcaactcaactgaaaagaatttaggaaggtacaaggtgaagtaaaaacagataccagtttttcagcaataacatcagcaaaggctgatatggagtcttgtcagttttgttagcataaagcatggcatttggaaggcagaagtgcctcaccagaacagggagcagccaaacccattgtggcttcagctccatcagaagaatcttggtgccttgagcaaggccatctctaccacatgagcatgtgagagccaagttggataatactgaagtggtaggtcagtcagtgcttgccgcactcacagcctgttttgagaaaagcagttctttgagcagggaaggccatcttctgtacacatgaatagcctcactccagccagaactctgtgaacttgacccaaggtcagccaactcaaagactggccatcaatccatgaaggtaactgaacatggcttttgaaaaatgtaggctcctaacctctaccccagaaccatcagctcagattatctggagtggattcccaaactttctcttcagcaaggtgattgtcatgcacaaagctaaagttttaaaaatattgatctaattcagactgttcatttttatagatgaagaaactgaggcacagagaggtcacaaaaacaaaactacttgtttttcatgtatatttaccttttctatcagagatactaccactgaacagatggctttccttgatggatggtttcattagcagtgtctgaatacttatcttctgtttgccatgtgtttctcttcctgtgtttgcgttttgcattcattcattcattcactatgtagttggctaggacacttattgagtgtccattatggaccaagtcttttcctaggttccaggaaacagaatcccaaaatctctgatcaagaaattatgtgttgcctccataaataaaattataaacaagatttatttctatttgtatcacccttcattctaaatacccacgtgcttacgatgtccttacctagcagtcttccaataagaattattgacagaacagatccactgtcgtgccgaatttcatcccccacaaaaatcaaaaactaaatcttgctgtgttcttacttagaaataggaagaaatatgtctccttacaatgaggcattcgctaatgcagccagattttaaactgttcacccagatttaagaccatctagatttctaacagagcaatggtcattaaacatctaataaccacccaggcacaaagaagaccattagctgtgcaaaccggcatgtatccaacaaagatgatctgggcacacagtccctgttgctctcatttgaaatgtttctctcttttattgtctgaagatcatgataaaatgcctctaagcagtacaaaagggccatgatttttattaaaattgagcacataaagagaccaaaaaagaaaaaaagaaagtacttgccaatggaggcaaggaataggtcacagaaaaaactagacatgagggagaggacattgggagaggcacttagagggccgggatgctggagtaaaaactagctgtgactcaagtggaaggttctgaacataggaaggatgtaaacatgtcagtcaacaagatcaccattagtttcctcacagtttgaaggggcaggggtcatggaacagagacagggagtggatctgcccagaccttccatccgccacttactgggcctcattgttagaggagggtaaggggcataggaagaacagtactgaagaggaacgaaagtggcagggaagagaaaagtgttagaagaaaaatatagcctggtcccttgcataatttcagagggagcacaggaaatttaaactgtcgaagcaagaaataaaaataatacctacaacccttaaatatagcactttacattttgtgaagtgtttcagagccattttctccttgacactacctcctcactccatttttccttggccgccgcttatcatctctgggtgctgaagtctcttgatgtgaacagaatggagaacactttggtctttacctctcacctctacaccttttgtttcccaggaacagaggccacaaaagagctgtaagagcagagtgaagcaggctcatcctggtaatttgtagttttgcagataaagaacactttcctcagcacatgtgcagtggatcctgacaccagagcttcaaagaggtaatcctacaaatgatcccaggaaatctgtcacatcactggcaaaatcagcacatgacagtcattctacatttagggagggagcgcctctcaatgtgacacaataaatgagaaaagcaccatcaataaaccaccaaggaacaaaggaaacctgaatcaaaatgacagtcaggctgctcaagatcagtgaactatgaagccaagtatttaaatgtttaaagatataatgaaatttccctttcaatctacatagtctcatatggccaagaacatcacagaagtccttaataatagctgataggctttgcttgaaagctgggtcccctactttgtagtaatagagatgttactggtacatgtcacatcttcctcacatggacaagcttgcaacccactattctcctgccaccattaaaatgatagattgctaggtttttgtaattgtcataaaattccatgcctgaaatggggatgctgtcttcctattttcccactgactctattttaagtgactcttttaatggtatttctctacttgaaataattggataatctaaaactgagaaataagcactttcctttcctcattgttttatcttctttatctctcacagccccaggagatcacaaatatttggccttagggcaatatcagcagttaatgattcatgttcaaagctcaaagttgtctaattaacaaaaggcaatgttttacagaggccatttttgctttcaagttaatagcacaccatacatacaaagggtggattgtatccaggtcttcaagcttgcagtctgctactaattgaagacgttctaatttcactttttttctgacccaaacttcaagtcattaaaaattaattattttcatttgtttcattctgatttatcagcacccgtgtagtacagttcacacatcacatcctcctattatgtgctcataaaaattacgttttggtgtttattaaaatatgcacttgattaatgaaaatattattagcatattttctgtgaattgtattcttaatagcatcagtcattaacaaaatcagaatctttaaaatgtctaaccatgttcttaatgtaaatggtggcctaggctaagtatttcctagtagcagaaatttggtaagatttctggtactgtatcaccaaaacatcatgaatttttatagagagggactgacattaaatactgacatttccaaaattatagtatgtatgcatgtttctgatgccaacggctttgatatcagcacaaaatccaacacatcagataagacttttgtagattcatcatgatcttgaatctcaaaacaagctgattccaaggaagtaaatgcttgttcctctataatgcctggatactttgcatatccatttattataattgcttactttcttgtctgtgtccatactagcaagcagagagtctatcattgcatctttgcagtatagcacagtggttaagaaaataaactctcaactgaaggctgtcttggtttgaatttcggctccatgcttcctagtttatgtaacatggacaaggtacttaaactctaagtgcagctttcttatctgtaaaatgagcataatggtatccatttttctcccagatctgatgggaacaataaaagcattcagagtggcttatatttggttaatacccatcaattgttagctattattatttgcatttttagtatccacaaaccagggatgagaatatggtaactagtcagtgattattaaaagagtaaatagacgagttaataagacaaacactagtattcctatttatagatgagtaaaaccagcctccataaagaaaaaaaaatcattcccaatttcagtcaagtagtaagtgacagaatcatttttcaaacttgggtctatctacggctaaactacaggagaaggcttgctgtctcccagaggtccctgagcttcctattggttagacaacacctaaatttcaaaaatgaatcaggtgatttttttgttttaggaataatttaaaaattattgggcagaaatgccatgaacttcccctctcccatcactgccaattaatatactaaagagcaatagctatgaaattggaactttgttcccaaatactctccagaacacataaaaacggggggcagatgatattctcacagttaactttacatttaagtctctgccgctgtcaatctttgtcaaaatgtctttcttataattaagaatcatggttctcagaggagacaagtggcaactcaatagctcaaaacttactgaaaaatgccactgcatattgatgtgccacacacttgagcattcatacccatctctccaatcccaatggctttgctcagtgaagagagcaaggaagccatccatgcaaggacactttaagtaggtgttctcattcttcaatgataattacttgagttaccaccttttaccattgctatgaagaaaaggatattttatgagaaggaaatgagttcatttctaagctctacgtaggtgaaatcccttatatttgttcatcccatagaagttattactaagattgatgatcttaatatatagactgtaaggaagatccagttttcaccctgaaagccttgctgctttaccaccttaatagatacatgattttcttcataccgtctcaggcaagaaaagaaactacaaactacatgttagagtttttaattgtgcctgatctatctacattttacaggacttcattctcaaaatacatgcttataacacttattttttcctttcatacttagtattcatcaaagggaattgcactttactctcccagagctaaaaaagatgatctaattaaaaatattaaagaatgagccattaaagagttgtctgaaaaaatgtaatgtatggagttcatgcatgcactcattcaataagcaggctttgagctgctataaccctcaggcggcatgtcctagagataatgagatcttagtattaaacacctctgtaacagaaatattatcatacaacaatgtagcaatatggctagacatttggaaattaaaaaaataattccagacctatcaaattgttttgttgaaggcaacaggcaacaaaagatgtctaaatattcaaatttcagaaaatatactccccaggtaccttgatcttagacgttattgggaagcaaaaacagaaccaaaatttagaatcaaaaagtcatcatataaaaaatatggcaagcataccaacctttcagtatccgtactctctctatacctttcctcctgttaataatatagtattcttatccctaagaaagcaacctcacctcctcagaggcttttttctacaattaatggatctactgcatgatttccaacagcatgtaaacatggtctatatcacccaacaaaaaaaaaggtgtgtatatgtggtggttgcaggggcggggggatagattgcattattgttttcaagtgctcactatttcttcatttgtgcacattaccataggcagtgaagtgtcttacagaaggagtgtacttttctgcccattgacattgggcttgccatgtaacttgatttggtcaatggaatgtgtgtaaatgtgtagtatggcaaattcaagctgaagatttgagacattgcaaggcatggttctgtctctcacttcttctctcttctatcaaaaggatgtgtcccagattgggggagctctgtcagcttgtgtccagtcataagacacatggtacagggcatagctgacctctagctactgacatggaatgtgatcaagaaacaaaccaattttgtttgaagcttttagttggtttttgtcactgcagtataatcccatctagctctacacatccatgtttctctgctctctaagcggctatctctacttctccttctattctccctcaatcctctaaaaccaggcttctttcccgccaactactccttccctttccaatgaaccactcttaacagggtgtcttccatatttccaactcaaatgatcatctctctcttcatctcttttgacctctcagaagtatttatcattgttgtccactccctccttcttaaaatattcccttctcttgatttctcacgatttgccttccatatcactggccattacttcttagtcacttttgctagttctctctcctgtttcaatcattgaagtgtgaatacaccaagctttcctttagtcttcttttctgtccctacattcttcaaactctacattaatcctcatctagacctgtgttttaaatataatatgtataacaaggactctctagccctgacctcttaatttagccccaaagttatctgtttagctaactgcttgacatcctcatctatgtgtctataggcatttcagtcttaacttggccaaaatatgattgttgatttttcctgtgtagatctgtccctcccacaatcttccccatctcagcaaatggcatcactatgtacgtagttgattaagccaaggactgaaatcagggtgatggggctacaagccaaaaattatcaaaggttaacaacaaaccaccaaaaactaaggaagacgcatggaacaagttcttccccacagccttcagaagtaaccaaccctactgatacctttatcttctggcctccagaactatggaagaacaaatttctgttgtttaaaccacccagtttgtggtactttgttttggcagccctggaaatctaatacaagcccctgttctgccaagttggtaggaggtggaatttcaacccttagggacatttccacccctccctcatcatgctctggagatgtctttagactccagtataaaaaccaggccaagccaggggactgaccccagagaagtgagcctagaaaaaagggtcacctttgaccagcttacctagggatcccagtctggacacaacaccattctctttccagatcctgctacttggcatgctgccaagctttatggtgctggtctccgatacacttgggacctataatgtcattctctgccccacttctactttagggaatttctcatctctctccctcttctgcctccccttcctcaataacaatcacaaaaggcaactagaaaaattattttcaagcagcttctactttaagtttgagaaatgcccttgacttgaagaacacaaaagatctggctaccttcagaaaaaaagaggccaagatttgtgaatatcacatatacagtgattctcattcttgctgtctgattcttttctttctcattctttctgtcactctgattctttcacatcagccaaaataaaacaaactaatctcttaataatttattttgtcaaagcagggatgtctatctaggtaaggcttacctgataacaacttcatgatacacagatggtatcatgtaccaagaccgtcaccctgtgatatgctcataaccaggatctgtctcataatcagcacagcaacctagccacaacacagaaaaatcttcaaaggattcaataagctgcagagcagaaagagttcaagttgtttctagagatccagtcacttcttccatcactacccatgctgtttcttcctcctcacagccttgtttttgaaattttagccaattttgaaattttaaccaattaaaagaggtcaaataccatgccctacattagcaagctttctccggtgtttgtcttctctgctcacaggaactccctatttactgtacatttcaaactccctctgtttcagcaaataaatcggtgtctgatggtacactcattatagtgctgttgtttctgagaataaggtcctccaagttaattaaataaggctggggagcttacttatgaaacaaacagcccactgctgcttctgctgataaataacaattttctcaataaaatgatgttgtatggatgctgcagttgggttcttgttatgctcatcagcgagctcctgaatgagtctagatttcccctcttcacataggtacatggcattaacggttataaaaaaaagggaagatgtatgtactgttcttctcataaagaaaaaatctattggatgggagcttaatgtatgtttcttggtagtatcaccagtagatgcactataactaccaagaaggaggtggccagttatattttatggttctcctttcaattctaataaggaagcatgtaatactcacaaagtacatattgcattgtttcactggaaggcatttatgaatggataaactgggtaatgagaattactggaaacttgcatattttcccacacagactttttatagtaggcatatgtaatctgactttcaatccctcatcttgcagcaatgagctgcaggagatttgaatactattcctactgtgcagaaataaaagtaggaataaattctgatgattctataatagctggagctgaaaagtcacagcattttccatttaaggggtccacatattagatccaaactgctcaagaagttttaaggttttcaaaatctgtcatcctcagagttaagatgaaattcaacttctcttggtttggggtggtcagttaaggtaacatatcactagaagaattggtattcatgatttctaaagaagtattaaagactataaagagcttttaaattaaaatatcaagaattataaaaggagtttttaaccataaagtcctctccaaggtataaaaaacacattatggaatgatgaattttcatactcaactgaagatatattctgagatgttttcttctctatggttgaagctttacacataacaaaagcaattagaataaaagaaaatattaagcttttctgacaacatcaggaacattaataataaatgtagatttcagttcagactattctcttcaaaataatggtttcagttatttgagactatttgctacttgaacacagcctatatttactgcacagcaatgatccataattaagctttaactttccatgtgcctagatatgagtccatttttagtgatattgataagatctatgatgcatcactacttttggaaaatgttgctgattccaaagatattagcactggatgctatctttgaaatgatgcagtattgagcagtactaatgtagcttaactgttggtgaaattgccagagtattagcatgtctatgattccctctgtctctcaagttgatatcctgcagagagcagagctcatgatcttctgtactagagagacacaatgtcatccagagggcaaaaaccagcttataaatccttacaaacccttccttccttccccattctatagatgtgtaaattgaggctcaaaactattaagtaatttcctgtagtcactgataaatggcagaaccaggatcagaatcaaggtttgtctttcaatgaaagtattaaactattggtattagactactgcaagcctcctcctatatttaatgtcattctatgcagtgctgcagatggagtggtaatacacatgagaggtaaaattgtaaagaagcatagttcatcctttttgtgtccccaggccactttcagattctcccagccttgatacttaccttcctttttgtctacttctcttcctcccatccaatgaactctgagaaataatatgacacctgtcatttatgaattagcatgaatttccatcaataatccagatttttgagctgcaaaggatgatagaaaccatttctgaacccagtcattttacagatgtggagacctagccacagaaaggttaagggacttacctgagttcacagagctaatgatgtacatacagaacagaagcaagaattctgtttcgtgactcccaactcacagttctattcattataccttcacaaaggtatttttttttaatttcagaggaatgttcttaccttaaagaaattttacacatcaaggagtaaagagaaaacatattgaaaaacaggagccctgcatgaaccccttaaaccatatttgttggtggctgcctactctcttcttaagaccagtcctgctgaagaagccactggtgagcatggtgagcacctctctccagacagtagtatgcagaatatcctcccttccagacctttttccttttaaaacagcaagcattgcgtctctctgttcttcttccccacaggaatcaatgcaatcattgtgttaaggccccacggaaagctaccactgtgttaaaaatagaaataaaaaacaataaaatttcaaattgatcatttctagttactaaaagaagaaaataatagactttcccttcctgattatgttcattaccatagatttcaatttgtctcaaattacaaggaaaagtagattgaaatctatagctagatccccaggtgtaacgtttcattttttaaaatcaatatgaaatggaagcattttgcagtaagtatttttggctccaactctaaagtactaaggctattatgatgcatttagtcatccagatagttgatcatattcagcctatacttgttttcactctcaatctttctgtcctgcataaacatgaggctctaaatgtcagtggtttttgagagcttcttccctgtcaaaatagctgtgtatagtttgcttgggctgggtatttttggtgtttttctgtgtctgtatctacaaccagcagtgaaggtggaggataaggcagatcatctggacacttatggaaaaagatggctagaaaacagggaagtttcaagggcctgactattcagatcaaccagtctcatcattttagttttatgttgtaagtgttcagtttctgaaacaatatacagtgttacatgaaagtcagagctagaaggaaccaagtaagcagctaattcaacctcctcattttacaaatgacatctctaaggccgagagaaaggaagcaatttggcctatatcataacctaacttgcagagctgagactcagaactataagacttcctaatactgatattttagtttggatttccccaaaagcagagcctgagaaaaggggttgggtgcaggtggtttattttagaagtaatcataagaaatgggagcaataaagcaggaagatgaggccagaaagaagagaaaaatagatgcaacattgatttggttatcactatgggaaactagggccaaatctcactatggacccactggaatcatacaccacatacatcagcaatgtgccttcacaggatggaagcccacaacacttaaccactcattccagtagagggttgttcccacaggccttaacttccccaagttttcaggctatgactaagcaagcctagtgactttagaaaaagcctaaggacagaaaagcacagagacacagcctggcacttgagttagtgtactttaagcaactctccatcacagctgcagctgaaatcaggtggaacaagaggttgtgtcataggccacaaagaatctactacaagtggtttttaaagtacgttgcctacaactttggggttgttctgcaaaaaggctccagagaggcctgagaaaggacctagtgtattagggttctcaagagaaataaaaccaataggatatttatatatatatgaggggattactacgagaattggctcatgcaattatggaggctgagaagacccatgataagctgtctgcaacctggagaaccagggaaactggtgatataattcagtgtgagaacctggggcaggggtaggggctgctggtgttggtgtctgaaggcccaagaacctggagctctaaagcccaagggtaggagaaatatggatatcccagctccagaagagacagtgaacttgcctttcctttacctttttgttctatcctggcccttgattggataacgcctacccacattaatgagggggatcatctatactcaatctacctattcaaatagtaatatgttctggtaacacacacatccagaaataatgcttattcagatatctaggcatcatatggcccagtcaacttgacacataaaattaacaatcacaagtccctcccttgtcaaactggtactcatatgtatctccttacaccatacttactctccaattaaagataataacaagatcctaattccacctagcaggatgcaactatcctgcaaacaaacaaaaatgaacaaatcctttccctgaggataaaaagtccatgagtgatatttactcttctcctgatatcccataacttaaatactatgaggaaaatacttatacatacttacataagtcagtaaagggaagaaaacaaaggtatttccttcatatatgtatatatacacacaaatttacttataaaaattagggaggaaatattcatgatgattatagtccttgtttttctaactggtcatgtggttgtagctggtatttataactaccttcttatactacccattctgtgtttcctttgccttcagcaaacatctcattcggtcttggctctttacctagcaaggtgatccaaaccatcattcctgaagggtctaggccatttgtagtcctgcctggattgaattgtagttttccattgaccttaattacagggtatggtaatactaagatatgccccatgggatatcctgtattctagacatatgcttctttacctccattatggagtggttatccaatttccctttgattgcctggatcaatcatcctcatagacacacccagaaatgatattttatcagctatctgggtatcttttaacctagtaatgttgtcatataaaattaactatcacaccccggaagagccacatggtaagattttaggacttctatttcttcctcattcagagcagacctacttttatctgtcttatatgttagaggtgctctatgagatatcatttgtagggggatgggggcttacttgtgtattagtcatgattctttagttttaagtgcacaaaccatatagaactagcttgggcaaagaaaaaatgttcacataactgagaagtcaacggctaatcagggactttaggcacaatgggattaagggttcacacaaagttgtctgggctttctcctgtctatgtgtcagtcttattctgtcctactctaggggcactttttctgcaaagagacagaaagtggctgccaatagctccaggttatattatactagcttagcaatgccatcagaaaatgagagcttcttcctcctagggtttatataatcatagcaaaagactcaaatatcctgcttagtttatctaaccacccccttggaccaactgccattggcttggacagctattctaaaactttagcatgcatcaacatcacctcaaagacttgtcaaaaaatgctcactgtgccctactcccagagtttcttatttggtaggtctgggatagctcctcaaaatatgtgcttttcaggtgatattcaaactgctgctccagtgaccacactttgtgtaccactggctataatgaggaggtactcataatcaaatcaagtcacagggccaggccagattctaaggagatagagtgtgtttcaggggaatagattccatttcctaattggaagagcagcaaataatctgtggccatctttaatctacgacaggagacatggtgaaaaggaccaacataagtgtaattgcctcctagaagggaagggaaaagagaacaaagaatttttcacaaatgatagaacacattaacccatatattcaagaagtgctacagattcccagaacaatcaatacatgaaaaaactcatctaggcacatcttggcaaaactaattttaaaaaagcaagggaaaaatcttaagccctgctaaagaaagatgacattattttcaaagaaacaacaataacattaacaggttacttctcaaaataagtaataggatcgaagaaaaagtgggatgacgtatctgacatgctacaataaagaaacttacaacatagaatttcattcagagcaaattattcttcaaatattaaagcaaatttaaaacattttagatagtgaaaaaatatggaggatggagataaaggcgtgttcagaagaaaatgattagccttacaatccatttatttgaaaagatgactgaacattaatgatttaagatttatctcaagaaattagaaaaacggccaataaaacccaaagaacatatgaggaaggcaacaataaaggtaagagcaaatattaatggaataaaacaaaacattcaatagaaaaatcaatagcaccaaataatggttctttataacaatgaataacttttataagcacctaacaaagctgattaagaaaaaagtgatagcatgaattttaaacatcaataattaaaaagggaacgtcactaaagacattataaatgttaaaaagataacaggaacatattaggagcaactctatgacaataaatttggaagtttaaatgaaatagactaatttctagaaagatgaaacccacaaaaaccaacacaaaaagaaacgaaaagtctagataattccctatttgcccaataattgaatctatactttataaagcttcccacaacaaaatatacaggctcatgttggcctttctgttgaaattttataaacatttaatgaagaaactatactaactttacacaaatgtttgtagattttagaaaaagagagaaaaaatacaaactcactttatcagaacaacataacattgtcccaaaatctgaccaaaaaaattacaagaaagggaaattactagtcaatctctgtcaagaacatagatgtatatatcttaggaaaatattaagaaattgaatccagcaattcacaaaaaggctaatccatcatgactcagttgagtttcttctagaaatgcaagattggtttagctatcaagatattaatccagggtgagccatgatggttcatgtgtataatctcagaactttgggaggccaatgtgggacgatcacttaaggtcaggagtttgagatcagcctcagcaacatagcaagacctcatttctacaaaaaaaaatttttaaaaatcaaccatttgtggtggcacatgcctgtagtcccagctattcagaaaattgaggcaggaggatagcttgagtccaggagtttgagaccgcagtgagttatggtcatgacactgcactccagcctgggcaacagagtgagagcctgtctcttaaaaaaaaatccataaaattcaccaattaacaaaatggaaaaaaagtataatcatctcaataaatgcagtaaaagcatttcgtaaaatgtagtatctatgtaagaaaaaactcaaatactaagaataaaagggaacatccttaatctgacaaatcttatctacaaaaatagaagggactacaataaacattatgctcgtgaaatattaaaagctttttctctaaaatcagcaatgagataaatatctctactattacaatttctaccaccattaaactgtacatgttagctagtgcaacaaggcaaggaaaagaaggtgtagtcactgaaaaggaagaaataaaactgttacatgcagatgacatgatcatgtatgtagaaagtccaaatgtatctgtacatttttaatactaatatgtgaattcagaaagttcactggaaacaagattagtagtaaaaaatctattgcactttcatatatgagaaaaaataatattagagaaagaattgttttaaaaagaccacttacatagtggctcaaaaaatcaagtatttagaaataaatctattaaaagataagcaaaaatgccaaacccaaaactacaaaacatttatatggggaagggatatccaactccaactccctctaggcatcctatctgccctacgtaaggggaggaaaagggaccgagtagcacttgtgaagattacagtgcaaggaaacaggctcactaaatgtgtgcaacttaattatagaactacagaataatacttccctgatgcctacaccttattaccatatcattaaaggcctattcaacagtttcttttctccagtgcatcatgtccaattttcaacaaaaaaattacaagatatattaaaaagtaaagtctgaagagacagaggaaacatcagatccaaattcagatatggcagatactctgaactaaaaattttttaaaattgtgattaatatgctaagagtgctagtggaaaaaaatagacaacatgcaaggatagatgattaatgtatgcagagagatggaattctaagaaaaaaataaaaaataaatgctagatatcaaaaacactgtaatagaaatgaagaatgcctttcatgagctcattagtagactggacatggttaaggaaagatcctctgagcttgaggatgtctcattggaaattccaaaactgaaaagcagagggaaaaagactggaaaatagaaaatagaatatccaagaacagtgaaaccaccacaaaaggtagttgagtaataggaatactagaaggatataaaagaaagaaacggaagaaatattttaagcaataatgactgagaattttttcaaattaatatcagacatgaaaacacagatccaggaagctcagagaacatcaagcaggataaattcattaaaaaacatacactcaggcatatgatattcaaactgcagaaaataaattaaaaaaaaaaaaaaaccttgaaagaagccagaggaaaaacaccttatctatagagaggcaaagaaaagaataacaaacaacttatcctcagaaaccatgtaagcaagaagagaggggagtgaaatattttaagtggtgagagaaaataaaaatcaccaatatagaattacatatgctgcaaaattatccttcaacaacaaaagagaactaaagactttctcagacaaaaattaagggaacttattactagtagacctgccttgcaaaaaatgttaaaacaaattcttcagaaagaagaaaaatgatatagttcagaaacttgaatttaccttaaaaaaggaaaaatgctagagaaagaaaaagtgaaggtaaaacaaaaacttttatttttcatattttccaatgatctaacaggtaacagtttgctcaaaataacaatagtaaaaatatattcaatgattatagcttatgaataagtgaaatgaattacagcaatgatacaagagatgggagagaagaattaggaatattttgatattttaaggtacttgtcctacccatgaagtgatatactgttatatgaaaatagacatggaatcactgtaaatgtgtatcagaaattctagggcaaccactaaaaaagtttcaaaaagaagtataattgatatattaagaaaggggagaaaatcaaatcatagaaaatgctcaattaataccacaaaagataggaaacgaatgagatacaaaataggaagaacggcaataaataaaaatcattaacaaatttggtacacattaacccaactaaatcaataatcacttcaaatgtcaatgggctaaacttactaattaaaagacagatatagtagattaaaaaataagacccaactacatgttgtctacaagaaacccactttaaatataaaagtagagggatacagaaagaactactttgctaatactaatcaaatgaaagctggggtagctatattaattttggtaccagaaaaaataaaagatctaaaatcaattccctaagtgtttaccttagaaaactagaaatagaagagtaaattaaatccaaagtgagcagatgtaaagaaataataaaaattagagcagaaatccatgaaactgaaaacaggaaactaatacagaaaatgtattaaaacaaaagccagctctttgaaaagaccaatacaactgataagtctctagccaggataatagagagagaagacataaattacccatatcagaaatcaaaaaggggatattgctacagatcccatgggcattcaaaggataataatggaatagtatgaactctgcccacaaatttgataacatagataaaatggaccaattcttggaaggcacaatctgccaaaactcacacaataatatgaaaaacaagaaatggggaaagtattccctattaataagtggtcctgggaaaactcgctagccatatgtagaaagctgaaactggatcccttccttactccttatacaaaaattaattcaagatggattaaagaattaaactttagacctaaaaccaaaaaaccctagaagaaaacctaggccatatcattcaggacataggcatgggcaaggacttcatgactagaacactaatatatatatacatatatacaggttatatatataattatatattttatatatataattaatatatattaattatactttaagttctagggtacttgtgcacaacgtacagatttgatacataggtatacatgtgccatgttggtttgctgcacccatcaactcatcatttacattaggtatttctcctaatgctatccctcccccagtcccccacccggcaacgggccccagtgtgagatgttccctgccctgtgtccaagtgttattgttcaattcccacctaagagtgagaacatgtggtgtttggttttctgactttgtggtactttgctgagaatgatggtttccagcctcatccatgtccctgcaaaggacaagaactcatccttttttatggctgcatagtatgccttggtgtatatgtgccacattttcttaatctagtctatcattgatggacatttgagttggttccaagtctttgctatttgaatagtgtcacaataaacataagtgtgcatgtatctttatagtagcatgatttataatcctttgggtatatacccagtaatgggatttctgggttaaatggtaattctagttctagatccttgaggaatcaccacgctgtcttccacagtggttgaactaatttacagtcccaccaacagtgtaaaagcattcctatttctccacatcttctccagcatctgttgtttcctgactttttaatgactgccattcttactggcatgagatggtatctcattgtggttttgatttgcatttctctgatgaccagtgatgatgagcattttttcatgtgtcttttggctgcataggtgtcttcttttgagtagtgtctgttcatatgctttgtccactttttgatggggttgttttttttcttgtaaatttgtttgaggtctttgtagattctggatattacccctttatcagatgggtagattgcaaaaatttcctcccattctgtaggttgcctgttcactgtgatggtagtttcttttgccatgccaaagctcttaagtttaattagataccacatgtgtattttggcttttgttgccattgcttttagtgttctagtcacgaagttcttgcccatgcctatgtcctgaatgatatggcctgggttttcttctagggtttttatggttttaggtctaacatttaagtctttaatccatcttgaattaatttttgtataaggtgtaaggaagggatccagtttcagctttctacatatggctagccagttttcccaggaccatttattaatagagaatactttccccattttttgtttttgtcaggtttgtcaaaaatcagatggttgtagatgtgtgctgttatttctgaggcctctgatctgttccattggtctatatctctgttttggtaccagtaccatgctgttttggttactgtagttttgtagtatagtttgaagtcaggtactgtgatgactccagctttgttctttttgtttaggattgtcttgcctatactggctcttttttggttccatatgaattttattttattttttattatactttaagttctagggtacatgtgcacaatgtgcaggtttgttacatatgtatacatgtgccatgttggtgtgctgcacccattaactcatcatttacgttaggtatatctcccaatagctatccctctcccctccccccaccccatgacaggccctggtgtgtgatgctccccccgtgtccaagtgttctcattgttcagttcctacctatgagcgagaacatgcggtgtttgggttttctgtccttgcgatagtttgctgagaatgatggtttccagcttcatccatgttcctacaaaggacatgaactcatcattttttatggctgcatagttttccatggtgtatatgtgccacattttcttaatccagtctatcattgatggacatttgggttggttccaagtctttgctattgtgaatagtgctgcaataaacatacgtgtgcatgtgtctttatagcagcatgatttataatcctttgggtatatacccagtaatgggatggctgggtcaaatggcatttctagttctagatccttgaggaatcgccacactgtcttccacaatggttgaactagtttacagtcccaccaacagtgtcaaagtgttcctatttctccacatccacatgaactttgaagtagttttttccaattctgtgaagaaagtcactgatagcttgatggggatggtattgaatctataaattactttgggcagtatggccagtttcacgatattgtttctttctatccatgagcatggaatattcttccattttatggtgtcctcttttatttagttgagcagtggtttgtagttctccttgaagaggtccttcatatcccttgtaagttggattcctaggtattttattctctttgtagcagttgtgaatgggagttcactcatcatttggctctctgtttgtctgttaatggtgtacaggaatgcttgtgatttttgcacattgatgttgtatcctgagacattgctgaagttgcttatcagcttaaggacattttggtctgagatgatggggttttctaaacatccagtcatgtcatctgcaaaagggacaatttcactttctcttttcctgattgaataccctttatttctttctcctgcctgattgccctggccagaacttccaacactatgttgaataggagtggtgagagagagcatccttgtcttgtgccagttttcaaagggaatgcttacagtttttgcccattcagtatgataccggctgtgggtttgtcataaatagctgttgttattttgagatatgttccatcaatacctagtttattgagagtttttagcctgaaggactgttgcattttttcaaaggccttttctgcacctattgagataatcatgtggtttttgtctttggttctgtttatgtcatgaattatgtttatagatttgtgtatgttgaaccagccttgcatcccagggatgaagacaacttgatcgtggtggataagctttttgatgtactgctggattcggtttgccagtattttattgaggattttcgcactgatgttcctcagggatattggtctaaaattattttttttggttgtgtctctgccaagctttgatatcaggttgatgttggcctcatcaaatgagttagggaggattccctctttttctattcattggaatcgtttcagaaggaatgctactagctcctctttgtacctctggtagaattcggctgtgaatcggtctggttctggacattttttggttggtaggctattaactattgcctcaatttcagagcctgctattggtatattcagtgattaaacttcttccttgtttagtcttgggagggtggatgtgtccaggaatttatccatttcttctagattttctagtttatttgcatagaggtgtttatagtattctctgacggtagtttgtatttccgtgggatcggtggtgatatcccctttatcattttttattgcgtctatttgattcttctcttttcttctttattagtcttactagtggtctatcaattttgttgctcctttcaaaaaaccagctcctggactcattgattttttgaagggttttttgtgtctctatctctttcagttctgttctgatcttagttatttcttgccttctgctagcttttgaatttgtttgctcttgcttctctagttcttttaattgtgatgttatggtgtctattttagatctttcttgctttctcttgtgggcatttagtgctataaatttccctctacacactactttaaatgtgtcccagagattctggtacattgtgtctttgttctcaccggtttcaaaaaacatctttatttctgccttcatttaattatttacccagcagtcattcaggagcaagttcttcagtttccatgtagttgtacagttttgagtgagtttcttaattctgagttctaatttgattgcactgtggtctgagagacagtttgttgtgatttctgttcttttacatttgctgaggagtgctttacttccaattatgtggtcaattttagaataagtgcaatgtggtgctgagaagaatgtatattctgttgacttggggtggagagttccgtagatgtctattaggcctgcttgttgcagagctgatttcaagtcctggatgtccttgttaaccttctgtcttgttgatctgtctaatattgacagtggggtgttaaattctcccattattattgtgtggaagtctaagtcctttgtaggtctctaaaacttgctttatgaatctgggtgttcctgtattgggtgcatatatatttaggatagttagctcttcttgttgaattgatccctttaccattatgtaatggccttctttgtctcttttgatcttggttggttcaaagtctgttttatcggagactaggattgcagcccctgctttttttttttttttttgctttccatttgcttggtagatcttcctccatccctttattttgagactgtgtgcatctttgcacgtgagatgggcctcctgaatacaacaccctgatgggtcttgagtctttatacaatttcccagtctgtgtcttttaattggggcatttagcccatttacttttaaggttaatattgttatgtgtgaatttgatcctgtcattatgatgttcactggttattatgcctgttaagtgatgcagtttcttcatagcattgatggtctttacaatttggcctgtttttgcagtggctggtagtagttgtttttttccatctttagtgcttccttcaggagctcttgtaaggcaggcctggttgtgacaaaatctcccatcatttgctagtctgtaaaggattttatttctccttcatttatgaagcttaatttggctggatatgaaattctgggttgaaaattcttttctttaagaatgttgaatattggcctccactctcttctggcttgtagggtttctgcccagagatctgctgttagtctggtaggcttcccgttgtgggtaactcgacctttctctctggctgcccttaacactttttccttcatttcaaccttggtaaatctgacaattatgtgtattggggttgctcttctcaaggagtatctttgtggtgctctctgtatttcctgaatttgaatgttggcctgccttgttaggttggggaagttctcctggataatatcctgaaaaatgttttccaacttggttccattcttcccatcactttcaggtacaccaatcaaatgtagatttggtcttttcacatattccctatttcttggaggctttgttcatttctttttactctttttttgtctaaccttgtcttcttgctttattttattaatttgatcttcaatcactgataccctttcttccacttgattgaatcagctattgaagcttgtgcatgcattacaaagttctcatgccatggttttcagctctatcaggtcatttaaggtcatctccacactgttctagttacccattcgtctaatctttttaaaggtttttagcttccttgcgatggttttgaacttcctcctttagctcggaaaaatttgttattcctgaccttctgaagcctactctgtcaactcatcaaagtcattctctgtccagctttcttcaattgctggcgacgagctgctatcttttggagaagaggcactctgatttttagaattttcagcttttctgctctgttttctccccatctttgtggttttatctgcctttggtctttgatgttggtgacctacagatggggttttcgtgtagatgacctttttgttgatgttgatgctatgcctttctgtttgttagttttccttctaacagtcaggtctgtcagctgcaggtgtgttggaatttgctggaggtccactcccgaccctgtttgcctgggtatcaccaaaggaggctgcagaacagcaaatatgcagaacagcaaatattgctgcctgacccttcctctggaagctttgtcccagaggggcatctgcctatatgaggtgtctgttggcccctactgggagatgtctcctgtttggctacacaggggtcagggacccatttgcagaagcagtctgttcattctcagaacacaaacgctgtgctgggagaaccagtgctctcttcagagctgtcagacagggatgtttaagtctgcagaagttgtctgctgccttttgttcagctatgccctgcccacagaggtggagtttagaggcagtaggccttcttgagctgcggtgggctccgcccagttcaagcttcctggccgctttgtttacctactcaagcctcagcaatggcggacgcccctcccccagccaggctgccgccttgcagtttgatctcagactgctgcgctagcagtgagcaaggctctgtgggcatgggacccactgagccaggcatgggagcaaatctcctcatctgctggttgctaagatcttgggaaaagcacagcatttgggcaggagtgtcccatttttccagatagtctgtcatggcttcccttggctaagaaaaagaaatcccctgaccccctgtgcttcccaggtgaggcaacaccccaccctgcttcagctcaccctctctgggcttcacccactgtccaaccagtcccagtgagacgaaccagttacctcagttggaaatgcagaaatcacccgtcttcttcatcgatcatgctgggagctgcagaccagagctgttcctatttggccatcttcttccctccacccctgcctcaaatagacctatatattttttttaaaattgagataactaacctaaaagccttgactacaccgttatgcaatctatgcatgaaacaaaattacccttgtgcaccataagtttacacaaatttttatttttttaatttttaatttttgtgggtgcatagtaggtatatatatttatggggtatgtgatatgttttgatacaggcatgcaatatgaaataagcacatcatgaatagggtatccatcctctcaagcatttatccattgagttgcaaacaatccaattacacactttaagttattatgaaatgtagttataattgactatagccatcctgttatgttatcaaatagtaaatcttattcattatttctagccttttttagtacccattaatcatcccaaccttctcccccatgaacccctgactacccttcgcaactctggtaaggatccttctactttctatatccatgaattacattgttttgacttttagatgccacaaataagtgagaacatctgatgtttgtcattctgtgcctggcttatctcatttaacaaaatgatctccagttccatctatgttgttgtaaatgatgaatctcattctttttatggctgaaaggtactccactgtatatatgcaccacagtttctttattcattcgtctgttgatggaaactaagtttcttccaaatcttgttgtagacagtgctgtaacaaacatgggagtgtagacatctcttccatacattgattttctttcctttgggtatatatacaacagtgagattgctggatcatatgggagctcaatttgtgtttcttgaggaacctccaaactgttctccatagtggttgtactaatctacattcccaccaacagtgtacaagtgttcccttttctccatatcctcaccagcatttgttattgcctgtcttttggatataagccattttaactggagtgaggtgatatctcattgtagttttgatttgcatttctctgatgatcaatgatactgtgcaccttttcatgtgtgtgtttgccatctgtatgtcttgagaaatatctttcacccatgttttgattaaattattatgttttttcctatagagttgtttgagctccttaaatactctgattactaaccccttgtcaaataggtattttgcaaattttttctcccattctataggttgtctcttcactttgttgattgtattctttgttgtgcagaagctttttaacttgatgtgatcacatttgtccatttttgctttggttgcctgggcttgtggggtattgctcaagaaatttttgcccagaccaatgtcctagagatttcctcccatgttttcttgtagtaacttcatggtttgaggtcttggatttaaatctttaattcattttgattttttaaaatatagcaatagttaggagtctagtttctttcttctgcttatggatatccagttttcccagcaccatttattgaagatactgtcttttccccagtgtatgttcttggcgcatttgtcgaaaatgagttcactatacgtgtgtgaatttgtttctgtgttctctattctgctccattggtctctgtctctgtttttatgccagtaccatgctgttttggttattatagctatttgaagtcaggtaatgtgattcctacagttttgttctttttgcttagaatagctttgggtattctggttccatgtaaactttaggattgttttttctatttctgtgaagaatgttattggaatttgaaagagattccattgaatctatatattactttgggttatatagacattttaacaacattgattcttccaatctatgaacatgagatattttttcattttttgatgtcctcttcaatttctttcattagtgatctatagtttttattatagaggtctttcttttcttggttaattcctatatatttaattttatgtgtggctattataaatgattgcttttttatttctttttcacattgctcactggtggcatacagaaatgctactgatttttgtctgctgattttgtatcctgcaactttactgaatttatcagttctaattgtttccttgtggaatctttaggtttttcccaagtataagatcatatcatctgcaaacaaggataatttgaattcttcctttccctttttttttcttctttttgagacagagtcttgttgtgtcacccatgctggagtgcagtggcatgatctcgattcgctgcaatccccacctcctgggttcaagcaattattgtgtctcagcctcccaagtagctaggactacaggagtgtaccaccacacctggctaatgctttgtgttattagtagagacagggttttgccatgttgcccaggctggtcttgaatgcctgagctcaagcaatccacccttcttggtctcccaaaatgctgggattataggtgtgagccactgcacccggccttaattcttcctttccagtttggatgcccttcatgtttttctcttgtctcattgctctagctaggacttccaggattatgttgaataacattggtgacagtgggcatacttgtcatgttccagatcttagaggaaaggctttcatttttttccccattcagtataccagctatgggtctgtcatatatggcttttattatggtgagctatagtccttctataccctgttattttagggtttttatcataaaacaatgttgaattttaccaaatgctttttcatcatcaattgaaatgattatatggtttttatccttcattctgatgatatgacatatcacatcaattgatttgcatatgttgaaccatacttgcatcccagggataaatcccacttggtcatagtgaatgagcattctgatgtactgttaaattcagtttgccagtattttgttgaggatgtttgcatcaatattcaccagagatattggcctgtagttttctttttttcatttgtctttggttttggtatcagggtaatactggcctcacaggatgagtttggcagtattctttcctcctctatttttctgaatagtttgagtaggactggtattagttcttgtttggtaaaattcaggattgaagccctgatgtcctgggcttttctttactatgagactttttattaatattatggctttgacctcattacttgttattggtctgttctggttttggatttcttcttgactcaattttggtaggctgtatgtggctaggaatttgtgcatttcttctagattttccaatttattggcatatagttgctcacagtagctactaatgatcctttgaatttctgcagtatcagctagaatgtctccttcatttctgattttatttaattggatcttctcttttttttcttagtctagctaaaggtttatcaattttgtttaacttttcaaagaaacaactttttgttccattcatcttttgtattctctctctcaattcaatttcatttatttctgctctgatctttattatttcctttcttctactaattttgggtttggtttgctctggcttttctggttctttaagatgcatcattagattgtctatttgaaattttcccttttttgatatagacacttatagccataaaattctatcttactattgcttttgctatattccataggttttgctatgttgtgtttcattatcatttgtttcaagaaaatgtttaatttccttattaatttcttcattgacccacgggtcatttgggagcacatattttaacttccatctatttctatattttccaaaattcctcttgttatttatttctagttttattccattgtggtcagagaagatacttgatattatttcaattttttgaatgttttaagacttgttttgtgatgtaacatatggtctgtccttgagaataactcacgtgctgaggaaaagaatgtgtattctgcagctgttggatgaaatattctataaatatctattagatccatttggtgtatagtgcagattaagtctgctgtctgtttgttgatttcctgtctggaacactggtctaatgctgaaagtggggtgttgaagtctctagctattattgtattggggcctatctctctctttacctctaataatatttccttcatatatctgggtgcatcagtgttgggtgcatatatatttaaaattgttatatccctgtgatggttaatattgtcaacttgattggcttgaaggctgcaaagtattgtttctggatgtatctgggtgtttgtaggtgttgccagaagagattaacatttgagtcagtggactgggagacaaagacccaccctcaagaagacccatccacagtgtgggtgggcaccatccaatcagctgccagcatgggtagaaaaagcaggcagaagaaggtagaagaagctgacttgctgagtctttcagctttcatctttctctcattctggatgcttctgatctcaaacatcagactccaagttctttggcttttagactgttggactcacaccagtagtttgccagggcctctcaggactttggccacagactgaaagctacactgtcagcttcccttcttttgagattttgggactcggaatgagccactactggcttccttactcctcaacttgcagacggcctgtcatgggacttcatcttgtgattgtgtgagtcaattctccttaataaactccttcatttatacatatattctttagttctgtccctctagagaaccctaatagaatcctcttgctgaattgaccactttgtcattatatagtgaccttctttgtatcttcttacagtttttaaccttgaaatctattttgtcttatataagcatagcaactcctactcctttgatttccattggcacggaatatcattttccatcccttttttagtctatgtgtgtctttataggtgaagtgtgtttcttgtatgcaacagaccagtaggtattgttttttttcacccattcagccagtctatgacttttgattggaaagtgtagtccatttaccttcaatgttattattgacaatattattgacaagaacttactcctaccatttgattatttgtcttctgtttgttttgtgctgttctcttccttctttctttcattcctgattttgtgaagatgattttctctaataatatgatttagttccttgccttttattctttgtgtatttgttgtatgttttttggtttgaggctaccatgaggtttgcaaatactattttataatccacttttaacctgataacaacttaatagtatttgcataaacaaacaagaaaaagaaaactaataaaacttgcattaactttgtcctcccatgttttaactttttattgtttctatttatatcttcttaaactgactgtgtcttaaaaagttgttgagttgttatttttgattggttcattgtttagtctttctacttgggacaagtatagtttacatgccacaattacagagttataatattctgtatttttctttgtacttactattaccagtaagttttataccttcaggtgattatctattactcattactatccttttctatttgattgaagtactccctttggcatttcttgtagaatggttgtggtattaatgaactctctcaacttttgtttgtcagggaaaaacatttctttctccttcatgtttgaaggacatttttgccagatatactaatctggggttaaaggttgtttcccttcagcattttgaatatgtcatgccactctctcctggcctgtaaagtttccactgaaaagtttgctgccagacatattggagctccatagtattttgtttctttctcttgctgcttttagaatgctttctttatccttgacctttgggagtttcattataaaatgcctcgatgtactcttgtttgggttaaatctgcttggtgtttaaccttcttgtaccgggatactgatattttcctctaagtttggaaagttctcattattatccttttgaataaactttctacccctatctttttctctaactcctctttaaggccaataactgttagattttcccttttgaggctattttctagatcctgtaggtgtgcttcattgttttttattcttttgttttgtcttttctgactgtgtatttcaattagtctgtcttcaagctcactaattttcttctgcttgattaactccactattcaaggactctgatgcattcctcagtatgccaattgcattcttcaactccagaatttctgcttgattcttttaaattatttcaatatctttgttaaatttatctgatagaattctgaaatccttctctgtgttatcttgaatttctctgagttcctttaacatgggtattttgaattctctacctgaaatgtcacatatctctgtttctccaggattggtccctcgtgccttattgagttcatttggtgtggtcatgttttcctagatggtgttgatgctagtagatgttctccactgtctgggcattgaagagttcagtatttattgtggtattcactatctgggcttatttgtagctgtccttccttggaaggctttccagatatttgaaagaacatggatgttgtaatctaagttgtttctgctttcaggggcaccctaagtctagtaacactgtggttcttaaaagatgtcttaaaacttaataagaaaacatactcacaaaaacctgaccttaaaatgtacaaaagacctgaacagagacctctccagagaagatatacagatggcaaaaaaacatatgagagatgctcaccatcatatattattaggttactgcaaattaaaacaacaatgagatactaccacatatctaacagaatggccaaaatccaacacactgacaatgctaaatactcatgagcatgtggaacaacaagaactctcattcaccgcttgtagtaatacaaaaggtacagccactttggaagacaatctgtcagtgtctttcaaaactaaacacactctcaaatataacatggatgaacctgaaggacattttgctaagtgaaataaaccagatacagaaagacaaatactgcattaactcattcatatttgaaatctaaaaaggttgaactcatagaagtagagagtccaatgatgattactagaggctaggaggctgaggagggaggaaatgggagatggtgatcaaagagtacaaagtttcagacagacaggagcaataaggtttgagatctattgcacggcagggtgactacagccaataataatgtacagtatatttctaaataactaaaagtaaatttcaaatgcttcaacataaaaaatggtaggtaagtgacatgatggctatgctgattagcttgatgtaaccattttacactgtataaatctatcaaaacatcacattggaatccacaaatgcatataattacaatttgtcaattaaaagtaatatcattaaaatgtttaaaaactaaatacacttttatgatacaatctagcaatcatgatctttagcatttatccaagtaagttgaaaacttacgtgcacacaaaaacctgaacatggatatttatagcagctttattcacaattgccagcaacaaaaacgtccttcaatgggtaaatggataaattgtagtagatacagataatgagatgttactcactaataaaaacaataagctatcaagctaatgaaaagatattgaggaaacataaatgcatattactaagtgaaaaatgccaatctgaaaaggatacttactgtatgattccaactgtatgacattctggaaaaagcaaaactatggagacagtaaaaagatcactggttgccaggatttaggcgggagggaggaatgaataggtgataggtggagcacggaaaattttttttttttttttttttgagacagggtcttgctctgtcacccacactggagtgcagtggtgcaatgtgggctcactgcaacctccacctttcgagttcaagtgattctccgggctcaggctcctgaatagctgaaaatacaggcgtccaccaccacacccagctaatttttgtatttttatagtacaggtagggtttcaccatgttggccaggctggtctcaaactcctgacctcaactgatccacccgccttagcctgctaaagtgctgggattacaggcatgagccaccatgcccagctgagcacagataatttgtaggacactgaaaatactctgtatgatagaataatggtggatacatgccatcagatatttatccaaacttttagaacgtacaacactaaaagtgaaccctaatgtatactataacctttgggtgataatatgtcaatgtaggttcatcaactgcaacaaatgtaccactctggtacaggatattgataatggggaaggccatgtatgtgggagtagaggcagagtagatgggaaatctataaccttcctttcaatttggtggtgaaattagaattgagctaaaaactaaagcttacttttaaaaaatcactgagacatattaaagacaaagtaactaaatggaaggctatacaatgtttgagaactattaacagaaaactcaatattgtaaaaatgacaattatccctattgcattagcatcatgcaatatgctgattgcaatgatgatcagcatcatcacaatcaaaattctagctagtattttaaaaatataaattgataggctacttgtaaaatgtatatacaaatgcaaaaggccatgaatatccaagaacaacctgaaaaagagtaaagctggaggacttatgctatcagacatgaaaacatattcaaaactataataattaaaatagaatgttttgcctaaagatagacaaatatataaatggaatacaatcaaaactgtctcacacatatatgaccacttaatttaactgtaatctaaatataaaagtaataccacaaatttctaggagataggaaaatattgttatgacttgagtagacaaagattttttaagcaggacagtagtcactaaccataatgagaaggactgatgaactggactacagttgacctttgactaacaagggttcaaactatgcaggcccatttatatgcagagtttttcaataaatgtactggaaaattttttggagatttgccacaatttgaaaaaactcacagatggaccatgtagtgtagtccaaaaatatatttaaaaaaaagaaacggttatgtatgtcatgaatgcacaaaatatatgtagatactaatgttttatcatttaataccataaaatatatacaaatctattataaaaagttaaaatttaacaaaactttggcatacaaacacaagaccttacatggcaatattcacagttgagagaaacgtaaacaaacataaagatacagtattaaatcataaatgcataaaattaactgtagtccatactgtactactgtaacaattttgtagctacctcctgttgctgttctgctgagctcaagtgttgcacgtatctacttaaaacacaatgtgacgctaatcatctctgcttgagcagttcctctctccagtaaattgtttattgcaataaaaattccttaggtatatttccccgtgtttagcgccataccgtaaacctagaataacaccaaaaggactcatatgaaatgccactagtgatgctggaagtgctcccaaaaagcagagaaaaagtcacgacattccaataaaaagttgaattgtttgatatgtaccatagaatgaggtctgcagctgtagttgcccaccatgtcagataaacaattcatcttgtaaacagacaatgtaaacttaagatattgagcaatattacacagtactaaaaatgcattctcttttcctcatgattttttaaataacatttttctctagcttactttatcataagaatacattatataatacttataacataaaaatgtgtgttaatcaactgtttatcagtaaggttttcagtcaacagttggctattcatagttaactttttgagtcgtcaaaagttaaacactttgttttttttttcttttgagacggaattttgctcttgtcacccaggctggagtgaagtggtgcgatctcagctagctgcaacctccaccccctgggttcaagcaattctcctctctcagcctcccgagtagctgggattacaggtacgtgccaccacatctggctagtttttgtatttttagtagaaatggggtttcaccatgttagccaggctggtcttgaactcctgacctcaggtgatccacccacctcggcctcccaaagtgctgggattacaggcataagccaccgcgctgggccacacacgtatttttcaactcatggaggtaaacacccccatgttgttcaagggtcaattgtacattaaaattaagcacttctgttcaccaaaagagatatttaaaaggcaagccaaagagtagaaaaagttatttgcagtatatgtataatttgtatggatatattttaaaatcctacaaaataataataagaagaaggtaactcaatagaaaaaaatatgggcacaaaacttcaacaagcactttccaaaagaggatattctgaatggctgataaatgtttgaaaaggtgctcaactttattaattttcaaggaaatgcaaattaacaccaccataaaacactgctgtgtaactaccagaatggcaatatttataaaataaatgctattgtatatatataaggtacataacatgatgctataagatatatagtaaaatggtttctgtagtggaacaaattaacatatccatcatcggccaggcgtggtggctcacgcctgtaatcccagtactttgggaggccaaggcaggcagatcacctgaggtcaggagttcaagatcagcctgatagacatggtgaaaccctgtgtctactaaaaatacaaaaaattagccaaatgtggtggcaggcacctgtagtcccagctactcgggaggctgaggcaggagaatagcttgaacccaggaggtggaggttgcagtcagccgagattgcgccattacactcctgtctaggtgacagagcaagactctgtcttttaaaaaaatatgatgataatgataatttgctgggtgtggtggcaggcgcttggagtcccacctacttgggaggctgagctgaggcaggagaattacttaacccgggaggcagaggttgcagtgagctgagactgagccactgcactccaacctgagtgacaagagcaaaactctgtaaaaaaaaaaaaaaaaaaacaaacaaacaacaacaacaacaacaaccaaaaaaaaaaccatcatagttactcagctataacctcatttagcaaaagtcttgaatacaatacactatgatcaaccatattcctcgtgttttacagtggatcttttgacttgttaatccatcatatttattattttgcatcctttgacctacatctccccatttctcctcccaactccaaccctggtaactactgttttattttccatctctatatgtttgaccttcccctgtcaccccacccacccagcagattccacatataagtgagaatatgacatatttttctttccatgtctggcttatttcacttagcataacatcctctaggtctgtccatgttgtggcaaatagcagaatcttatccttttttaaaactgaattctttatcattcatccattgatggatacttaggttgtttctgtatcttggctattgtgaatagtgctgcaatgaacttgggagtgcacatatctttacaagatggtgatttcatttcctttgggtaaatacctggaagaggattgctggatcataaggtagttctcttattaattcctttaagaacctccatactgtttccacaatggctgtacccatctacattcccaccaacagtatacaagggttcccttttctccagaccttcagaatggcaatatttaaaggattaacaatacaaaatgttgatgaaactggagaaaaactataattttcatatttctgctaggaataaaaatgtggaaaattgttcagcagtatttacaaacactggacatatatacgtatatactttatgacccaataattttacttccaggtatttatcaaacagaaatacatatatctatttgcacatcaaaaggcatgtgcaggatgttcagagtagcactatctatatagccaaatgacataatgcccatcaataatagaataaattatgatgtgttcataccatggactactacacagcaatgagaatgaacaagctacaatcacttgcaacaatatggatagatctcacaaatacaacattaaatgaagaaaatcattcataaaattgtacctaatatatgattccattaatgtattggtcaaaaccaggaaaaactaattaatgatgacagaagtcaggagaatagctgattctgggcatggtaagggagaggcatggctgaagactggtagggcatattaggaggttttcaagggttgattctgttttattctgatctgcacagtgctgaaataggcatgttcactttgtgaaaattcactggctatatgcttgcactttttaaaatccgtacattacttttgtgcatatgttacctgtgattaccacaaataaagattctacacaaatatacatctgcacaaatatttgcataaagacagaaaataattctaaacactatactgaattcacagctaaaattttaaaaaacttgttaaattaaccagatccatgatataaataagtgaacaacactataaaagatgactttagaagattccttttatgtctgtgtattataaactgtccatcttatgattcatccctggtttcttgaataaaatcattaaaatagttgtcagctcttatagacctgaagcaatgtgatcaactttccgaaggtataggaaagagaaatgaaaagagccaaaggctgtttccattttgaaaacataggctttgggtataaaaaacaaaagtaatacttggcttagattggtacctatgttaacttaattacaaactgatcttttattgtttttaattaaatgctactgttttcaattttttactaaaacatgtattattaaataagggagactcccaaagatacctactctaaaatgctctaagaatgaaaataattggtctttatttataaatgaatcttttaaaataaaataataagtgactattaggagatctgtgatcttttctcatctctatcactatgcacatttatagatgatgaaactggcaaaaaaaggtaaatgacacaccttaagcaaatcatttacctttttttggtcagtttcatcatctataaaatgtaagaattggataagttctcattcggccttagcattctatgtataaagcaaatgtatatgaagctaaactttgtaagatagtagattatcctagctaatattaactcttgcgtaaaatacacagaagcattctgttcattaattgtccttaaatatgtatcattcataaccttgaagtcactataattacgaatttatgatgccaatttactgatataaattttgaaagtatctcttctttcttgtaataattaagataattaatcttaagattaacaagtggttgctttatagctagaatgtacaattgttctacaattttagtattccaactctgtctgaaagattgtatgaagttatagagtctctttttccattgcatttttggaaagacacaacacaaataatattcccagaggaatactgggtttctcatatctctgataagattgataagaaatctggtagtacacttggtaagaaacagaatggtagaaggaaaaaaatcaatgatgcatccagaagacagcacttttctaggaaatgctatgttattttcaaacatgtccccaaatctgtacaagttattgtcagaaactgtctatctttgtaacaagtggcaacataaaaggaacctgttagtgttccagtttggagatcaccaaggtgagagaattcaaggtggaagtcacatgaaggacaacctgtatcaaaagtaagcaaaatgtctcagaaggatgctctgactcactgtgatctttcttgataaacacacagaataatggattcgttactcagttttctctctagttagaatatttatgttaatgtattgggctgtgctcccccaaggatatggagaacaatattagataattaagcaagaacgaaatgctaaagaaacagaaataatatgactacccacacttttcagctcaaaatatttctggtgttaagattagaatgacctacaaaagattcccatagaataaaaaatttataactgaaaatatctgtggcaaatatccagataaggaaagtgccttgctcaaggtcaaagctacttagtaacaggaatagaacctgttactaacaggcactgcttagtagttttgacctccaagtagtcagtgggcaatagacaaatagacaaaagagatacatctagttttcaggtactcaagagactttcttcatattattatatatgggttagcaaggtcccatcacaaaccttcataataaacaagggattaacatatatgaatgtgtgtgtatatttgtatatatacatatatatgttaacatatatgtatatatattccattacacacagtaacatgtttcccaattcactccctgtctgtgcccttcctccaactgtaatcttagcaaaccacaatccataaaaagctgagtaggggccattatcaagagaggcaaaagagacgagatttggtatctcttttcaagatctaagcatcttgacttgcagaggattgactttgtttgctaaagcgcactatccagttaggactgaaaaatattcccagaaaaatcctaggtaattctaacttttctaggtcacatttatcactgagactcattacatggctttcacaatgcccaaagacatcattatagataacctccaaattatataaatcttgcatagcaaagagagggtagataaagaatcccagctgtaactaaattattgaatcctaatcacaaaaggagactataaagactgttttataacagaaaggtctgtaggaaactatgctactgattttaaaaaattaagatatcaccaagatatgggagcatattgaggggaacgaagaggaaacagaagcctaccaaagcaggcttggaatgtctgcccggccagaccactggatcttaagctagttgcccattagagctcacctccatgctttttgaatattcccttttacatccacccagaagaattcattttctcactcttaatctagtgctcttgacattttactttgctcctttcctttcatcctttcaagattaatattagtcaaagttatattgttctactaaaaatttaaaaaatgcaaataattaggtggaaaatatgtaattaagaatactttgccttgaattttcctgataattgcttcaataatttccttgacaaaaaacatgagcttcatcttagtaaaactatatcttgttattaaatcacatactgtaacctagagtacagtggactatctaaaattcaatctgaatcttctaaactttttggcaaatgaaatcatcacaattcaagctagtttaagcaaaataaggtaaaatagtacctcaaaataaggtaaaatagtggtgcaagtagccagacataccatccatgggtatgtctggttatagccatagacagatccagggcaccagcaagagtatcaggacacagtatttttccattgtgtggctctgccaccacagtaattatcaggaaggctctatctctagtgtggcaaatatgagcaacagaagctccccacttaaattctcccagcttagcaaccctagtgaagagaaagaacctctttccgaagctccagcaaaatatggcaggacttatactcactgaccataacatggtttgggtcatacacccatccctgacaaagcatgtgagttttccctttggacaagcctgggtttcagaccctgtggagttagaaggtagactcaaggccatctgaactatatatactaactggaagggaggaatagtttcctcttgtacaaaaacctggttctcttaccagaaaaagagagaatggattctggtcacaaggacaagaaacagaaggttcactaccagaacacatactctagaaaatacaaaagtacctcatgaaagcatatgttgccatggaatattcccaaagatagtattttacaaagatgtcaacatatagatgatcattatggatgaacaatataactcttggtgccttacagacaaagacatcttctgaaagagtatgaactttatatgccaacttgaaaattataaaatgttattgcctttttaatggtaggcaaaaaaactaggcaatcagaaaaaattcaaatgttacttcataattataaaactttttaatttaaaaaattcttcaaagttaaaataatttatacatttggtcatttttttaaaaaaatgaacaggtttatatggtttcagtgctgcactgaaatgacatctatagttatttttaattgctatttacaggaatcttgatatccttgtaaaatctgttactatagaaatctcagcaaataattagctcctcagggaaaatccaactcttcataacttctagttgaaacaaaaaaaatagcctttagctcttcttcctaaataatgatacgtttattacttatacattgctgcccactacatgtaaaataaaactaaattttttccttagaaatgctttcagacattgtatccacctcttcaagatatttaaaaataaaaaaaatttattttaactgttaacaggtttagaaaaattaatacaccatggagtctatagccttgcaaattattttaaaatgattattttctgttctttgttttctgttcttttttctcccatttcacaatcccctgtggctagaaacagacaacaaattaagtacaatgaacattctttctgcttactagggacaagtgacttttttttttcttttttcttttttgagatggagtctcgttctgtcacccaggctggagtgcagtggcgcaatcttggctcaatgcaacctccacctgctgggttcaagcgattctcctgcttcagcatccctcctagctgagattacaggcatgcaccaccacgttcggctaatttttgtatttttagtagagacggagtttcaccatgtcggccaggctgagggtctcgaactcctgacctcaagtgatccaaccacctcagcctcccaaagtgctgggattacaggtgtgagccactgcgcccaacctgacaagtgactattttcaagctaagtaaattaaatgtatctctaaatagctcataaataataataagtgtaaatacttaactctaatgtatatatgttttattgtttatatatatatagtgtttaattctaaaaggaatttaaagcaactttgaagatgtcaaagtaaaataaacaagatgaagcaaaaggcaaagagagtataaaagcaagctaaaaccaagaatgaggtttgtactcagtatgcattccatgaagtccacttactaatagtggatgttaacctaggtactttagtttcaaagtccctcaagtgaacaatataggttattccaatacaaaataaaatactgaatggcaaaagagaatcctacattgtatctgaagtatgtctgtaaacattagaacctagcaaaccgagcataatatgtatacatatacatagacatacatatacagagagatgcaaaattcttaaagcttgcatttatcctgagtttactactttattgattctgatatactcaagccagaatgattttatattgtcctaatacagacctattttcaatatgtgctaatgctatagtttgagtaggctaaaatgatttgttctaaatagtcatttttacatgatagggccaagcaaagttaaaattagaggttggatgcaccacaaataacagagagagcaggccaggcttagatccaaagaagcagagtcctggaagcccaaggcttattgattgatggatggagaatacaaggaagcaatgggtacaaaaaaaaatggcaggtgcataaagttactgctaagagagagaatagagaattgggagcacatggtaaagaacaaaggaaaggtaaagaaagaaagataagaacagaaaaattttaacatagcatatgagtgaattacttcttagaagcctagtaggacttgctccagatttttttcttgataacccactgttatcactcacagattcaaaattaattctctcgcctttctgcaaatagcctaaaacgtattcattatttttttacaacagagttatcataatcaacaacatccaaagaaacaagaccttaaaatcaagcacaggctataatcctggctatctggtttttgcacagcatgtaatgatgtagattccaagcagtaggtgcttgggaaagagtcattggcaattctaagttaacagtttggtaggattcttgtgatcttcctcaacccaggtagcttcaagtgccccccactaaacctcttttctaatcagattgctacacttaacctgctcgtggggaccgtcacagcttggtcaaatagacctgggcttgactccccaattcacctattgacaaagaatatttatttagtttttcccagtttcaacactcactactattttggggattatactatttatctcaacaagctgctctggaagtcaaatgagatactgttgcaaagtacctagttatatccctgaccatcataaaatggtagatattataggcataggagagaagttcaagagcattggcattacagagggatatggtcttccagtgattggaaatgattttttctagagatgaaagctggttctaatccggtcaacctccttttcactgtgggaacccaaacaatcagtatctcaccctcaccatatgcacaatgatgttggattagatgtgatagatcatctctaaggtatgcttcccctctataaaattctgtggctatacaagtattgtaaattagaaattttccagttaatttcccttggggcttactagtcttacattgaactcccttcttttgtcctctagttttcatcattaatatttcaaatcatcatgaagaacaggtaagatgacaccaaccctaaaaaatagtatttagtattgtggatgatcaaaaccttttgaaacaaggcagaccttacattaaatcctgactctccaatattggttatacgaccttgaaaaagttttttcagcgccctgagaatttgtttctattttacaaaatgaggctaatgagtaatacctaccttaaagtattagtttctgagagcttgaattctcctggcttctagtaggcattcaatattatattattttgtaccctgaaagaatcattaaaattcagctttaaatctttctggatatgcttaacacatttttgattgaagaacatggcaagtatcttaaagatattttacctccaaaatattgtctaatttaaaaagccaaaaataaagtaacagcaagttatcaaaatgatggctctaactttgctacaggttgagcatccttagtctgaaaatctaaaatccaaatgctgcaagacccaaaactttttgagccaccaatatgatgacacaagtggaaaatgccacaccacacctcatgtgacaggttgcagtcaaaatgcagtcaaaacctttccacgcacaaaattatttaaaatattgtacgaaattaccttcaggttatgtgcataagatgtatataaaacaaaaatgaatttcatgtttagacttgggtccctttcctgagatatctcattatgtgtatgcaaatattccaaattcagaataaaatgaaaaccaaaacactctgatcccaagcatttcagataagggatactcaacctgtaccaaactgtggcaagataagactattaaacatctgaagtgtacctcagattgaactatcaagaattacaaccacattgagaaatgtgctttaaaatgttgtcatgagcacacgttagtgatgagacaaaaattgttattcacttctgaaagacccctgaactgaatatttaagtactatttcaaagcctatttttataaaagtgcatcaaaatgttcagaaagattatttgtgaataatgaaacaccatttcaaagccagaaggaaaactagattggctcacttttcagttctcatattattagttcaataggtttatttaaaaatctctctgatcttttactctgactcactgaaagcaaattttgaaaagtgaaaaacctataaggcttttcattttctactaagtatcttccacaaatctaacatcaataaaataagacagccctggacctgaatatgacagcctttacatggttctaatgcattgcctaccctatgcacagaacaatcactaaactcagcaggaaaaaagatcaatcagtaaaaataggaatttgagtttaattcaagtacctgggaataccaacatgctttcatataatctcagtactgattacttttaaaaaggcataacacttcatttaaaatgaatatctgagtgcagttgattatttatgccctttatatatctctaactattcaactaataataacaaaaacaataatcgttaacaatttcttgagtatatacaacagaactgaatcactgacttaaatactttacataatgacctcatttaatcctcaaaactattctacttacagttgataaaactgagtctgggaggagccaagatggccgaataggaacagctccggtctacagctcccagcgtgagcgacgcagaagacaggtgatttctgcatttccatctgaggtaccgggttcatctcactagggagtgccagacagtgggcgcaggccagtgtgtgtgcgcaccgtgcgcgagccgaagcagggcgaggcattgcctcacctgggaagcgcaaggggtcagggagttccctttccgagtcaaagaaaggggtgatggacgcacctggaaaatcgggtcactcccacccgaatattgcgcttttcagaccggcttaagaaacggcgcaccacgagactatatcccacacctggctcacagggtcctacgcccacggagtctcgctgattgctagcacagcagtctgagatcaaactgcaaggcggcaacgaggctgggggaggggcgcccgccattgcccaggcttgcttaggtaaacaaagcagccgggaagctccaactgggtggagcccaccacagctcaaggaggcctgcctgcctctgtaggctccacctctggggggcagggcacagacaaacaaaaagacagcagtaacctctgcagacttaagtgtccctgtctgacagctttgaagagagcagtggttctcccagcacgcagctggagatctgagaacgggcagactgcctcctcaagtgggtccctgactcctgacctccgagcagcctaactgggaggcaccccccagcaggggcacactgacacctcacacggcagggtattccaacagacctgcagctgagggtcctgtctgttagaaggaaaactaacaaccagaaaggacatctacaccaaaaacccatctgtacatcaccatcatcaaagaccaaaagtagataaaaccacaaagatggggaaaaaacagaacagaaaaactggaaactctaaaacgcagagcgcctctcctcctccaaaggaacgcagttcctcaacagcaacagaacaaagctggatggagaatgattttgacgagctgagagaagaaggcttcaggcgatcaaattactctgagctatgggaggacattcaaaccaaaggcaaagaagttgaaaactttgaaaaaaatttagaagaatgtataactagaataaccaatacagagaagtgcttaaaggagctgatggagctgaaaaccaaggctcgagaactacgtgaagaatgcagaagcctcaggagccgatgccatcaactggaagaaagggtatcagcaatggaagatgaaatgaatgaaatgaagcgagaagggaagtttagagaaaaaagaataaaaagaaatgagcaaagcctccaagaaatatgggactatgtgaaaagaccaaatctacgtctgattggtgtacctgaaagtgatgtggagaatggaaccaagttggaaaacactctgcaggatattatccaggagaacttccccaatctagcaaggcaggccaacgttcagattcaggaaatacagagaacgccacaaagatactcctcgagaagagcaactccaagacacataattgtcagattcaccaaagttgaaatgaaggaaaaaatgttcagggcagccagagagaaaggtcgggttaccctcaaaggaaagcccatcagactaacagcggatctctcggcagaaaccctacaagccagaagagagtgggggccaatattcaacattcttaaagaaaagaattttcaacccagaatttcatatccagccaaactaagcttcataagtgaaggagaaataaaatactttatagacaagcaaatgctgagagattttgtcaccaccaggcatgccctaaaagagctcctcaaggaagcgctaaacatggaaaggaacaaccggtaccagccgctgcaaaatcatgccaaaatgtaaagaccatcgagactaggaagaaactgcatcaactaatgagcaaaatcaccagctaacatcataatgacaggatcaaattcacacataacaatactaactttaaatataaatggactaaattatgcaattaaaagacacagactggcaagttggataaagagtcaagacccatcagtgtgctgtattcaggaaacccatctcacgtgcagagacacacataggctcaaaataaaaggatggaggaagatctaccaagccaatggaaaacaaaaaaaggcaggggttgcaatcttagtctctgataaaacagactttaaaccaacaaagatcaaaagagacaaagaaggccattacataatggtaaagggatcaattcaacaagaagagctaactatcctaaatatttatgcacccaatacaggagcacccagattcataaagcaagtcctcagtgacctacaaagagacttagactcccacacattaacaatgggagactttaacaccccactgtcaacattagacagatcaacgagacagaaagtcaacaaggatacccaggaattgaactcagctctgcaccaagcagacctaatagacatctacagaactctccaccccaaatcaacagaatatacatttttttcagcaccacaccacacctattccaaaattgaccacatagttggaagtaaagctctcctcagcaaatgtaaaagaacagaaattataacaaactatctctcagaccacagtgcaatcaaactagaactcaggattaagaatctcactcaaagccgctcaactacatggaaactgaacaacctgctcctgaatgactactgggtacataacgaaatgaaggcagaaataaagatgttctttgaaaccaacgagaacaaagacaccacataccagaatcgctgggacgcattcaaagcagtgtgtagagggaaatttatagcactaaatgcctacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaatcaatgaatccaggagctggttttttgaaaggatcaacaaaattgatagaccgctagcaagactaataaagaaaaaaagagagaagaatcaaatagacacaataaaaaatgataaaggggatatcaccaccgatcccacagaaatacaaactaccatcagagaatactacaaacacctctacgcaaataaactagaaaatctagaagaaatggatacattcctcgacacatacactctccaaagactaaaccaggaagaagttgaatctctgaatagaccaataacaggctctgaaattgtggcaataatcaatagtttaccaaccaaaaagagtccaggaccagatggattcacagccgaattctaccagaggtacatggaggaactggtaccattccttctgaaactattccaatcaatagaaaaagagggaatcctccctaactcattttatgaggccagcatcattctgataccaaagctgggcagagacacaaccaaaaaagagaattttagaccaatatccttgatgaacattgatgcaaaaatgctcaataaaatactggcaaagcgaatccagcagcacatcaaaaagcttatccaccatgatcaagtgggcttcatccctgggatgcaaggctggttcaatatacgcaaatcaataaatgtaatccagcatataaacagagccaaagacaaaaaccacatgattatctcaatagatgcagaaaaagcctttgacaaaattcaacaacccttcatgctaaaaactctcaataaattaggtattgatgggacgtatttcaaaataataagagctatctatgacaaacccacagccaatatcatactgaatgggcaaaaactggaagcattccctttgaaaactggcataagacagggatgccctctctcaccactcctattcaacatagtgttggaagttctggccagggcaatcaggcaggagaaggaaataaagggtattcaattaggaaaagaggaagtcaaattgtccctgtttgcagacgacatgattgtttatctagaaaaccccatcgtctcagcccaaaatctccttaagctgataagcaacttcagcaaagtctcaggatacaaaatcaatgtacaaaaatcacaagcattcttatacaccagcaacagacaaacagagagccaaatcatgggtgaactcccattcacaattgcttcaaagagaataaaatacctaggaatccaacttacaagggatgtgaaggacctcttcaaggagaactacaaaccactgctcaaggaaataaaagaggagacaaacaaatggaagaacattccatgctcatgggtaggaagaatcaatatcgtgaaaatggccatactgcccaaggtaatttacagattcaatgccatccccatcaagctaccaatgactttcttcacagaattggaaaaaactactttaaagttcatacggaaccaaaaaagagcccgcgtggccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataatgccgcatatctacaactatctgatctttgacaaacctgacaaaaacaagcaatggggaaaggattccctatttaataaatggtgctgggaaaactggctagccatatgtagaaagctgaaactggatcccttccttacaccttatacaaaaatcaattcaagatggattaaagatttaaacgttaaacctaaaaccataaaaaccctagaagaaaacctaggcattaccattcagtgtgacatgggcgtgggcaaggacttcatgtccaaaacaccaaaagcaatggcaacaaaagacaaaattgacacatgggatctaattaaactaaagagcttctgcacagcaaaagaaactaccatcagagtgaacaggcaacccacaacatgggagaaaattttcgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaagaaatgctcatcatcactggccatcagagaaatgcaaatcaaaaccactatgagatatcatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaatgagtataaatcatgctgctataaagacacatgcacacgtatgtttattgcggcactattcacaatagcaaagacttggaaccaacccaaatgtccaacaatgatagactggattaagaaaatgtggcacatatacaccatggaatactatgcagccataaaaaatgatgagttcatatcctttgtagggacatggatgaaattggaaaccatcattctcagtaaactatcgcaagaacaaaaaaccaaacgccgcatattctcactcataggtgggaattgaacaatgagatcacatggacacagcaaggggaatatcacactctggggactgtggtggggtcgggggaggggggagggatagcattgggagatatacctaatgctagatgacacattagtgggtgcagcgcaccagcatggcacatgtatacatatgtaactaacctgcacaatgtgcacatgtaccctaaaacttagagtataataaaaaaaaaaaaaaaaaaaaaaaaaaactgagtctcagcaagtttaaataacttgatcagaccacacattaatgatggagctaggattgaattcagacatgtcctatatatttcattcattcatgagtatattaatttattcagtgaatatctttgtcctaaagaaatgccactgtagcagaaagatggttgcaaattctttgtcactgtgctcattgaaaggcaaaacgtattgttctccccttaaatatagacttgccctgtgacttggtttgaccagtggaatgtggtggaagtgactaagatacttccaagctagcacaaaggagatctgctgtttttgctatcaccttcttggaatattctgggaaccataccactgtggagtgagaagcccaagccatgtaggaggccacagggagcagaaccaggacgtgccagtcaacagcctcaataaccagcaccaaagctagtcatgtgtgtaagcaatcttatgcatcttagggctgttgaacactgagatcattgcagccccaactaacactacatgtagtggaaaaaccacccagcagtatacagtcaactcacagaatagcaagagacagtaaatggttgcttcaaacaaccaaattttggggtgactagttatgcagcagtggataaagagctgcaatatttttcttgaaatgagagcattgggtataatatagcaaaatacaaccctagaaataaaataagtaactataataatattattttggcataatatagcaaaatacaactctaataataagaaaaagcatgaagcaattgcttttctcttgtggctgggcatgatttttatactgaaagcctagtaaagtaggaaaatcagaagagactatggctctttttcttcacttatttattcatgtactcatttatttaaacttactcatttatatattcattaagcccctatttcttgttacatgtgagtgtctttgttaactactgtgggtcatactataaatcaagataagcctactgcctttaagaacttttaggtctaaagaaggtaaatactttttggttgattgactctaatgcattctcaaaacagtaaagtggaagttagaaaaattaaggaaagcaagggggaaaattggagaagcccagtccaagttttaatttttgctgttgataatacacaaggtaaattatgaaatatgtactgtacttatattttaatatttcatttctacccatagaatgttaagccccccaaaaatgaacataaaagagagtgtgtattcaattgcgtttgctcttctgcttggctctccttaaggcttctgagtttctaacctgtcaaaggattagtttccttaaatgcaaaattaagatgattctacccctacctgccccaaggtgtattatgccatgcaaaatgataattatgagataaaactattaaatctttatattggggtcagaacttatttacataaccatcttattcagaccatggcaatgcaaaagtgatattttatgcacttgtaagcagcagaagaaaataaaaattaactgtaaaagctctatccaaacttaattaaacaatgtctccacacattcaaataggagattctaatagggctgaggatcaaaatactcagtcctcctgtcctcaaagctgggtgtgggatgcaattggttccatcagattcctcccccaagaattgttagatttggagctaatggaggaagggcttggattttgagtcactggtcagaaggatgtgaatcaaacactgccccactatcttccctattacacagagaaagcctatattctataacaaaatatgagatccacacagacaaacagaggtgagggacagaccaagtcttgataacctcgcttggtcctctggatcaggctgtgcctaaaactgtgataaacgttcacttcaaagttgtgtgaaccaaaaattctcttttattattcaagttaatgtaagttggatttctgtccactgcttccaaaagaatcttgtctaaaaataaaattaaagcatcagaggtatactgaaatcatctgagacctttcataacttgtttgggcaactaatctcttatgaggataaaagtatcatcattctcagtaaacgaccacaagaacaaaagaccaaacaccgcatatcctcactcataggtgggaattgaacaatgagatcacatggacacaggaaggggaacatcacactctggggactgttgtggggtggggggaggcgggagggatagcattgggagatctacctaatgctagatgacgagttagtgggtgcagcgcaccagcatgtcacatgcatacatatgtaactaacctgcacattgtgcacatgtaccctaaaacttaaagtataataataaaaaaaataaaaataaaaataaaaataaaagtatctctaattgtaaactaagaaagatggtagttaaagcaagggacacaatgggtaacactcttatcctagccaccaacctgattgcattctttactttctagtcaagccccttcttcccttgtctaactacagatcaacacagatttttttctcatctttttttttttttttttttgagacagagtcttgctctgttgcccaggctggaatgcagtggtgtggtgtgatcacggctcactgcaacctccacctcccaggttcaagagattctcctgcctcagcctctcaagtagctgggaaaacttggacaggtgcacgccaccatgcccggctaatttttgtatttttagtagagacagggattcaccctgttggccaggctggtctcgaactcctgacttcaagtgatctgccctcctcggcctcccaaagtgctaggattacaagcatgagccaccacacccagcttaacctgcctttttaatttccaattcacaaagtgctatcctccaggatgccaggaaatgaactgggggacagaagaaagagtcaagaaaagaagataaaacttagcttgtagcctagtggcataatagctaacatgtctaaccattagcaaatgctcaaaaatcctgagcccagaaaagccttattcactacctttacagaaataaatctagaaggttagctatgctgaatatgttagggaaatggagaagcactgctattttgataatcaattcaaaagaaaattaaatttactaatggaaactaccgctattcattttctggacatatgtaaagataaagccagcttaaaacaacaaataaccaacctagtcttttaaccttcagatatggtgcaaaagcatgacctaaaagatactttttcattactagcgaagcaggctttagtctcaaactttaccttagaccattcaacgtctgcccatttgtcttgtactgacttttcctttcagtgccctggatgtcaagggaacttggctgccaaagactgaggctggaatcaaagtgctctgggctttcccaccagaactccatccatggggcatagaagcagacttggaaacagacaagtgctgtgtctgcaaaataaactaactagtgtagggcaaaatgggctctatgctttcctcaaccccagccccaacaaaaagcaagatccttgtggtcattttgcctttgcttacatccactgctgcctgaagctaaagaaaggctccttagtagaccatggtaagcccccttttatcctcctgctgtcagggatgaaagattccaagcctcaagtgcaacacagctgcagacgccgacttttccaaaagataaaaatcaaaacccaaaaaagaccacaagttcactttgaaattaaaaaaaaaaaaaaaaaaaaaaaaaaaaaaaaaaaaaacaggccttctcagagtggctactttccagacaccagacacacaaatgctttaaagacaaaagcaggttgttacatttgtcagggtgaataaaaagcctagagcaggactctcaagtctctctttctgtgctaaggaatgtcttcccaattttttgcagccttgaggaccgggagatgactgggaaattgctgacagggcagggaaagggctatactctacatgctggcattcacagacaaacaccgaggggcagcaacagcaaagaggagtcttggtgctcttcctggagttcccaggctttactggccatggatcctgttattcaatcaaatacttattgtgtgcctactacatattgggcactattctaggccctgtggatgtattagtgaactaagcaggaaaaaaaatcacctactcatgtgaaggttatgttgcaatagactttggggacagagacagacaataaattaaacaaataagtaaagtttataataccttagaaaataaaaagcactataaataaaataaagccaggaagagatataggaattgccagaagggcaaatggtagacttgccatttaaaattggcgttcatggaagattacaggaaaagtcaaagtttgaaagatttgaaggagggaagggagtaaaccagatatttgggaagaagagtggtagtggaaaagagagagcaagagcaaagactgagaggaaggaccttgccagccatgttcaaagaacagtaagcaggattcatgtctgcagtagagacagtgatggggcagaggttagagatgaggtcagagaagcagttttggaccaaattatatatggattgataaaacaccagtttttgctctgatgtgggcagtcctcagaaagttttgagcagaggtatgacacaatataacttggctgctgaattgagaaggacagaagcaaggagattagttaggaggccattacaataatgcaactagtactctggcgatttcaataggcatcttaattttttcacagtctaccttcaaataatactatactacttcatacataatgtaataaccaagtcactgcaacagaatacttccattcctccctcattcctttgtgctattatcatattttactcttatgttataaaccgcacaatgcattattatttttgctaaaaagaaaattattttttcaaagaaatgtaaacatgaggaaagaaagtcttgcatattttcccacatatttactatgtcttgcactcttcattcttttttgaggtccaaagttccctctggcattttccttcatcttgaattttttttttattattattatactttaagttttagggtacatgtgcacaatgtgcaggttagttacatatgtatacatgtgccatgctggtgtgctgcacccattaactcgtcatttagcattaggtatatctcctaatgctatccctcccccctccccctaccccacaacagtccccagagtgtgatgttcccctttctgtgtccatgtgttctcattgttcaattcccatctatgagtgagaatatgcggtgtttggttttttgtccttgcgatagtttactgagaatgatgatttccagtttcatccatgtctctacaaaggacatgaactcatcattttttatggctgcatagtattccatggtgtatatgtgccatattttcttaatccagtctatcattgttggacatgtgggttggttccaagtctttgctattgtgaatagtgccacaataaacatacgtgtgcatgtgtctttatagcagcatgatttatagtcctttgggtatatacccagtaatgggatggttgggtcaaatggtatttctagttctagatccctgaggaatcaccacactgacttccacaatggttgaactagtttacagtcccaccaacagtgtaaaagtgttcctatttctccacatcctctccagcacctgttgtttcttgactttttaatgattgccattctaaatggtgtgagacggtatctcattgtggttttgatttgcatttctctgatggctagtgatggtaagcattttttcatgtgtcttttggctgcataaatgtcttcttttgagaagtgaaattttctttatgatttcttctagtgcagaaaggctgagaatgagttatctcagcttttgtttgtctgaaagtgtcattttaccttcacttttgaaggatattttcactggggatatagaattctaagtcaccatatttttttctgcccatgatattaaagatgccattttattatcttctagactgcattgtttctagcaaaaaatcagtggtatgtcttactttgtttctctgtaagatgcctttttctttggctgcttttaagacttttaaagaatctctgattgtaattgtgatatacattagtatagtgtttttatgcttattctatttgggactcattgagcttcttggatctgtaggtttacagatttcatcaaatttggggatttttcagtcattaattttctatctcctgtcccatcttttcattctgggattccagttacatatgttagaaccctgtgttcccatgggtcactgaggccctgttcattatttttgagctttatttttcctctgagctttagttcagatagtttctactatgtctttaagttatatgattgatcttttttttctggagggtccaattaactgttatcctcatctagttagtttttttattcctgatactgtgtttctcagtttagaagttccatttgattttttctgtatttttcatttgtcacttcattgtgtccatattttaattgaaatctctatacatatttacatggctgttttaaaatctttgtctggtaattccattatttctattattcctgggtctgattctattgactaatttgtctcctggttatgggtcatattttcctgctactcagagtgtctagtactttttaattagttgaaaaacactatgaacattacgttgctgaatatctggatttttctgtcttcttctaaagactgttgaaggttattttggcaagcagtaaacatttcttgcaaatgagattttaaaggcttatgtttatgatctgttaagataagtcaaatgtagcctttaccttagagctaatttagtcctcctactgagacattacccttttgggtatctctaatgaatgcacgaggtgttcagtgcagtctcccaatgtggtgggaactgaaacatctcccagccctgtgtgagatctgggaaaggtttagctcacagttatccagtcacttccattgcccaacctcgtgaagcgtcaccatttgcatgaacatcttagcattcagcaaaaattcaagaagaatcctatgcatatttctggaactattttttatacataattctttcctcctagtgctctgtaccacaaatgtcagtaactttgttctccacaaattccaattttatcccttcaactcaaaagtcctgctgggctttgattatgtttcatttctctgtggcatagtccagaaagtaccttcaggctaaacttggagtgagcttagaaattatcttgtctgttgtccttctctcaggagccacagtcctacaataccggttgtccaacaaccaaaaatcattattttaaattttgttcaattttctgggtttctttatggtgggagagcaaggacagagctagaaagaacttgaaaaggaagtccacatccttcccttttgtagatgaagcaacagagactcagggtggagttgcagtacactcaaggtcacacagctactggtagaagcattaagctcagaagctgttttcgaagtccaatgtctttctcactccagcgtgctgcctcttacagaatgattggtagagtgtagcgtattagtttcctagggctgttgtaacaaattattacaaactaggaaacttaacacaatagaaatttattcttcctggccgggagcagtggatcatgcctgtaatcccagcatgttgggaggccaaggcaggcagatcacttgaagtcagaagttcgatgccagcctggccaacatggtaaaaccctgtctctactaaaaatataaaaataaaccaggtgtgatggcacttgcctatattcccagctatttgagaggctgaggcaggagaatcacttgaacccaggaggtggaagttgctgtgagccaagatctcaccactgcactccagcttgggtgacagagtgagacgaaggaaggaaggaaggaaggaaggaaggaaggaaggaaggaaggaaggaaggaaggaaggaaggaaggaaagaaggaaagaaagaaggaaagagggagggagggagaaagaaagattggcacttgcctatattcccagctatttgagaggctgaggcaggagaatcacttgaacccaggaggtggaagttgcagtgagccaagatcacaccactgcactccagcttgggtgacggagtgagagaaaatgagagtgtgagagagagagagagagagagaaagaaagaaattaatttattctttcccatttctacagaccagaaatccaaaaccaaagtgttggtagggctagttccttctgaaggttctgaaggagaatccattctataactctctcctagcttttggtgattgtttgaaattcttgatgttagttcacttgcagacaaatcactccaatttctgccttcttttcacatggccttatcctatcctctgtttgtttatgtcttctcctcctcttataaggatacttgtcattggatttagggttcacccagtaaactcacgatgattttatctagagatccttcactgaattatatccgcacataccttttctccaaataggggtacattcacaggtactggggattaggactggatatattctttttgggaaggggcacaattcaactctcaaaagatagaaaaggggaaaggtaaataatatagtcaaagtaacaatttgggaatatttatctcatataaaagcagacattgaagtttcccccagctgaatctattttggagaatttgaaagggtttccatctaggaccgtgaaggaaaaaaaaaatgcaaaagcaggttgataatgttatattttacctgggcacaatcatggtactggctcacacctcactacattcattaagtgcatcacgcatttaacaccattgttaatttggccaaataatccaagatgcaacaaggaattattgctttcagttactctaacctcttttgtctctaataaccatatcagtcatgactagaggcttgaatcctgaaaacggggacacgtagtaaagataaattactaacaagcccttacccataataggaggaaagtcatcactataataattctgtttgctgagatgacccaatgccagtttcagagtctttattaggtcaaaaggaaaggacatctaattgctatcttagctatcatttttcactaaccactgaaatgtgtggggttttttttagcatgaagtctttttttttttaatttttccaactttcttagcagtttcagatggtacattgtgagacaaaggcaaaagcaacagggagaatcatctcatgagaaaaattagcaataaagcactgtgacaggacagcaaaggcactttgttaaaaaattatttcaacctgaataatttgacagtgttaatttgttaagaaaaaaatatctagaacacataccaccctgagatccttaagcagttctctgaaactttgtttaatacaaacacttccactgcattgcaattgggaatacatctttcaacccacattttgcctggttataagtcctattgggtactgagcagaggcagtcaatttggtttgctttatgatctgaaccaaacacaaatattaagtgaggtcaaataacacaccccactggcaatcctcaaatctctaaagctgatttaaaagagactgggaaattgagctcaacagaaatggcaaaaataaagaagttcatttttaatgaacaaggaagcctaccaataccaatctccattgggccacagatgcctcattgtgcccaaattggattggaatgcacaagccaacaagcacaagcacaactgcccctccacccccacaaaaaaaatcacaatttggcagaagagaaagatttagaggaatgttaacttaatgcacctaaaattcaaatcatgattagaaaagggtattctggatatgacagtttaaggtaggtaaagagagttacgaatatgttcaaagtaattggaaaatgagcctaataccaagagaattacagaatattggtgatggaagagaattagagaataatttttaccttaaagtgtagatcctgagttcaggaagaagcagttacttgctcaaggtcagtgtctaaaactaaaacgggattagaacccacacccttttgagtctggtgctctctctactctgccaattgttctcaaggctgtggggggatgttaagagtttctcaaagttcacaactgggcctctttctttctctctcctcctcttccttatctcattcttttcccaagcttttattctcattgacagacttagtcatccaaacgtatttctccagttctgacatctctgaactccagacttagaatcaacagttctatttctgggtctcccaggccgctcaaacttaacatgtgcaaatgtaaacatctaccccccatccttcccactacagacttgttcctccctgcttgttctctatctactagatggaactatcatcttaccagtgtcagccttgaattggtatcttttctttactctttccctacagccaaccatcagtaagacctcctaagtgtatctcgaaaacatctatccactttctctgaccccaccttagtccaagccaccaacatcttgttcctggactgcctcctaacctctctctctgttctgatttttccacttccagttcatttgccacacagtagccagagtgatcttttaaagacattccgtttacaataaaatccaaacccctcaccattgcctataagatcaggcattatttgtccgcttacttctctaatctcatggcgtgccaccttcttccttgacccctctgctcctggtatactgaactctctaaattctcaaaacataccacgctttttctagtgcaggacctttgtacatgctgctcccactgtcaggagtgctcttttcattgtgaaaggctggttccttttataattccgggctcatgttatatgtcacttctaaaaaagaggcctttcctgatcactcatctcaatgacatattttttttaatttaatctttcaatttcaattaatctttaatatttcagaaagtatatcaacattgcctaacatgctgttttacacacaatagatacatgatcaatgtttgatataaatatacatatctttaaaatctttggtttaaccagctaaacttttaatattttatgaactagttagccctgagtcataaatttacctactttttttttttttttttttgagatagtttcactctctttgcccatgctggagagcagtgacgtgatctcagctcactgcaacctccaactcccaggttcaagagattctcctgcctcagcctctcaagtagctgggattacaggcacctgccaccacacccagctaatttttgtatttttagtagagacagggttttgccatgttggccaggctggtctcgaactcctgacctcaggtgatccacccgcctcaccctcccaaagtgttgggattacaggcacaagtcagcatgcccggccagatttacttattttttatgagatttaaaactgtttttagagatagagtcctgctatgttgtccaggctggagtgaagtagctattcacaggcatgatcattgcacactacagtgttgaacttctgggttcaagtgatcttccgacctcagcctcccaagtagctgggactacaggcatgtgccactgagtccggtgtatttttataagatttttaaaaagataacatattctaaattatgacgtccacataccatttacttttgtgtggaattataaggtgatattttaaatgatgggaatgaacaagttgacatgtatatcagtaacctctaaacatctatttcaaacatctattaactgaaagtgatgattcctccagctcttatactaagaacttccatacattagagcaatatacatattcaaaaagtgacctagttcaattagacaagtaaataattttcctatgtttaggtaaatttgaaaaatatacataattactacctcatcctagttagaatctcatttatatttattccactatgttcatgattttgtaaccaacttggaaggcatcgtattattaaaagtgtatcagattagctccctcaacttactatgtctagtaaccattctgaagaaataggcactggctttgaatatggcctgttccagtttgtgaacagtcgtaggcaagtaaagttgttgggcaaagaggtgagctataggatgactgagggtaaattgtcactactgtatataaagaagacaaatgagatataggaagagatctgttataataacatatatgacatatatctaagtttttcatatatttcagaattatagaaaaaaaagtatgtaatcttttctaagatgtatggatgacttacttttaataatatttcttgatttataatgtaaataagattaagcgaatatgggttactcttgaatttaaaaattggcacatgtaaatgagcattttaatacaaataattagaatatatttatactgtatacacagctacacaacggaagatactactaaaattttgctctatagcacattaccctagaaaacatagaattctagaattctctttaaaaagatcactgagaattattagatgatgactgtgaaataggttctcccagtacaatactacttctgtcattcaaagttctgacaacagttgtagctgaagactgaagcactttatgagaaagcctcattcttccatcagctgggtcacatccaaagtatttcacctgaatttcttggccaacttctaatcctagggcagtaggatgtttaatatttcattgatcaagttgtgtgttataaagcagtaccaaaatcatatttggatataattttaccattacaccagtatctctgctttcagttattgtggcagtacacactgctccaaattctaattgctgctcctgatcatccttgcggatttcagcaatgaagtctcttgcctcatgcatagcaccgggtgttggtgcaaatatagaaaacgtttcttcatccacctgactaatagttacaactgtttcagcctgaagttttttaagttatatccacctggtccaacaaatttttctcattttgataatggaacctgaacagtttctacaacaggtccattttcttttctagatgcttgaggttttgaaatagctttgttcatgatctgtaaaatctcctttttgccactgaagcttgttgaatagcctccattacaattttcattgttattccaggtaatttaatatctgcctgtaatgcagttattcctttattagtgccagctattttgaagtccatgtcaccattgtaagcttcaattcccagaatatctgttagcaaatgataatcttctatttcacccttctcaagatcggttttggtggccaatcccattgctacacctgtgacagcagattaaattggaagccctgaatccattaatgctaaacttccaccacatgcagatgccatagaagatgacccatttgactctaggacttcagatgtaactcttatggcaaaaggaaaatctttgggaataacaggatacaaagctttctcagcaagagcatcaggcccaagttctcttctatttataccggtgactttgacaatttcattagttgcataaggaggaaactcatagtgcagcatgaaatttttatcttttatcccatttatagttgttataactcgatccaacttaatactggattctaatgaatcaaatgtaacagcacaaagcagctgtgtttgtcctctttgaaataattctgatccatgaagggttttaaacatatctacctcacaacttatattccgaagtaaagtcaaatcccgaccatcgcatcttttgtattcattcaaaataatacttctaaaaactttctttgcaacagtattgaaggattctattatctcatatagatcgacctctggaaatatttcttttagttgttcctctgtatctaatcttattttgttaacagcttcatctctggaaattttatcatgttcataatctgtaaaaactgcatagagtctctccatagtgagtttatgagcatgtttcacaatctcttgtgaaggggtaaataacttctgaggtgtcctcttggtaacaccaatttcttttaccagctgctggatgccctgaattatttgctgggtatatttcactcccactttgatagcgtggcaaaagtcctgctgtaaaatgttctctgcagaggcttccaacatgacagtctgacttttaggtgctccagcaaccactacatttaaagtactagaagacatttcttttcttgttgggttaacaacacattctccatcagtcattcctattcatactgtcccaacaggtccattccaaagaatatctgataatgagagggctacagaggttgccattaattgctaggacatcaagttcattaataccatctactgctaacagattacacagaacctgtatatcacagaagtagccagctggaaagataggtctaactgaacaatctactattcaacgtgtaagaatttctttatcagaagtactaatctctcttctcagagggtttgtgggaattctacctactgcagcagccttttgtccgtagtcaaccaccaaaggcataaactgggaaggggaaggttttgttttactgacggctgtggccattaccgcagtgtcacctgactgtattacagcagagccatttgcaaatctggccagctttccagaggatatttctaatttcctgttgcccaagtccatggccacagcttgagaccctgtgctactcaatagtgctcgcacctgcaactggatgagtgcccgatcccaccctggcagacagaagggaccatcactcagcggccggagccacaggctcagtgaggtcttagcttcctcctgttatcctctgtagcaatgccttagtgtttccttcacagcacttattacaatttgtagtcatttactgatgtgattattggttattatccctcatgagtctcacagctaaatgacagcagggatcaagtctgtcttcttccctgtgtcacagctgtatctggcaccaagcacatacaaggcatttgataagtattctttaacataatgaaaatgaagtacatttataacactattctttctacccaaagagaacaaaaaaattatggacttccattctgtgtcaatatattcaacaggatagaagaaataacacaactgaaggttgcaaaatactgaaagttatcaacgcttattctctagagatccttgttaaacaatgtcccatccatcaagggtgaattagatttgtccctggcttgaggacagaataagatgacttcacccgactccttataaacttataattttatgaaaaatccatgagctctcatctttccagcactctgataacgaggtaattacccttttaatgaaaaaggaagcctttttatatctatccccattgaattatggacctcaaaattgaaatgaagtctaatagacatcaagcacaactacctgccagttcctaacaaggatgaggaaaaaaaaatagtgatatctggggagccaacgggcagtatgacagggtgtccttcctgccttctctgatgacactttgctatcaacaccagttcttccttttgtgccttactcagtttgtaagccagtctgcaacagtagaaaagtcattagtcacccttccctatctgttccatgggctttgaaatgaagccctggttcaggttcccatttaggtgtgactttctccattcctactatgttgactgtaatcaaagggctgggctcagtcctgacaacacgttcagatcccacactgcactagccctgctctagaatctcaatctattttcccagtgtcctaagacctgtcaaagcccctgccaccagcctcttccactactgactgagctcttccatcaaacgactgattaatggaaccacaacaccgacaccccacatgaattgcacccggagcccacaatccatactccttccccatgctccttcagtttatcgatgctgtttaattatcagtagtggctcggattaagccctaaacatctagctaccctgttccacagccaagactgttactctcactcctcactcctaggtcttgcctaactccccccatttcaggtattttatagctgagtctctacaagttatcactcacagctaaattcacacttttacttggtctctacattttaatccttggtgatctctttttatgcaattgccagtttagaggcataatcttgtaaacctttaccttctggacagtagcatcggaaagttcattactttcagttacgatacaacagcgagtgacaaatgcagctttggaaagcggaaaacttctttctccttgagagtctctgcacaactttccacatttggaacccaaggacatttcctttctctctctgctaacatggagtacagaaaggttacattagctaataaaagccctctgctgacaaaagatgcgtttgaaaagtcactcgaaaagggagctctctcgatagctttattaaaataaaatgccatatctttgtgaagttaaaagtctctggattgtggttaaaagtctggtctgctccttatacaatggaaagtctttcaaaagccacgtgtttcttaagctggcctcaccatgcataacagctagaatataaatctagactctcgccgcccatctatcttttcttttctgtgtcatgtagaggttcctatgtgaaggaaagatctccagaataagatgagagatagcttttataagaacaccaaatgatagaaattatggaaatcatgatattgaaataatttcttccaagttaaaacatcaggaacatttttgcttatcagataggcaagaatacttaaatttgaatgttggtcagcattcaacaagaaggcagtgcctagacccttggcttatgaattgggggcaattgcagcttccttcattcctctgaagggttgagaacttatgcaaagccatgggtgcagtgctgtccgacgccctgcagaggtgatgccaagagtaaggctaaatatgccgtttttgagagggagcccagaaagccagacttcagcagacaccaaagagtctattgaactactctgatgggaggatatgcaagagcaatgctgaatagtaacacccctgaagagagacaccatggaaagtagttgtcggacttgtggctacaaacaacaagaaagtccttcgcctggagctgcctctggaaagagcagctagactctagctggagagtctgacagagaaacacttcctagcagaggctcagcttcttgcccttccagaatgagaggctgtgtggttttgtgttcaagatcacgctatgaacatgatatgaacggttggtatgtcgagacaccttcattgaaaagagagaataagaaattgctccctgaaacctagaatagatggtgccccaggattgatcacaataatcattgggaatatacattgtagagacctcagattcctattgcacatgtgtcctacaaagaagggttacagagattctatcttgaattgtttgtgaatttttccacatgcattacttttgctggattataaacttctacaacacaaccatatgtttcacttcttataaaatctctcacagggtctaagtcaaagtcaaaggaccgtcattaatcagttgattggcactagagtggttggcctagcgttggtggacatagtcattctcagtgtcagaaaatcttgcaccctatcggaaaagcgtaagaggaaacacaaaaattaaacagaggatacagcaacataatagttctataaagatagtacatactgggagtctaaaaaacatccatatcttttgacataaatctattgctagaaaatcatcctaccaaaatatctaaagagtaaagaaactttatgaagaaagtcattctttgaacagaatatagaagcagaaaaattttgaaacaatctaaatatcaacaatagaggatatgttatataaactaagaatcttcttctgtgtaaacctgctattaaaaataatgcttaagaagtattttcaaaggtttaacaagtggttatgacgtaatgttcggcaacaaacaattgtatacaaactaggatctcaattatgttgaagtgtgtagaatattgacagtgggtatttctgagtggtaggatttggggtgtttctaattttcttgtttgaactttctattttatacttttcaagtttcctgcaatagtaatgttttacttttataatcaaaaaactattgaaataatactttaaattatgcatgtgaaaagattacctggtccaggtggtcattgtatccagctgaaggtgttaaatctagctagactctggcctgggtcttgagaggttagtatctataccccaccttcccttctaaacaggttagcaagctggcaagctggtaaaggagcctagcctcttcctccctacaggacactgcaacatcaaaacaaagcctctaaatactcccctaaagacaaggaagactaatatctgtgacgtagctattctcttctgggacatagaggaaaaaaataggtctctctcataacaagacaccattcatttctcaggttaagctgccattaccttcgaacacacagaagctgagggctgtttctgcagccctatcctacccagtcagccctctgcgtgctctcaactgctattctcactgcagaccaccattttcagacaaagctctgaaaagccccttaatgcccaagagccacaggttgtgtttgtgttaattactacagggctcagttcacaatatcacttaataaaaattaataattttcaagaatagattcataatcttctcagttatcagaacagctgaagttatttatgtgcttattggaacaatattataaatgtttgctttgttttaatacttcattgatgaatcacataatagtttataaaatcatgtttttacctgatatacttagttggccatgttttcctgattacaacaaacagatgaaaaataatttctgagttatttcctttttccttcagtatctcaaaggatgttcactgtgaatactgacaaaataatttattattattttcctagattctgaccatctgctgctaatcaattcattagaaattcaactcaaaaagaaaatttttggagatagtatgttaatataccagtttagagaaaacaacatacaattacttttgcacaaagtcagttggagaatagtttgagaactgtctagagacagcaagatattctcaagatgctccaagtatccattctgactctatgactattctgagcacaaactcaggattttagtttccttcactaatatctagtaataaaaaacctccatgtgttatttatgagaacagttaagcagataaataataaagtctcctgacacttcaaaggaaaatgaagaaaatatgagtaaatataaaatcaattcatcagatacattttaaattccagctgttagagtcagaaggaatcacagaagatcatttcactccatctcctgggtttatgctgataagctactgctctatccatatgagcgaagatgcagccgcaggttaaggggcaagcctgttgccatacagctggttagcaccaagaagcaaagtgaagttagatttcagtttctagtatcctcatacaggcctcttcccaatgagccaagctacttctcttttaaaaataattctgtctggaacattaagggggtcatccgtactgattcttcatgttttaaatacatattgtttgccagtcattatgctaataagaatacaaaaagaaaacaatatatagtatcagcacttgaagacctcacagtccagtaaggaaaacgtcaacatgaacaatacccatatgatacttgcatagcaatgtgagcacagtgctatgggaacatagaagagggagcaataaattctgctaagaaagtgttaaaaagtttcacagaagagctaggccccaaaggatgagtaagaggtatttaggcagaaggaaccatgaaaacaaaggcagggatgtgaacaacatctttgaggaggagccagcatacagaatgaaagatattgcgcatcaaaagcaaaacagcctttgcttttacacagacctatcatggtaaagcatcctcacagctgtacacatttaggtaatctctgtgttccccagcccctctaaagagcatcactgtgtcctccttgcctatatccatgccctctgtcaggaaaggccttgcccttttcctctatgccaactccccactgtccctcctgatacatctccaatattacctcttctccaacctccctgggagagttaattacctcctcctttgggctcctataacaacttttacatctcttgcaagaggttacttgaattacttgtttacatacatgtctatctcccaaacaagtctaaaaatggtaggcttctaaataattatatgtttgataaatatgaatgaatgaccttttctatggaaagctaggcgctaaaggtgatagagagataacatgcacatacgaactctcaagggaaatagacagacacatagataatgtataagtagaataataattctttgaattgaaatccccagggaaacattttcactcaaccgaaaatctaactgcaatctaaagattttcacatacaaccacttggcattgacttacaactccacctagataggttcataaagtcagatccttttcttgttacattcttagagctcataaaaggtggtctgaaaaggcaactctttgggtataatttagtcttattaaacagaattgtaagggagagaaaatgactgtctagtcctttatcattgggcatgtaatccattataaaggtgttaagctcactggtaagtgtaaaaatgagaggaaatgagtctactgacaaaaaatgcaatgagacaataaactaaaattaatgcttcacaaattctcagcttctcagccttattgtctcaatttgttattctcataaattatcagaaagtaaagcacagccactgctcctaaaaataaaaatcttattaaacttactatgtataaaactgcctgaagacattggctctcctttgacctcatgagttactcaagatactcaatcccagggttcaaaaaatatatctcattagcagtaccagatgtcagcagatgtgttattaaactgcctgtcactcaagcctcaatcctgaaaaatacctaggtcacctaatcctttatgccatccacatcttttcacatataataacaggaactttagtgcctggaattgttattaataataattccaaaaactcaatcatttctgggatgcctttgagttaatgggaaagaagctactatctgcctgacaaattgctgcacactggtaaaagatgattgacagaggatagatagtgtattagcctccttgggctatgtcataatccattcagctggctatcacaaaataccataaaccaggtagcttataaacaacagaaacatttctcacagctctggattctgggaagtccagcatcaaggccctggcatatctcttgtttggtgaaggcccactttctggttcacagatggcaacttcttgctgtgtcctcacatggcaaaaggggcaagagagttctctggggcctcttttacaagggcagtaatcctatttctgagggacctgcccttcataacctaactactttccccaccttccaataccaccacattgaggattaggattcgatgtatgaatctggggtttacacaaacattcagaccatagcaggctaccttaaaaaccacaaaccggtggcttaaacaatagaaatttattttttcatacttttgctagctgaaagtccaagacgaaggtgtcatcagggttagtatgtagcaaggcctctcttcctggcttgcaggtcactgccttcttgttgaatgctcacatgactttttctctgtgcactcacagagaaagaatgaaatgagctctctggtgtctcttcctgtttgtataaggtatcagattatggccccacccttctaagctcatttaaccttaattatctccttaaaggtcctaactccaaatactatcaccttggggttaaggcttcaaaatatgaatttgatgagagacacagttcagtccataacagacagactgatggatggatgtgaatggatggacagatggatggatgcatggatggatggatggatacatggatggatgcatggatggatgcatggatggatgcatggatgggagggacggagggagggagggagagagggaagaagagaaggaaggaaggagggaaggaagagagagaaggacggagggaaggagggagagaaggagggagggagggatatgattaactcatgaaggaggtaggattacgatcagacttaaatctgctggaagcaaaccattgcctgtaaggtaaaaaattgagaagtgttagaaaagcctcacactgctccaacatgctgcacataaacacgagccacagtgcctaaaatttcatattaaccaaagattcaacaaacatttatcaaggaagaactttgtgtctggcactgatctagtgttacagagcatgttaactgaattcctcactgaagacatttatattctaacatggatgaaaaaaaatctatgtataagaaagttgttcttaacctgaattacacaaaggatcacttgtgggactttaaaaaaatacatattccacaatcatatcttctgaatctaaatagcctgaggtaggccctgggcattgagatatatatatataatctctccaggggattctgaagcacagcaatacgaaaatccagtccagactactgagataagcattggccttttcttctaaacactaatgactctagaagataatatgtgaagaacctactaccgcagtgtaaataaactcactagatggctagcaataaatgatccagaacaatatgagactgctgggcaagagaaggcatgattgatttaagataatgtacacgaaacttggtagcagacatgaaatccctttgtaaacataaaagattattactcctcagtaggtcaccattttacaaggcagatcatttcattttaagagcttccaaatactgagccaacacatggtttttttggtaactttcttccaatgtgtctaggtccatagttttcagcgcatgccttctcccgaagtcttcagggtgagactccacaatgccttaggtctaggaccatagccctctgaagttcctgagcaagtctggaccaaggctgatcaagatcactaggcttagcaccagaagtatttgagagtctggaattaatcttgcggccattaccgcgggcttcagtgggttataagcccagggcaactgcatatctgttacactgcagtgttccctttaattccacctgctgccagccctgagtctaatccattcaactgacttctgtctggggttcctgttctccactagagctctcacgggaaccctagcctgtttggttgagctctgatactctggccagccattgccacctgcacacttcagggctggtttccattccctatacatccagtcagtggctgggtgacatttctttactattgacatgcccaagctgctatatggactcctgccttagatcattgattctcagatgggatggttctgccccagtagaatgtttcagaaactcttgatgatatatttggttgtcataacagtaacatctgcctccttctacagcatcaccccatgtttactggcatttagagtgtgggggccagagaaaatagacatcccacaatgaatgcactgtgtaatccacccaaggattagttgtactgtgttctcgaacactcacacagatggaaaacctctctgttagtatctgagcctagaagctaactgtttcacacataatctcaaagtactttttgcagcaagttttaatatgcaactaattttccaggacagtctctagcctgtaaatcatggggaggaaactttaccaaaaattgttcaccaccctgaaaatcacttcaccaacactataatgacattcttgctacttgagtgacaagtacaaagctcctgtaacggtctgcatttgcagtttccattcttcatgtagctacaagcatctgactactttattatgtcttttagtgtaaccaagctcaagcccttaggtattaactacatattatgttacttttaattattttacacttttaaacctttatataaaaattagggcattatattaatttattttctatatgaaattaagtatgtagagatattgtattacctacaagttatattatctgtgagagtaagaagggcactacaaaatgtctgttgggaagaggggatattaggtctgataggtttaagctcagtattagtatttattgagaataaagtgaatattctcaataaaccctgtagataccagccataccctttcatggcttcgcccttacagctgcatcagttcctgcacttcagctcccaacaaggcatcctccaggccaaggatgtctcaggatgccttgcagtcaaatctatccattggcagatgccatcctacaattcaaaaataaaacctaaaaattatttgtgtaattcatttgaattaaaagcatgactcttagcaataatagcataaagagattggctattacttttaaaacctatatttcaataatgctttcacatatattgatttcatttgatattcacaacaacacgatgagatgacagagaagactgtgcatttcttttttttaaattatactttaagttctgggatacatgtgcagaacgtgcaggtttgttacataggtacacacgtgccatggtggtttgctgcacccatcaacccatcattttcattaggtacttctgctaatgctatccctcccctagcccccaacccccgacaggccccagtgtgtaatgttcccttccctgtatccatgtgttctcatagttcagctcccacttatgagtgagaacttgtggtgtttggttttctgttcctgtgttagtttgctgcgaatgatggtttccagcttcatccatgtccctgcaaaggacatgaactcatcctttttcatggctgcatagtattccatggtatatataatgccacattttctttatccagtctatcattgatgggcatttgggttggttccaagtctttgctattgtgaacagtgctgcagtaaacatacatgtgcatgtgtctttacagtagaatgatttataagcctttgggtatattcccagtaatgggattgctgggtcaaatggtatttctggttctagatccttgaggaattgccacattgtcctccacaatggttgaactaattgacactcccaccaacagtgtaaaagtgctcctatttctctacatcctctccagtatctgttgtttcctgactttttaatgatcaccattgcaactggcatgagatggtatctcattatggttttgatttgcatttctctaatgaccagtgatgatgagctttttttcatgtatttgttggccacataaatgtcttcttttgagaagtgtctgttcatatccttcacccactttttgatggggttgtttttttcttgtaaatttctttaagttccttgtagattctggatattagccctttgtcagatggatagattgcttccaccattctgtaggttgcctgttcactctgatgatattttcttttgctgtgcagaagctctttagtttaattagatcccatttatcaattatggcttttgttgccattgcttttggtgttttagtcatgaagtctttgcgaatgcctatgtcctgaatggtattgcctaggttttcttctagagtttttatggttttatgtgttacatttaagtctttaatccatcttgagctaatttttgtataaggtgtaaggaaggggtccagtttcagttttctgcatatggctaaccagttttcccaacaccatttattaaatagggattcctttcctcattgcttgttttgtcaggtttatcaaagatcagatggttgtagatgtgcggtgttatttctgaggcctctgttctgttccatcagcctataaatctgttttggtatcagtaccatgctgttttggttactgtagtcttgtagtatagtttgaagccagaaagcgtgatgccttcagctttgttccttttgcttaggattgtttggctataggagctctgttttggttccatgtgaaatttaaagtagtttttttataattctgtgagtaaagtcaatggtagcttgatagggatagcactgaatctataaattactttgggcagtatggccattttcacaatattgattcttcctatccatgagcatggaatgtttttccatttgtttgtatcctctcttatttccttgagcagtggtttgtagttctccttgaagaggtccttcacatcccttgtaagttgtattcctaggtattttattctttttgtagcaattgtaaatgggagttcactcatgatttggcttcctttttgtctattatttgtatataggaatgcttgtgattttgcacattgattttgcatcttgagactttgctgaagttgcttatcagcttaaggagatttgaggccgagatgatggggttttctaaatatacaatcatgtcatctgcaaacagaggcaatttgacttcttctcttcctatatgaataccctttccttctcttgcctgattgccctggccagaacttccaatactatgttgaataggagtggtgagagagggcatccttgtctcatgccggttttcaaagggaatgcttccagcttttgcccattcagtgtgatattggctttgggtttttcataaatagcttttattactttgagatacgttccatcaatacctttaacatcacactgtcaacattagacagatcaatgagacagaaaatgtacaaggatattcaggatttgaactctgttcaggaccaagcagaccttatagacatctacagaactctccaccccaaatcaacagaatatacattcttctcagcaccattttgcacttattctaaaattgacctcataattggaagtaaaacattcctcagcaaatgcaaaagaacggaattcataacaaacagtctctcagaccacaatgcaacaatcaaattagaactcaggattaagaaactcactcaaaaccacacaactacatggaaactgaacaacctgctcctgaatgactactggataaataacaaaattaaagtagaaataaataagttatttgaaaccaatgagaacaaagacacaacataccagaatctctgggacacagctaaagcagtgtttagagggaaatttatagcactaaatgcccacaggagaaagcagggaagatctaaaatcgacaccctaacatcacaattaaaagaactacaaaagcaagggcaaacaaattcaaaagctagcagaagacaagaaataactaacatcagagtagaactgaaggagatagagatacacacaaaaaaaaaaaaccttcaaaaaatcaatgaatccagcagctggctttttgaaaagattaacaaaatagatagatggctagccagactaataaagaagaaaagagagaagaattgaatagacacaataaaaaatgataaaggggatatcaccactgatcccacagaaatgcaaactaccatcagagaatactattaacacctctacacaaataaactagaaaatctagaagaaatggataaattcctggacacatacaccctcccaatactaaaccaggaagaagtcaaatccctgaatagaacaataacaagttctgaaattgaggcaataattaatagcctaccaaccaaaaaaagcctgaccagacagattcacagccagattctactagaggtacaaagaggagctggtaccgttccttctgaaactattccgaagaatagagtaagagggactcctccttaactcattttatgaggtcagcatcatcctgataccaaaacctagcagagacaaaacaaaaaaagagaattttaggccaatatccctgatgaacgttgatgtgaaaatactcaataaaatgctggcaaaccgaatccagcagcacatcaaaaagcttctccaccacagtcaagtcggcttcatccctgggatgcaatccgtcacataaacagaatcaatgacaaaaaccacatctcaatagatatagaaaaggccttcgataaaattcaacaccacttcatgctaaaaactctcaattgtgtatttctgtatctgttttaaaaaagaatcttgaggctctgagattctgatcagctcagtcacagagctagcaagagagctgggattagagtctacaccttcagaagccaaaagctgtgatattttcacctacataacactgcctctaaagtgagacaagtaacaacaggaagaaaagaacaacagaaagaacaaaattaaaaggatcaatatgaaatgctgaaacatgtaaatactaacagggtaatggtaatttctgaaagcctaaagaggaaaattccacaccacaatccaagagatctgattaagcaggctattttgtcatgtgaacatactcttctatggcaacccaccacagctcacatctttgcacccattgtatagaatgcctgtgggcacacacaaatggctcgcaaagacgacacttaaaaatagctgtgctgccctctactgttgaaaaaagagcaagcatgaaaacggcaatcagatttgctacttgtgtgtcttaagctgataagtgaacagcagcagagtgctacaaacaccatttcattattatcagtcagtggttcagtagtaactttagcattgaaataaatattttgacattaatgagatcaaacagtttatttggcttaataaagacaatatcataattgtttattgttggtgctatccttgttagttggattgtctgcttaagactagctgaatagacatgaatattcagtacttaaagcttgttttcagattcttgtaatgtcagggctaaataaaacttaaaggtcacatagaggtaaatggatgttttacatatgacaactctgatccataggcagcagctgcctggagaaatgtgtaaataaggattttgagactctgttcaagctcagtgacaaagaagattacaattgattagtaatgtcttccaagtaagagaaagtgagataatgctatacgtgcaacatccatctgtccatgggctaaattagactgccatccctaggctcgtctgatcactttacagataaggaaatcaaggcccactgagacgaaattgcttgttaaagatctcattgctggccaggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactggggaggctgaggcaggagaatggcgtgaacccgggaagcggagcttgcagtgagccgagattgcgccactgcagtccgcagtccggcctgggcgacagagcgagactccatcccaaaaagaaaaaaaaaaaaaaaaaaagatctcattgctgctggaaattagcctgggtcaatcctattactgggtatatacccagagggatataaagcactctaccatatagacacatgcacacaaatgttcactgtggcactgttcacaatagcaaagacatgaaatcaatctaaatgcccatcagtgacagattggataaagaaattgtggtacatatacaccatggaatactatacagccataaaaaatgaaatcttgtcttttgcaggaacatggatggagctggaggctattatcctcagcaaatgaatgcaggaacaaaaaaccaaatactgcatattctcacttataagtgggagctaaatgataagaacttatgaacacaaagaaggaaacatcagacactggggtctagttgagtgggaaaggtgggaggagggagaggagcagaaaagataattattgggtactgggtttaattcctgggtgatgaaataatctgtataataaacccccataacatgactttacctatgtaacaaaccttcacatgtaccccgaacctaagatgaaagttttaaaaaaaatacctgtaatgtgaaaaccctttactagtgggattaatattgtttgggcaattatcatcactgtacaagtggctgttaatagcattttccacttgctctgtgctgggcactgtactatattctttaccaactattatcttatttaattatcaaaggctctttggcgttggatattattacccttgtttttttgttttgtcttgtttttttcctaaaaaaaagaaagaaattaagctggatcaagaattcaagcatcctgtattctggaacattcttcttgccattagatataagtttcttagctaggcctccaggaatggaggacaagacatttcagcccaaactttataaagtaacaagtgatgttcattctcaatacagctttaagataattctttactgtcaccaaggcacatattttcttctttacatagaccaaaagcctttgcgaaagatagggcacaggcaaagccttttcatcttacaattgatctttttgatgatttgttcataaagaaatagaatttcccattgtggagtcatttccatggttacctattgatttcctataggaagcatgctgtttacacggccatcaggtctttattgtggagggtaaatcaccctctgagttttcactttatctgcaacctgaggcatgtaaaaatgagctctgcaaaattaccagaacaagataaataaatgattcatgtgaattggttttgcatgaataagtgattaatcctctctttcaactttgctatgagagaatgcagaattaatgtaattctatgcaaacagaatccacttttctgaattctgacctaattgttggtatttgtgaggcaaaatacatgtaaaatttcctgtagtttttaaaaaactaatgatactgctactgaaaatcaggaaccaaacttctctttataaaccttaactgcagatgcacacggatgagattgtgatttaccctaaaagttccttcaaagcatcttgtaatttggcattccaaaggtatatgaccttagtgttccaaaataggacttagaattgctcaccaaatagcctagtctttaaaccagagtccatgtggcagccttagcagcctgaattaattaggctcttggaagaaacacacctaggactctggagttttcacataatgagaaatcagtagaccattcaataaatcagtagaacactcaacccaagaaaacatccacaaaaataaaatccctttaattggggacataaaataacaattctattctatgaagatgtgtctcagcgttacgctagaagtttaggtctctttctccaagagtatttcacctgtagtcaggaactttaaacataaacccagaccaaccaagtgattctataaaagtcacaaaataagaatactaggaagaggagataatcttggactggaagataagcagagaaggcttcttggtttgtgcaaaattgtggcttttgccattactttcaatggcaaaataaattttggcaaaactttttgttaggagacttgcagaagcagtgagatttgaatagatacaaatagaaaattatagtagctaaccagttagcgagcatttaccataggacagacgctctgccaaaccctttatactctatcttatcttcataactatccaatgaggtgagtaagttattattctcttttttataggttagatcgatgagattaggccaggcgtggtggctcatgcctgtaatcccagcattttgggaggccgagatgagcggatctcctgaggttgggaattcgagaccagcctgaccaacatggagaaaccccgtctctactaaaaatacaaaattagcctggcatggtggcgcatgcctgtaatcccagctacttgggaggatgaggcaggagaattgcttgaacccgtgaggcaaggattacgatgagctgagatcacaccattgtactccagcctgcgcaacaagagcaaaactttgtcacaaaaaaaaaaaaaaaaaaaaaaaaaaaaaggctgaggtgttaaacaactagtgtgacagggctagttccaatgattccaatacatactgtctcctaagtctacaatcataactaaaccatttcagtcagagggaaatagggaatatagtggcaaggaagcaaatcacatagcaagagggtgacagaggttaaatcactacatcaacagagagtggtgtagtaaagggaggaagggctgggaaaactgcatgagggtggattacagagagctctgaatgccattcttggtaggataaaatgtgagaactgaaccccaactgagaaggtgccaattaattcaggtggcactgacctgtgaggctgaggaggtcttaatcaccagaacactaaatgctcattatccaaccttttaattagcaaagaaactaccctgtctggaaaagttttcagcaaagaactaagatttgatcatgctgttaaagaaaaaaaaagaaaagaaaaaaacaatcctctgatctctcccaggcaacaaatcttgtatttcagatgtatgttttcatatcttccaggtcccaattggagagaaaatgaggaaaaggaggaacagatgggactaaaagcagaaggcacctgatgaaagagaaaaagcaaggctgggggaagggtgtttagagaaggactgggagaacaaaagcaaagaatctgaaatgtaaggttatctcctctgctgaactacacacacaaagttgttctatttactgctttgcaatattgagtgactctatcaagtactggtggcgatcggtgcctaggaataatcacatggatctctcaatagaaagctcactttacagaatcaggtcactaataagggcctggggcatgtatatcaccatgtaggtgtgaaaatgcaggacagggtcaggctatgccaacatctttgtacatgtgaaaaatgaaacccaagaaggtcaacagaaagggcattggcctgggaatcagaaaggtagtcctttccctgaaagaggataaatgtattttcccaaggtgacaaggtaagtagtagagtgcctacattttgtttcttgcctcttaggagagcatgctttcttccgttcccatgaacttcagaatgagccacatctttactcaaagcctcctctgctatttatatgtgtgaccttaggtaagttattatcctctttaccatacagaaaaataaaacaagttctttgctttcaaacagctaaattaaatcaggcacaggtaggtaggcaaggtccaacaggaggagttggtgttaagtgattcaactttgttcccagcaccaggctcatattataattatcactaagagtagaatttaccacttcagtagaggaaaggctccccatgcttttccatagcttccaaagttggtttgatgattatgggggaagagaaggaaattgggacaacaccttcgatactagacagtatttatcagtcactcagagctgtccaccgtgcttacagcttggtggatattatttcattcaatcccccagtaatcctttagattattatttcaattgtacacatgagaaaattgaacttcagaaaaattaagggacttgcccaaatcccactagatttagcaccaggctccaagctaatagcaaactagagagctcttatgggaacaaccatattactgcagctttcccagtgtagttgtcatgaccaactcagggttctccagtccaaacaaggaggtcgtgctaatccattcatacatcttaactcccggaaatcatttccattccccatggagcaaaattttggaaagcagattcaacaaattttgcaaggtactgggggcaatgtggctattatacagaaataaaagacaactttcctgtcctccaagaacttatagtttggcacgaaagtggtaagtaaacagacaacagcaagttagacatcttcttcagagattatatttgagcagtgcagatgtacaaagaaaggggaagaaagtgaacagggagggagacattgaggaaaagctgtggtgggagggagagaaggaaggagggagggaggcaagaaggaaggaaggagcgaggaagggaggggaggggagggagggagggagggaggaggcaggctttgtatgtcagggactgtgttagttatattgccttatctcttaattcttccaacacctggttgtcgatatcattactcccatcatattcctcctgctaaccttcatcacccttagaatgacctagtcttgcatgatatggttcctgccttcctctgtggcatacatcctaccacactgacccctttactatgccttgaatgtatcagtctctctttaacctcagggcacttgctgttctctccagctcaaatgtcccccaactccctccagatgtccatatggcctgcttctctctctcttccttctactcaaatgttgcttccacagaaaggctctccttgatccccctaataacccacctctcagctccactctcttctccttactctggtttatttttcttcaaggcacttaccattaccaatctttctttatttgtatttgttggttgcttgtctccccattcctccactagaatgtaaacatttattctctctcaggatagtaggcagtgactgtttatttttatttatccccagaggagtctcagcagtgcctgacatatagtaagtgctcaagagaaattttatgaatgagctaatgaatctgcctttgcaagatatggaaactggggttcagacaagttatgcatcttggccatgtcacacaaatggacctaccaacttcatgacattgttatgctcactcctgcctcaggctttgggccttgaaaatctctcctcctgcaggtctgctgatggatcttcgcagagctggctccttcccatagcttcagaagagccttctggggtcacctcctttaaaattgccccttccactcccattaccctatttaacattctccatgacacttactactctctgaaattaccttattttcttatctcccttattagaatgtaagtactagagaaatcagaccaatgagactatttctttctcattcacagcctgcctagagcagcacaaacaatgcaaaaacaaaccaaaaaatgaataagcgtgtgtatgtaggtctcttagtaccatgcttggcccataacaagtgcttactagctactagttactaattttttagtagtagagatttaataggaaagattataggaaaagaaactcaaaacaagggaatagtgtgaattaaagactagcttttcttaaactatgttgccaaggtagttttacccacaagtctgtgtcctgggcaaaaatagtggaaattggcttcagcgcaatcacaagacttctggaggagtctttcactccgtatggatcaaaaatggtgtgtttcaaccaagagtatggctttggacatcttctcgtacaattcacatatttgtcagtcatataaacatttcaatttcaagaatagcatctaatgtgcaatttaatttggcctccattttgtaactctcggagctgcaaatgtagttattttcacttgcagcaaatggtttggttgaatagtgcatggctatccaggactggcagaaagcaaaacaccaatcgataagagcaataaaactggaaatccacaagatgtgtggcctgaaacatgtataatttttaattcataatttacttaaatgattgattctcccaaaagaaagaactgaaataagtgataaattgaagtcttactgtgcagaaaaatgaatacagtgttgatatgtctttaagatttctccacaaccaacagagaagagaaggtaacttctggaccctgaagtaaatcttatttttatttggggaattatttggacatagctgctattgccaaaaaaagattaatccatactatgcccacctcccacaggctctacaaccattccaaagaaaaacaggtgaggagctaaatgatgttgcaaaaatcagtgaatttggaataaaaaacatctgtattcaaatattgactctgtggtaggtaagactagaggatcagacaggagggcaaatatgttgaatctttacttaaaggccaactcccttgctgcctacttttttttttttaagagacagattttgctgtttcccaagctggagtgcagtggctattcacaaatgcaatcatagcacactacagccttgaaatcctgggaccaatcagtcctccttcctcagcctcctgaatagctgggactacacctacctatttttgtgctctacacttatctatttcccttaagaggtaagggttagtatttaagacttgtcccttgaagcaggcctcccaagaaacaagtgggctttctgcaaagtaccaacgaaactggcaatggcctaaatcttaaggacattaatcctggtcaatgatggcaagtcctggatcccagtcccccagttatgtcagattctctagctatgaatgctgatgtggcaaatccagccgacagcttgctagactatacagctgcaaccacaagagttggactccagcctgctaattactccaggggagaggctggtgctaccccagacataaatgctgagttagcagcatggagctagagccagctcatattgctgttgtatcctggctgatctctgaatatagcaaggaggaggtgatgcttccctaataattcaacttgaaagccccaaagcccaaggatggggatctatcccagaaatctgacttgcagtcatgctgaattgctgtgtactaccctagaatgtgataaacaaaagaaaaccacacatctgctactgcatacgttcgtaagtttgcctctagggctgatatacattctggctgtatacattctggttatttgtatatcagccctctagggctgagataaattccggctctacacattctggctatttgtcctggtccccacaatacctcattgataacatttatgaagggaagaataatacttcttgataactttttggaagttgacaaaatagaaaaagaaggtccaaatgtctatatttttatgtacacatttatgcatatttacaacttctgatatttcttcttttttctcagattatatgaacctctggactctggagtaagcatgtaaatatatacgtatatgtctgtgtgtgtgtgtttctgtgtctgtgtgtattacttatatttatgtttatatttatatttataggcattttgaggtcctgtggtaaaggccttggtcatgtctgcataaaagtcagcatgggatatcctcaaagctgcaaggctccacctatgtagacactactgggagcaggatgcctgggagacgaagcagggcagcataaatttttgtagcagaggcagcatctacagggggtgtctttgtgtctcggaggattgttgcaaaagagttcataaatgtgcagttccctatcttccccaacccttcaaagatgggaaagaacttcatttagatgttccatcctaccccgtttttttactgatctgggcaataccaggtccccttaacacacacacacacacacacacacacacacacacacacacacacacacacacacttcctgcaatatattgtgctgaaaatcagccttgctgtcacagttccattatcaggagagtttggagtaatgcccagcctagtctataatgaaaaattgtggctcagtgtcctgattaaaaccatatcatcctttcttgtctatagctccgttcttaatttcagtctagcccaagacgctatctaaggtggcttggaatgcaggcccacatgttcctttctgctgtgagtacaagcagaacaggcagagctgggattcaaattgacctctctctgattctgaaccccatggtctttcccatgaagagatctagttttttttgtttttgtttttgtttttttttttcatctgttaggggctgttatgggttgacttgtgtttcctccatcctccctgaaaaagatattttgtagccctaacctctagtaccccagaatgtgaccatatttggagatacggtctttatagaaatattaaagttaaaataggttcatttggtgtgagctctaatcccatatgactggtgtccttatgcacagaggaaatatgaataccaagaaagagacacagaggaatcagagaaaagacagacacctatgagccaaggagaaaggcctagaacagatccttccctcacaatcctcagaaggaaccaagcctaccaacaacaccttgatctcagacattcagcctccaaaactgtgatgcaatcagtggtgctttgttatgccagtcccaacaaactaatacaggagaaattcagagttttcaaactggaagtgcatgtccgtgaacattagattgttgcagccatccaactgtacagtgcacagctccagagggcagtattcccagggtcacatcatggtgcattcctgcactagacgtcatacaccacacagcctcacacagtggtccctgaccaagctgacacagatagagtctcctcctgtgagacatctgttacatatgttacatgtgttaaacctgttataaattcagttaaattgccctcaaagtaaagattataaaagaaggatgttaagggagatactgttggatttgttgcagtgcatttaaaaatagataacttcaaggccatggaatatgggactgttttttagcacaaaattataaaagtggagaactaatatatgttaacctatcgggaaactcatctgagtatgagctgggcagacgttttgattgtctatggagggctggacttcccacttttctcccactcatctgacaggatcagtttttcaggtgatgaattaggaacaaggtgagaaggaggtggctctagacaccctggatatagcactgttttctgttaatgagattcagatggcctgataattaaagctgtctccaaaacagaatggctttcctcatctagcatccttggcacagggtaattcaactgaagactgggttcatttatccattcaactccctaataaatacttatggagtattaggcaatgtcctggatattggaggaatacaaagaatagtgccagtcatatcaatcttgctctcaaagagtttaggttctaaggagaaataaggtagatgcgtagaaaattccaatatagaatataaaactatgtgtcacagaaaaagtgcagttaaaatgccacaggagttcagagtagtttacgaaggaagatattgggacagtgatggcatttaagctatatgaataacattaacagatagagaaaatggcataagccaagatggagaggagaagttgaaggctgactggagtacagggcatgtttttgggagctagaaaatacaattggaaaggtcttctatatcttctttggagatggttttaaccactagaccaggaatgtaagttttattctgaggaccaataggagccactcaaagaagacgaccttacagtgatgttgacagagaaattccaaagataagaagttacccgccaggcaaggtggctcacgcccataatcccagcactttgggaggctgaggcaggcggatcacaaggtcaggagattgagaccatcctggccaacatggtgaaaccccgtctctactaaaaatacaaaaattagctgggcatggtggtgcatgcctgtagtcccacctactcaggaagctgaggcgggagaatctcttgaacccaggaggcggaggctgcagtgagccgagattacaccactgctctccagcctgggtgacagagcaagactctgtctcaaataaaaaaagaagaagttaacctatcaagtgacttctgaaatctccctctcagatcactgagtctctcgattcatgctgaagaagaaacaataatcccttatcatagatatggaccacatcagttgagatagggcttggagggtggggaagctatgaaatccttctgaaagaatggctatattttaggggatcacagagaatgcaaagttcaagcaactaaagggaatagaaaatccaagctatgcggggggctcttccctttctcataatccccctgggcaataagccagttcagagacatcatcagcttattttctcataaacaacaatttatcagtaagaaagtgatatttttcctctttgcctgactccttaacacataattggtagtacctcccataactgattaactcagaacaaagctgaaaagaaaataactattgtgagctggaagaaataaactaaactctaggcgtctttcacctccttagatccatttacagtgacctttagccaagggaagcaatgatttagagagcagctagaaaggatttgtggaatccactgaactggaattcagcacacggagctaatcctgcaaaactgtgattataaaattacaaagcttgaccaaagaaagctttgtgcattctgtggacttgtacctaaaatcacccttagtctgaaatatcctttttgtcttccacaggaattggctaactgtattgctctatttatgccatctttgcaactaaatactgtgattaacttgaagtgtggtttccagaaatttcttatgaggaaacagataaatatggaaagatgtatgccgaaagatgtttactgcagcaatgcctaagataaagactgaaaacaatataaatatccatcaggagacgattgcttaagtatagtacagtaacacactggactatcatccagccaataagcagactaagttagatactaacaagattctaacaataaacacagtaagttagtactaacaagaaactatgtccatctgttgcccatgtgtccattaaatattgctaagaaaaagaagtaggacgcaaatagtatgtgtaatatgaactaatttttaactttgtatgtatgtttgagaaagagaaaagcgtaaaaatggtgaatcaaattaacagtgattttcatggaagactgggattgtagtgaatccttcattttctccctatgcacttctgaatggcttggattttgttacaatgagtatgtactgtttttataattagaaaaatgatattcctattagaaaaggaagataaagagactaattcttcactatgttttccaaattttaatattacttatatcagagattattttaagatattttaaactactcagtgtagtagaaacaatactggacctacaagccagtcttcagttgtgagttccagctctctgtttttcctatctgagcctcagctgtcttcatacacaaaatgagtggctgtatttactgactcacaaagtccctactagtactcacatttcataattctaactggaaataaatacaccaggcattcaatcctgtcttatgcaatatggcctaaaatgaggcccacaaactgctataatccaaagacaagtggactcttggaagagctgaattacataatagaataagtttctatcatagatccccagggaatgagtcttttttatacacttaccgtcagaagttctgtcaaaaattctacaatcatctccagccccaacatacacaatttactagacaggaaattgaggccacagaggcaaagggacttgtacaaaatctcacagctaatgagtagaaaattcaggattacaaatatttaatcatttctgggctgggtgtaatgcttcttagatcttagagttcaggctaaacatgtgataggttcaaaacaatgctttgaccgtcccccacagccctacaccaaatgaatttctttatgatatcctccacagcccgatccacatctctgaaactgaaacacattaaaaggaaaagatttttgaagaagtataatttccatttcctttttccacccacatatgtgcaggcacactgatataaaaagggactttaaaaaatttgtggaatcttaagcaaaaagaacaaagtcagaggtgtcacattacccaacttcaaactgtaccataaggctacaataaccaaaatggcatggtactggtacaaaaacagacacatagaccaatggaacagataagataacccagaaataatactgcacacctacagccatctaatcttcgacaaaggcaacaaaaataagcaatagggaaaggaccccctattcaataaaaggtgttggaataaatggctagccatatgcagaagaatgaaactggacccctacctttcaccatatgtaaaaattaactcaagatggattaaagatttaagtgtaagacctaaagatttaaataaaagaatcctagaggaaaacctaggaaatacaattttggacatcagctttgggaaagaatttgactaagtcctcaaagcaattgtaataaaaatgaaaattaacaagtgggacctaattaaactaaagggcttctacacagcaaaagaaactatcaacagagtaaatagacaacctacagaatgggagaaaatattcccataatatgtatctgacaaagatctaatatccagactctacaaggaacttaattcaacaagcaaaaaaataataataataacatcattaaaaagtgggaaaaggacatgaacagacacatctcaaaagaagacatacaagtggccaacaaacatatgaaaaaacgctcaacatcactaattatcagagaaatgcaaaccgaaaccacaaagaggcaccatcttacaccagtcagaatggctattattaaaaaatcataaaacaacagatgctggtgaggctgtggagaaaagagaatgcttatacattgttggtgggaatataaattacttcagccaatgtgaaaagcagtttggaggtttatcagagaccttagaacagaacttaaaatttaaaacattcaaaccagcaatccaattactggctacatatccaaaagaaaataaattgttctaccaaaaagacacatgcatttatatgttcatcacagccctagtcacaatagtaaagacatggactcaacctaggttcccatcaacagtggatcagataaagcaatggtccccaacctttttgacaccagggactggttttgcagaagacaatttttccccatatggaggtggggaggggaggtggggaaatggtttcaggatgaaactgttttacctcagatcatcaggcattagattctcataaggaacatgcagcctaggtccttctcacgtgcagttcacaatagggtttgcactactatgagaatctaatgccatggctgatctgacaggaggcagagctcaggtggtaatgctcacctgcccaccactcacctcatgctgtgcggcccagttcctaacagcccatggactggtaccagtctggggcccaggggctggggaccccttgggtacagaaaatgtagtatatatatgccatgaaatactacacagccatagcaaagaatgaaatcatgtcctttgtagcaacatggatgcagctggaggccattatcctaagtgaattaacagaggaacataaaaccaaatactgcatgttctcacttacaagtgggagctaaacattgggtactcatggacataaaaatggcaacaatagaaactgggaactactacatggggaaaggaggaaagtgaggaaaggggcaaaaaattatggggtgctatggtcactacctgggtgatgggatcattcagacctcaaacctcagcatcacatagtaaacccacgtaacaaatctaaaaccatttttctggaaaaatggaattaaaagataaaaataaaaaatataaactttatttctctataccatcaccatcaaattcatgacatttttttaagtgatgatactagccatttagccatccctaaaggactgagggtcctggtaagttaaccatgtctatacagtctttctacttgttaataaaataaaatgagtgtcttttaaaggtttcttaagattagaaaacaaaaagaagtcagaagaagtcaaatcaggacggtaaggtggatacctaatgagttcccatcaaaactcctgcaaaattgccctagtttgttgagaagcatgagcaggagcattgttgtggtggagaaggtctctctggtgatgttttccaaggtggtggtgtgctaaagctttggctaactttctcaaaacactcctaagaagaagatgttatcattctttggtcctccagaaagtcaacaagcaaaatgccttgaacatccaaagaaactactgccatgacctatgctcttgacagttctgcttttcctttgactggaccatttctatccctttgtagccattgtttcgaatgtgctttatcttcagcattgtatcagtaaaaccatgttccattttctgttacaattcttcaaataaatgctccaggatcttgatcacacttgtttaaaatttccattgaaagctctgctcttgtctgcagctgagctgagcacaaaagtttggcacccatccagtagaaagcttgttcaactttaatttttcaaacagaatgtggttggaaccactatctatggtgtatactattgtttgtgttgttaatccttggtcctcttcaatgagggcatgaacaagatgaatttttttcttccaagttgatagggatggcctgccactgcaggcttcatcctcaaaatcatcttgtctcttcttaaaacaaatcatccatttgtgaactgctgatttctttggggcaccatccctataaccttttggtaaagcatcaatgatttcacccaagcatcattataaatttgatgttcatattgctctgatagggctcttttcaaactgatgtcttatccttcttattatctcaaagtagtttctgttcagacatgttataattagtacaaatttattttgatgcaaaaaaaaattttaatctatgcatagttttttcataacacacattttctatgaacttgtgaagagccctcatacacctctcacttactttgtataatttactttcaagctgcaaccacactcaaggtgtgggtcacagctatcctggccacgtgcaaggaacaaaacaaaaaacgactttaagatggaagatatattaaaaattagggctgacttagaagtgtagagcagctgtgtttaataaaaaatcatgaaactaggaaataaaagacctaggttcaagttctacctctgctactcagttgtggtaggaccttggtcaagctatttaagatttctaagcctagtttccatatgtataatttaagaaccattcactcattctcatggtttttatggtatagagggagagttaagtattaaataatcatacaacaaatgaatgaggatttgaagacaactaatatggtcctttcagagaatagaacaaaagtacctgacctccttcgtagcaggtgatgcttcaacttggatttgacagatgagtggtcattaattcactgaaaggaggaaggagttaagaggaagtatattctaggagaaggtaccaccatgttcaaaggctccgtagtggcaggaagcatagctggtttgacgaaatgaaaagaaggccagcaaaaatggccattgaaaagtttaaaatatgggagtgaatgttacagggtagctgtgagatgatatgaaacagggcacagaacatttctttaagtatgaaagcacaaaatatattaggtgttgataggataaaagtatacaaatcatctaaaagaactcttccccaacacaaaggcactgtcaaaacattagctggtgttgttcagtgactagggtactctgctaataaaggcaggaatggaataaaacatcaccacagtgacttttttcaagttgaaaatcttgcagcagaaagaacaaaagatacaggttcaccacgcataaaagaacctgactgtagggcaaacaaatgacagaatttgtcagaaatctccactgcagagccaccaatgaataccaacctagtttgacacagtacaggtgaaatgccagaagagaagcccccaggttgtgatcaaatgcagctgcttggaaacaattcaaaatgcaaacaacagacttcctgaactcctgggtcaagtttcaaccacagaaattataagctgactttgtcacaacaaaaatttgtcccacaaaatggatattttctttcgagcttgcatgaaactcaaaaaaaaaggtatcaatagaatggataggtcatttgtctctcaagaacactgctggggaaattacttataagacttataaatgagggtgatataatgtcagctctgataaggatattaattaaaagaaaattgactgttgacatttctgcaagttcagactatcagatcaaacacaaacccaaaggaagggagaaggtcaaggtgatattctataagccagaaagtagattaaaagtttctggacaagctaagatatatgaaattgcagacctgtgggcttttatgcttatagaaaatctaaactagaaccatctacaacttaaattggaaaggaatttgtagaaacaatgtactagatagcaatcagcatgataatacagagcacatcaatgtaaatttccttttttgacaaagtgaaagaccacataaacaaaggagaaaaggggtatataatctattataaccttagcaatcttttcaattctgccatgcaatacatagtaccatataagataaaaatctagatttttatagtaatgagatgactggaaagttatatgcaaaaagtggttaactaaacaacaggataatgtatactacaattttaaatatatacaaagctatttaaaaactaattgaatactaatcaaagctttggaaagagaaactagaagcaatttgaaaaaccagaaagaaaaagatggatatactatgtcacctatacatgaacacatttctgaatatcaaaagcataaccccaaatagagataaattatagattggggaaaacattgccaaataatatggtagacatcagattactatcttaaatatacaacaaggtcactaagataccaatgagaacaggggtaaagaatgataaagacgacagaattaaggcctgttttttatttgtttgtttatactttaagttctagggtacatgtgtacaacgtgtaggtttgttacatatgtatacatgtgccatgttggtgtgctgcacccattaactcgtcatttacattaggtatatctcctaatgctatccctcccccctccccccaccccacgacaggcccccgtgtgtgatgttccccttcctttatccaagtgttctcattgttcaattcccacctatgagggagaacatgtggtgtttggttttttgtccttgcaatagtttgctgagaatgatggtttccagctttatccatgtccctacaaaggacacaaattcatccttttttatggctgcatagtattccatggtgtatatgtgccacattttcttaatccagtctatcactgatggacatttgggttggttccaagtgcacttcatgtctaaaacaccaaaagcaatggcaacaaaagccaaacttgacaaatgggatctaattaaactaaagagctgcttcctcacagcaaaagaaactaccatcagagtaaacaggcaacctacagaatgagagaaaatttttgcaatctactcttctgacaaagggctaatatccagaatctacaaagaacttaaaaaaatttacaagaaaaaaacaaccccatcaaaaagtgggcaaaggatatgaacagacacttctcaaaagaagacatttatgcagccaacagacacatgaaaaaatgctcgtcatcactggccatcagagaaatgcaaatcaaaaccacaaagagataccatctcacaccagttagaatggagatcattaaaaagtcaggaaacaacaggtgctggagaggatgtggagaaataggaacacttttacactgttggtgggactgtaaactagttcaaccattgtggaagacagtgtggtgattcctcaatgatcttgaactagaaataccatttgacccagccatcccatacccaaaagattataaatcatgctgctataaagacacatgcacacgtatgtttattgcggcactattcacaatagcaaagacttggaaagcctggtttctaatgaggttttgtttagggtcattgctttgattcctctgtgtatttgttatctattgtcatataaaaaatacctgaaaactaagtagcttaaaacattaaacatttattatcttacagcttagcagcttagttggctggggcagcagtcatctgaaggcttgactgggggtggatgatcagtttccatatggttcacacacatggttatgggcaggaggcttcagtctcaccacataaacctccccgtaggctgccagaacatcctcacaacatggaagctgatttccccagaatgaatgatccaagaaagagcaagagaaagtcacactatattttgtgacctggcctcagcagtcacacactgccatttccacaatatcctactgattacacaaatcagccccatccagtgtgggagaggactaaactagggcttgaatgtcataagactagctactgattaataatagaaaatataaatctttcttttttcactaaatatttattgaatatctacaatgtgccatcgggagttctaccctggtaaaaaccaattcaaaatggtaaacctcacagtcacagaaacctcaagtaataatatcatatttcaacactgagcaacagtgagatctaagaactgcgcattcaggttgcagtctcaactcttcatccctgaaacatctatggatcattatgccaatgggaagttcataactttatttaatggccagaaaactgttcatctacatcgcaatacctcagcccaacatcagatctttcccaagcatgtcaacacaaatttccaaacagagattgcagctctctagctaggaccaacacaagaatcatcaaccaatgtttgaaagactcagatgtgaagcctgtagacattttctagattgttccaaattcattttatgtgcaaaagatgatatttctagcccgccacccctagagtgtgcatttcactttgtctactacccaatcaacacatatttgatggaatgcctgttagattttaggcagtagactagttgttgggaaacatattttgtcttcatgggagaaatagacagtgaagcaaaaataaataaataaacaaactgaataatatggctcatgataaatgccataaagccaataagcagaggacttgatagcgaatgctaagagaagggtagcagaagtggcctgggatgattttctgagataatactatatgccgagaccttggggagctagtcatttttaaaaggccagaaaaaagcactccaggtccagcatttcagactgataagtgccaaggtataaaaatgcttggtaagagcttggatctgttggatgacagtttggctgaaacaggaagcaaggagagcatccctcaaactgaggtaatagcaataagaggcagaagacaaacttttcagggacttaagagctgtgataaagagtttggggtttatgctgagtgtgatagggaaccagcaaatgtttttcattgggcaagtggcaaggtcagatgtaaatttgtagtttgtggcatagtccatgagacctgtggtttgtgtgacagctgccagagagcaccaagggcagtcagggcaaaggaaccaagcggctgattttgcccatagaaagataagacccttggccttatcttcatttgaacagtgccatttttattggggactgaaataaatgcatctgttgctactgatggttagtttgtcctcatttgctgaaagggaaaggtctcttcatgactcatccacaaatcctgctgatcctcctaattaaaaagttttcaaacaagttgatacattacttattaagagcccagacacaccaggcataaatccttcctgccatccatatgtatgccaggacttcactgctgtatctttcatcattatgagggatatccttcaatataattttcatgacaccatctgccatgttcttctctcaactttttttggtggggtgacaactcagtgattatgaatgtcatatctggcatcttttaaaaataaaactctatcagagatctcaagggggaaaacaagtaataaaaacatatccggccaggagcagtggctcacgcctgtaatcccagcactttggcaggtcaaggcaggcagatcacctgaggtcgggagttcaaggccagcctggccaacaccgtgaaaccctgtctctactaaaaatacaaaaaaattagccgggcatggtggcaggctcctgtaatcccagctacttgggaagctgaggcaggagaactgcttgaaccctggaggcagaggttgcagtgagctgagattgtgtgactgcactccagcctgggcgacagagtgagactccgtctcacaaaacaaacaaacaaatatccactggcaagtgctatggaccacagacctaggaatgcattgcaggttagccttttttacaccaaaaacaatgcaactaagaatgaaggtaaactgaatttgtagccttcttagttttcagcaaattaattcttgcattcttttaaaacattgcacgttttcatcagtataattggttatgtgttgcaaactattaaaggtggaaagagcaattcttaaaattaaactctctctccattcaccttcaccttatgtatccaagacctttaaagttccacctcctctgagatgacttctctaatgaatccaaccacatggtttattcacattatgtgacattatatgtggcctctggcatgaaaccattagcaaataagcatggatctaatttgtttttttatatatctccacccaaaataaataaataaataaacagagacaaggacttaggtgcaaggagtttattttggagatacccccaggaagcagcagttagggaatggggagattgaaacaaagaggtaggaagaaaccataagaggtgctgttaaccaccatgggcaagtggtgctcgatgcagctggggactaattcttgagtgacaggtaggatgtacctaagaatttccttctaagggacaggaggttaaggaatctatcatattttctagtggttgaagtttgcctctggagcatcaattttccaaagttctgtgctacccaaaaggcagatcaagccagctcctgggcctttggaaaaagtcttgaggcagaagtgcagaggggtgggaggtgcttaaagtgggatgacgtcattttgcatgggaactgtccagcacagctatagtggaaattagtggtggatcaagagattgtagcagagggcacaaaaagtgtctatttcagcataaaaactgtgttgttaattaaaaataaaattttgtttaaaatgatgtttttaacaatatcactgaagatataaacactcatttctcttagtgtcatagagagactgactgatcagctgactcagtctgagaatgcccaagtattaaatgagcacttgtcgaacactagttgagcagtatgaagcaatgcacaagttaaagtcaagatgcccaactctcaaggagcttgcaatcttacagggattatcaacattcacaaacaaactaacacataactggtagttctgactacaaaggcagaaaaagtgagagacagcatcatgtagcggttaaaagcttccactctggagtcagagagacctaggtttaaaattaatctaggatttgcagtgtgatcttggacaagggtcttaatctctctgtgtcacaatttcttcatctgatggttagaaaaataactatctgcttcatggagttgtctgaaaagtaaatgcaagtaaagcactaatcacagcacccggcacataaatattcattaaatgtcagttgttttgtgaaaattaaagagaaacgtaacagtagaatgggatttaaagaagagaagtatctccttgtcagactctttctctttcttaaatatgaattttctatagcctctggcccctgttctagtaccattttcccttttttaaaagtttcattttctaaaaaagaactacttatattaagattgggaggccagtattaaaagatgtggaaatatagcacaaaatgcacgagctttggagcaatactagccaattttaaatccatgtatcttgccactgaatgaccttgggtaaatctcttaagcacactgccactcagttttctcatctacaaaatgggagcaatataacctgtcactgtgaagagtaaaggaatgtctctggaggatttccaacacattttagatcctcaaaagtattgattgctattactcactattcattcagtagacacttactaggcacctactatgtataaagcactgtactaggttctacagaataacaagacagacataaataagatatgggtccaacagtcaaaagtgttacaggttaaacttattaatacataaaaaaatctagatgtttgaaatgactcaaattaataagttacctgaatatcaaatgttactatcctaatttcaaagacaggaaaggagacagggaggaagagagagggggagggaggtggggaaggaggaaactaagctggttatctctgagacagagtttgcagaaatacaagatgatgagatctgtttaaattcacatctgctataggatactcagaagtctacaatgtgaactgaactcagagaagatttctcccatgaggctaagaatgtataaggccaactctaccaaccctgaacctgcaacatataacaatgctgctctatcccaaacttctaatccaggtgaaaccaggatgaaatgactgtcattgacaccctggaagggaaatgagtttgagtagagatgagaaaaattaatatggtgatgatgggatcattctactggctggaatgcatgtaaggcctcatctctttcctaagtcactgtcttaccaaaccagaatggggggattccaaaaagagcaggatctaagctagcaccccaagtttattaaactcaagaatggctctcaagatgagcatggtcttcacaagtatatacttctccttggttcaacaagtatcccttcctcacacttgcagaatactttatagttcacaaagcactttaatgacatttaatgtccatcatctcacttaactctcaggacagccctttgtgtttagtttccattttgtagacgaacaaactgaaacttgggaagcttaagcaaccggtttgaggtcccataccaagatgcagaggagcctggactgaaactcaagtcctctggttccatttccagggcattttccacacttgtgtacagcctctgagaaaagggaaggttgcatcaatgaaattggaaggcagtaattggaagccattttcctctgacttagagacctgaggcatctctgtcaaataaaaattcccaactaaaaaactggtggtaagccgggcatagtggcacaagcctgtagtcccagccactcaggaagctgagggaggaggatcacttgagaccaggagttcaaggccagcctaggcaacctagcgagacgtcatttctaaacaaacaaacacacacacacacacacacacacacacacacacgcacgcacgcacatgaaaaaattggtgtctctgaatctgtgctatccctccagatcctcagatgtgaaatccttaaatcctttatgaacatggagcctactccatgaagagcaccattagattcaagatagtaaaattcattcgaaactaattggtgagtaatgaagttgctaaagtttatgagccttgcaccaacactaatacagaggtacagtgtcaacaataaaattgtaatcactgacaaaactagccttcatgcagaaaagggaagccttttccttttcccttggcctgtagacaatagcattagacaatttttggagtgacaagatcacttcctcctgcctagttttaaagagtgaccacaaggaacagcttcgcccttagaaataacttttgattatttgataatggaaaggaaaaaaagtgtacaactctcctctagttaaatttcaagcatttagagaagtggatatgtctatatcacaacatatcctgaaaaacagccatggccatacacaagagaataatacagtgcccctttgtactcctgtctacacaggcagttgtctgctaccaaagaggggttccagaagaaaatgttatttggggcagaaaagactggcctcccgccccccaacagatctataagaatatgttaacctcctgtgcaactcccagagagctgaatggataaatacactgagtactcagtaaaatctacctcaaaacaattattctggtttttgcttagttagtatttgttcttcctaattgtattaagagaaccagttgtttccagaggtcagtcctggagaatgccagcaagccctgggatctttattggctgggatcttcatgttggctctgatgctacactgaccaacgaagttaccacaggtctcacacagctattgagcactgaaatagggccagtccaagtggcatggactgtgtgcagacaaagtgactccatattaaatgttaatagctatgttgacttattaacctcagtcccaggaatgctttctgattcccactctatttactgtcctcaatgtgagaacatgtacttgctataaatcccgcctttacatcaaagcaaccttgatgttattgcacaaattataggctatgacgcacatagcattcttgccttttctggagggctgcctttaattggctatagagcacatatgccctttctctgtggtatataagctcttggtctgaggagtaatggtgtggagatctacctgtcttgctgccacccaagaccatgaggcaagttccccagtaaatcaccctttactagcaaactggatttgtctgcctcattctttggtttctcagctccttctgtgcttggtggtcactttgcatatgtggtcttttcacagaacagactatacatgtcaaatacacatcagattttgaagatttagaataaaaataataacattggtaatttctatattgattccatgtaaaaatggtagtagtttggagggattgttttagtaaaatagattacaaaatatatatatatatatatatatatatatatatatatatatatatatattttttttttttttttttattatactctaagttttagggtacatgtgcacattgtgcaggttagttacatatgtatacatgtgccatgctggtgcgctgcacccactaatgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggacatgaactcatcattttttatggctgcatagtattccatggtgtatatgtgccacattttcttaatccagtctatcattgttggacatttgggttggttccaagtctttgctattgtgaatagtgccacaataaacatacgtgtgcatgtgtctttatagcagcatgatttatactcatttgggtatatacccagtaatgggatggctgggtcaaatggtatttctagttctagatccctgaggaatcaccacactgtcttccacaatggttgaactagtttacactcccaccaacagtgtaaaagtgttcctatttctccgcatcctctccagcacctgttgtttcctgactttttaatgattgccattctaactggtgtgagatgatatctcatagtggttttgatttgcatttctctgatggccagtgatgatgagcatttcttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcaaaaattttctcccatgttgtaggttgcctgttcactctgatggtagtttcttttgctgtgcagaagctctttagtttaattagatcccatttgtcaattttgtcttttgttgccattgcttttggtgttttggacatgaagtccttgcccacgcctatgtccttctgaaactattccaatcaatagaaaaagagggaatcctccctaactcattttatgaggccagcatcattctgataccaaagccgggcagagacacaaccaaaaaagagaattttagaccaatatccttgatgaacattgatgcaaaaatcctcaataaaatactggcaaaccgaatccagcagcacatcaaaaggcttatccaccatgatcaagtgggcttcatccctgggatgcaaggctggttcaatatacgcaaatcaataaatgtaatccagcatataaacagagccaaagacaaaaaccacatgattatctcaatagatgcagaaaaagcctttgacaaaattcaacaacccttcatgctaaaaactctcaataaattaggtattgatgggacgtatttcaaaataataagagctatctatgacaaacccacagccaatatcatactgaatgggcaaaaactggaagcattccctttgaaaaccggcacaagacagggatgccctctctcaccgctcctattcaacatagtgttggaagttctggccagggcaatcaggcaggagaaggaaataaagggtattcaattaggaaaagaggaagtcaaattgtccctgtttgcagacgacatgattgtttatctagaaaaccccatcgtctcagcccaaaatctccttaagctgataagcaacttcagcaaagtctcaggatacaaaatcaatgtacaaaaatcacaagcattcttatacaccaacaacagacaaacagagagccaaatcatgggtgaactcccattcacaattgcttcaaagagaataaaatacctaggaatccaacttacaagggatgtgaaggacctcttcaaggagaactacaaaccactgctcaaggaaataaaagaggacacaaacaaatggaagaacattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcccgcattgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataatgccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagatttaaacgttaaacctaaaaccataaaaaccctagaagaaaacctaggcattaccattcaggacaaaatatatatttttaaaaataatttcacctgtttcttttcaccctaaataatatatgtactagaaaatttaaaattacaaatgtagttcacatgtttgaattacattatatttttatagggctctaatgctctggaggacacatccttattctccaagatctctatcaagtcatttaggtaagtttaatagaagaggtataaatgccatgttttaatgaccctgaatttgggtaagttagaaagtgcttacttgctgtccaaggttctttgaaagtagaaagatgcaaaacagtgtgcttgtttgcctggttgttttgggcagtttgatctctcattgtctctggtaggaacagtgtctgtttaactgatctgtagggattcagcattgtgtgatggggcatgtgggtgtttaactgtaacacttgagaagaatgcttacagctcagctgttagaatctcgtgctaaggaatctaaggttaagggttgaatccccagccagacacacttagctcagctttttttgtggaccaggcatgcactccccacctgggcttgctttcttgcaaatgtccattcttggttacaataggggccagtgaaataatggtgctgtacacttatcaaatccatcaacaccactccaaaaagcagctcagcttcatccttcaggggaacagcatcacctgtaccaccttttcatataaaggaaagcatattattttcctgtgttaaaaaagaaggttttttttaaagcgatacctgttacaagtttcaaaagccaagcaaaggtaaaaacataaaaagtattgtgtttgctccctcatttgcttccagaaaaaccattcttaagctataaaggtccagatttgggtaagctaaatcctgcccatctaggagatttagaagatcatagagaaacatatttatgcttcttatttttcataaacttactattaagaaactcagtatattagattcttgcatgacttgtatccctcaaatttccaagaggaattggccagcagtgctgtgtaacagaagccagagtccagagattcaggccacaggctgactctgcaccaatggctatgtggaatgggacagttcatctccgtctctggttctgtgtgtccccctctgtaaaagcagagtttgtacttacatttagtctaattctatagtttcaaagcaccctagttgaccaccttgaaaggccaaatcaaacattcatgtttctcaagtctactttttttgttggtttgtttctcttcaagagcaatagaggtgatgcctcagaatttggccgaccttcattttaaacagctgtgccaggcagctttggaatgggctcctgtctccagtggcttttgcacctgcaatctggctggctcgagctttctgtttcccgcctgccccggcagcaggctaggagtaagagcagttgcctatgacgttctctgaacctcctgctccaggcgactgagccaggagatacctaaggggcttgtcaacacctaatgctgtctctccttctccttggctccaaacactgttctgggtattgcctcgctgggcctggctaaagctctgtcttctgaagtgaaggttgaccttttattaaatactaaccctacaagaaaagtagaataaactagtcccattgtaacttgccaagattaatacatccatagaattggggcaggagataacaccgaatgtgtactacagactagatattgttaagtagtatatttctaatttaatctttaatctttataataagcctatgtaatagataggcactatgattattgccaatttacagatgtggaaactgtgggttagagaaataaggtaactttcccatagacttatagctattaagtgacagaggtaggatttagagataggtagatccacttgagtccagagcttatagaggtacctaccttaccaacaggacggctttttggaattcatttcgataaaaaaaaaatcaagttggatatgacggacttgatcatttcttctgcctgagatgcctaacacatctaaaagagctgtacgttagttcatgttattgaaaagcagccaccaagacaggctagatgtcactatttctgagcctccttctactcctcttgtttttttccttttttaggagggaaagactggcggaaagagaaatacacaaacctcagaagggagcagacaattcacacatttctacagtttaaccttcagtgccagtaagtgtcaggtagtagagcttcaggtatgccccaaaagtctccttgcaaggaactgagaaacctggaacatttctgcgtttatgcttatccacctatttctatcctctaaattcatttgatatctgctcttcctttcaaaggtaattcagatcacaccatagcaccacggaccataaatcattctgaacagaactctgtttctggggcacatcaatgttcattcaagggatcgtgctttagaaactaaccaccaatatgtatttcagtaatctactccaatacttataatgtgacacaaagaacaatcttcagccttcaccacttcctcaacaccacattttgctcagctttccagaactgcctttggaatctcatcttataggagggagcttatatgcaccagaaaagataatgagcaatcctgtttaccagaaactcatctaggaaaacagctaaggaaagaggatgaagcttattaataagccccaattctcagctttgactgcgttagatatatcaagttcactggaaccttactaggtatcctagtctcagccactgtatttctcaggtctgggacatatctctgagcctttcccctatgctgatgttggtttatcaggtagtgcctgccaacagcctatggctcatgctaaaaataattgagagttgctcaattatttctagagaggcagctggtgtagtggaaagaacactgactgataataacagctattgtttactcacttcatgcaagacattttacaagcattatctccattctgctgataacctaaggaaataggtatgattgcccccattttttacctgagtcagttaaagattagagaatatccatgatttacccaaggcctcaagtttattgtccaacagatccatgatgtgaattgaactctctctctgattccatataattctgatgtatcattactgcctccaaatagaaggcagaaaacttggtcagagtcctagaattgccacctgggtggcctataacaaaccttaatttcactctggatcttaattagctcagctacagaatggaaataatgctattgagtcttaggtgaggatgcagtcctaagagtcaaatagcctgggttaaaacctagtcccaagcttaccagatgcatgaccttgaagaagtaaattagctttacttttaacatggaaataatagcaacaactaccccaatagatattgagtagattaaacaaattaaaacatgccaaatgtattagtcagggttctctagagggacagagctaatggaatatatatatgtatgtatgtatgtatatatatatacacatacatacatatatatacatacatatatatacacatacatatatatatacacatacatatatatatatagagggagaggagtatgtgtgtgtgtgtgtgtgtgtgtgtgtatataatatatatataatatatatatataaaatatatataatatatgaatataccttgcatttatatatgaaaaaaacagaatgtattagcctgttttcactctactgataaagacatacccaagactgggtaatttataaagaaaaagaggtttcatggactcacagttccacatgtctgggaggcctcacaatcatggcacaagagcaaggaagaacaaacggacatcttacatagaggccagcaaagagagaatgaaagccaagcgaaaagcgtttccccctataaaaccatcagacctcgtgagtcttattcactaccacaagaccagtgtgggggaactcaccccccatgattcaattacctcccaccaggtccctcccacaacatgtggggattatgggagctacaattcaagatgagatttgggtagggacacagagaaaccaaatcacagagccaccaggtgatagtctgcaaactccttgttttaaaattattttctcctttgcctggcctagaggtatggaggctctattatcatagcatccagatggacataggagagcagcctgaatgccaagatgtctggtatcagatagctcagttaaaggcaaagtatggaaattactaagagcaggaaaaaaaagatacaaatattttcatctgataagagaagattacagtgatcacagagtgtagtggtttggcatcaggctgccaagagtgaaattccaacaagtttgcttatcagtgtctcagtttccttgtctgtaagctccgcctgttaatagtgtctacctacagggtcactaagtaaggtatttatcacagggtaagtattaaataggtaatagatgtaaccctatgaggtattctatatatctgctgaggtaaattcttgttcctaataatgtttcctccaacttcctgtgagtttcggcggtgagaaagttagaatggaaaaggtctgaaattgagagaaagttgcgaaatgagcaataagatggtgttcgtgccctacgtcaaaaagacttggtcagaaacatacatctttgagacagacttgagagctcttgtttggctctctgaccttctgtgggaaattaaatctcccaagttgttaaatccaagccagtctttttctccttttcagttttccaaggtcataaacacagaaaagggattcctggccctggtactagagctcatcttataagcccaatgtagtatagttctaaactaagcatattctataagcaaagtccctagatttgtttcctggcttcaccacttaccatcaattggaccctcggcaagttatttaacctcactaggcctctcttttatcatctgtaaaatgggaacaatgaaatagagacactgagaaaattcagtgagacaatgaatatgtgataggcagaacaatgtccccgtcccccaaaaaagtctacgtcctaattcccagaacctgtaaacacgtcatattacatagcaaaagggatgctgaaagtgaaattaaggtttcagatctttaaatagggagattgtcctggattatccgggtagacacaatctaaccacatgggctcttaaaagtggaagaagcagcagaaaagtcagagaagtggccagagagttccaaagcatgagagggattcaacccacacttgttggctctgaggactgaggaaggtggccacaggtaagtgggtggcctctagaagctagaaacagtactcagttgacagtcagcaaggaaacagggacttcagacctgtaacagcaaataactgaattctgccaacaacttgaattagcaggagtcagattctaccctagagcctccagaaaggaatacagtcctcgtaacacctggatttaatccaacaagacctgtgttggacttctgacctactgaactatgaggtagatttttgttgtgtcaagctctaaggctgtggtaatttgttatggcagcaaaggaattgtggtacggaatgtcaagtacttagaatgtccccagcacacagagtaaaatctcattcaaatccagcaatttgatgatggcaatgctgatgaggaagaggggaatgacaatgaatttttaggttacatctgaaattatgactattaagcctgcctataaacacaatattaagatttttaggtcctcttgtggatccaatatcctattaaatgttttctatttagtaaattactttatctaagcctcaaaactattctatgaaataggtacaattacacctattttcatgaggaattggagctcagaaaagttcatttatcttatgctgagtttcgctctgagtgattttgggttatgcagaagctatcaaggacataagacaatcctagtggagggaaaagttcataatgtccccaaagacaaaaatacagcacaatgagttattccttcaatgagcatacttaggcaacactttctttccatcaatgcctaaagcgatggttggagccctttgaaatcaagttaaatggggagaggtgcacagaagcactagaacttgccattgtttaagagacagaaaagaattgtgctgtctgagcaagacaatcctagccatgtgcctgctgagagcccagagcatgtgagctttaactaaggaaaccaactccaaatcctcagcagctacggaagtatgaaatggatttcaggtggactgagacagagtttagaaatgggaccaaatgtgcagtctcttttgaccaaagtttaaaggatgatttgcttcttcttttcccaagcagaatgcaattttagatcactcattacatcccaagagaaattcataaaagtattactcaacaggtgaataccacaggagtttctagttcaaattttagaccactccaagtatggtcaggcaaccactgcctcaaaattacttgtgttgcctgaaagaaatatagcttcctgtccctctcccaaaagcaaagaaattgcagaagcccagaatctgcatttggtgattctctcgcaaattcaagtttgagaaaccctttgtagagacttacatgggtatccagaggtaagtcaggaggcatcagcaaatattccgtggcaggctccatgagaagtactgagataaaaattcttgccctggctccaagatttcacaggcaattgatgaactacaatacaggacagacagacataagtaatacatagaggtaggtataagtagactgctctgggcacacagaaatagagcaatcaattctagccagggctctccctccaggattttaggaaaaggtatcagtcagactaaacttgacaatgagatcagcagattacggtgtaagattggggaatagtaagttggttccacaagcagaaggaaggtccagaccaaggtcagcaaaggcacaaaagcatgtccaggcctatgctatggtggaagagaggtcctcaaagactgtgagtaaagacgtcagaaaatcagtccagctggaggacaacaaaggcactgatggccataataaagtgggggacattttgagtttttaaagcaatggtatgagttagtctatggtttcaaaatgaaataggctatgcattattttcctgtcactcccataagaaattatcacaaaatgaatggcttaaaacaacaagagtgtactgtctcacagatctggaggctggaagtctgaaatcaagtgttggtagggctagattccacctaaaagctagagtgaagaatcctttgccacttccatctactggtagctccaggccatcattggcttgtggctctatcacttctacctctgcctctgcgttcatgtgagtttctcatcttctccctgttatcatcctcttttgtctcttatgagagcatctgtgattggattaagatcccaaccagatcattcaaaatgatctcatatttagctgcttaatttaattacacctgaataaaaccttttttccaaataaaagcatattcacagaagattaggacaaggatatattttagagaggccacaactcaaccttctataggcttccattaggctgtatgatagatagacagagaccagtttttgaagacagacctaccctggtttgtaaaatcaattctgctacttattgggcatagaacaaatgtgcccaatggtgataataaatattttgtagggttgttgtgaggattcgaataatgtctatacctttctaagatagtaggtgtctggtgcataatgcggtctcaataaactgtagtaatattagtgacatgaagtacttgtgctttgtgagatatgttagagacactgcagtttagggggtgagtggacagggttgagaaatgaatgctttgggtgcagttcttagcctatgtgaccaatggcctatgtgacctgaggaaaatgactttgtctgctggagtttttttaatctgatatttgtgaaaggaaatttgtaatatttactacatcaggagattgctattagtgtttaaaaaaataatgaatgtatttagctcccactagaatatgagaaaacaaaacaaaaccaagcaatgaatgtaaaacatttatcccagtgcctatcttagcacatagtaattgagctactcagtgattatgaggatgagacaaaggatcatgtgtatgagaaagtagtcattcacacatggagacctcatgtttagaatgtaaacaaagtacttttgtgtgaaatagctcatttagagctcctataaactgttatcttattttgaggctctgcctggggcaagaactctgcccttccagatgttcagggagagaccacctccctggatcacatttcttatcaaattaagtactgctgaaaattttctgttgacttttggagggcagaggccaaaaagaaaaaatgaaggctctttggggaagacctgcatgagggttctataactcttcccataggcctgagtgaaggctgctgcaggaggagttttctcactcctcacttccatttccttcttgctatgatcctcagaaatgaatccattaaaaaaaaaaaaacagagctggtcaaccaagacctgctcagtccagagaagctacacagagccccactgtgaggagaaactaacatgataatctattctggtgctgaatgttctgtctctacctcaacaaagcagaggggctttgctttaaattttttttctaattttaaaacaagacagcaaattaattgttagtgtccaggcaaagcagatctgctgaggtcagtgaggcaaaaaaaaaaaaaaaaaaaaaaaagagaccatggtgaaatcacaaggagaatcatacagaactaggtggagatactgagggaaccaacacactgttctgaacactttgggggcttcagagtatgaagatgaccaggttccaagatatacacacagcttaaaagtttcaaggagacacaaatcagaaaggtgtatcaccacaggaggagaaacaaataaattcaagtattcccaaactagactacaccacagaaatattctaagactaagatctagtcaaatacattgagagaagagtgatctattggcatgagtgacacagagtaaggaaataatatggatagaccacatttattttcaatgaagaaagtaacatagcaaagataaaattgaaactaagtttctaaataattccttatctggtcccttccttctcattctgacatcaccgcctccttccttcaacttctatagtaagttctaagtggtctccttatccacctccacttttaacccattcttttcacatcttccattttaacattcttcccagaaaacataaatggccaatacatcggaataaaatttcacatatgccaatataacaagagatgaaggaaagttaatggtagagggaggaatagtgtgttttttagttctatcagattcttttttatactggcattttcatctgtcaactcctgtatcatttttttgcgattcttagtttcctttgattggattttgctgttctcccaaatcttgatgatcttcattcctatctatattctcaattctatttctgtcatttcagacaactcagctggttaagaacccttgttggagaactgatgcaatcatttagaggacatagacacttgggtcatttgggttgccagagttcttatgttgattctttctcatctctacatgtgtgtgttcctttaactgtgatatagattgaatatggtcagtagacttcttttctggatgtgttcacagggccaaggctttgcgcagggtctttatttgtaactgacatcttgcctttggtttcacagttggcgggttatgttattgaggtattttggtattgaagctttggagtatgatccaataggtggcacttagatgtagtggtcagttagcaggttcttgctcagttgctgtgttctcggtcaatgatctgaaagtgtgagttcctctcccacttaagagctggctgtagatcgtggcttgacattcctgggctgcccaccaccgctgcagggtgatcttcaggtttatatttcctcaccaacttggaggcagcagaggaagaggccttatcaatagatgtggctgatggtctttcacttgtctcctgggggctccaccccagagatatgcaggtcagcaatcgctcactgcaatcagcccaggataaggggtctgtgctgtgggcccaaggcaggggttccctgcttggtgatgggtgatggggtggagtctgtgggagaaggactggcctcctccccataggtcgactgcagcttgttagaggtgtgaataagacacttacggtctttgctccttcattagactgagggtagcagggatagtaccactacagaggcagtagcagagtggctttcagttgctcccgggggatccgcctctgataaatgtggactcccagctgttgcccagagtgttcagccattggggtggggcagctgcactgttggtgtgagcttggggctccacttgctggggagcaaagggcgaagggctcactgggaagagagactagtctactctccatatggtgatagtggcatgctgtaagctcaggtgtagccctcaggctctttgtttcttccccagactgagggcagcaggaatagaaccactgctgtggcagtggaagagaggcagtcagatggctctgggagtctctccccagggaaactccagaccactaccactgggtatgctcaggatagctaagttttaccaggaaaatgcaaatcaaaagagttcaggggttgcgatattagtatcagacaatgcttaattcaagaaaaaagcaataaagagcataaacagattaatttactaactcacaattaagacagcaacttaaccatttataaacaaaatagcatatcataatatttacattttgtttgaaaagagaactacctaaatgcaacagcaatggcaaacattaaagcactccccccttaattttttatagttcaagtagaaaaaaattacagagaattgaaatacagaaaatacatttaatatatatcataatccatatcctaaaaatggatctataacttccttcaagcatgcctgaaacatctatgcaaatttttttttttttttttttttttttattatactctaagttttagggtacatgtgcacattgtgcaggttagttacatatgtatacatgtgccatgctggtgcgctgcacccactaatgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggatatgaactcatcattttttatggctgcatagtattccatggtgtatatgtgccacattttcttaatccagtctatcattgttggacatttgggttggttccaagtctttgctattgtgattaaaaggtgaagaaagctcaatattctaaaaacaataggtcctaatgactatagttaattataatgttttgtatggtcaggtatggtgactcatacccataatctcagcacttttggaggctgaggcaggaggatcacttgatgccaggagtttgagaccagcctgggcaatacagtgagacctagtttctacaaaaaaaattttcaaattcactggacacggtggcatatacctataatttcagctacttgggagcctgagataggaggatcacttgagcccaggagttaaggctgcaatgagccatgatcacaccatagcactccaacatgggcaacagagacctgtctcaagaaaaaaaatgttttgtatacttgaaaatttgctaaaagagtagatcttaagtatttttaccacacacacaaaagagagataactatgtaaggtgatagatatgttgattagcttaattttggtcacatttcacaatctggaaatatatcaaaacatcattttgtactccttaaatatatacaattttaatttgtcaattatacttcaataaagcttgggaaaataaataaaacaacaggtcaaattatgtacctcagaatggggaaaagttcttccctaggctccttataacctacttttctaggcctattgctactaactcattaattttacaacatactatggtcactcttcataatttattcttccccatgtctccctactatagtgaccaggaacccagcaggcgtctaataacccttcctccagccctgtttagcattttaatcaatgatttagatgaagatatacgggatatatttattgaacatgcaattgaaacaatagcaactatatgaacaaaatcaacttccaaaatactcgtaacaatcaagccagtctaaatagaaggaagtttaacagacatataaatacaagattgggtataaaacctaaagaagtgaagaatgtctgagatttgatttagcagcagtatgtcacgtaaaactaacaaattgtaatctggttttagtagacagtgagcttaatacagttcaacagtgtgcaatgttgatgccgaaatgggctaattgtgtattactagatgcagagtaactagaaccagagaggcaatccattccaatttcagtttggggtgtgaaacatttttattgaactctttatggactgagtgggctaactcagagggcactgagttccccataaccaaaagtgttcaagcaaagccagaactatgttagtagactcatttattcagttttcaggagtaacctcaggttgggtgcccttggggtctgaagtttatggcagttcccaaagagtgccttcctcctgggatattcagattcaatcaatgcaaccattcttttttgtttttgcttttgtttttttgagacagaatctcactctgtagcccaggctggaatgcagtggtgcgatctcagctcaccgcaacctccgcctccggagttcaagcaattctcctgcctcagcctctgagtagctgggactacaggcacacaccaccatgcccaggtaatttttgtatttttactagagataggctttcaccatgttggccaggctggtcttgaactcctgacctcaagtgatctgccctcctcggcctcccaaagtgctgaaattacaggcatgagccacagcacccagtcaaccattctttatgatgatatatcaggtgacttactttttatttccctttcacgttcacctgacacaataactacttttgtagacaatacccttcagagagcttcagcactgcaatcctgctcaggtggaaacttagtgagtaagaaggaagtgccacataaaagcagcagatggtaaaattcccctaatacagcaggatctgattgtcccagatagctggcatatctacagaccagacacaagttggggggaagaaaacttgcccccattagtagcatttttatgcgtaggtgacattctacaggtaagttacaagagggcaaaaataaaaaataacacatcttgtaaggcacaggcatacacatgaggtaactccaatttgttgctgtgtgctacctgcatgagctatacctctttttgcctttttcacagagagaaacagaagtggctggttatgaaaaccggcagcacagctttttccctccctgtggtgtcttcccagataagaaagcaggcctgaatcccgggtgctgttcttccagaccacatgaaaggtactgtctcaggctcctcatctggaacttttatgctttacaaagatgataatagtccctcaaaatcacctacaatgctgaattaaatagcattcaaagtatactaggagaaaattacagtcaagtttgagtcaacagatctcttaacctggtaacttttaggaaaccacttaatttctgcaactcagtcatcttccctataaaatgggaataataaaacctatcttgactactctaaagactagtattgagaagcaaatgaggtaagagacatgagaaagatttagaaattataaaattcaacataaatacaaattaatgaggtacatctattatgtcacctgatctttataacgtgacaattgtccaaatcaaaatggagtcactaaagtttttttttgtttgcttgtttgcttgtttgtttttaaaaaaaccctgataaatagagccacagaagtccatgaagagaggattctcatattcgtatacctgacaagaaacactatcacaatgactgcaaaaaacacaaccttgtacaaagaccattacaaacttacacaaaagaatacctttgcaaggacatctgcccagcaattgcctgtccaatctcagactggtgtcactcttgttatttatctttgtaaccaaggataattatttcaaaacaattatgtaattctcctcattttttcctttaaaaaccatttctttcttttacctccctgagtactcatatgggcacagcagtctcattgcagtgtattctcatgcactattcccaaataaatatttttttcttttagaaagcctctctctgtttgttatttaggctgacaataacaaccccaggaaatgggtaagttattatccctatttattgatgggttgcgggggagaaacagaaaaggatcaggctatttgcttaaagtccctcagcaagttggctcccaaggcaagtccagtgcccttgcatcccatcacctcctagaccctccaccagtgctgcttattctctctgctgttttcccagaatcattcactgcccttctccacatcacaggagctcctgtctcctctgacttcaggttggactggctaatagaaagaccaaaaggtggcaggagagcagagttgagcattcgttccctggctctccccctgcctcagcactgtggctctgacaatgactggatccctctacaacttcgactcttatctagagcctccttccacagtggtaggtcatggcaccccatgaacactggatccccatgctcaccccatgctcttcaggcctgggcagtacaacagcttcctgctattgctaaaacctggcacctcgtcctctcttcctaggtgcctcagccctgcccacacatctctaaattgtacctttaaattgtatatctttaaattgtacctttattcaattatctgtaaaattccagttgagcatgtcttctatttctgctgagaaaactaagaaactcctccttttcaaactatttgttcacaggctgccaaaaacttttaccacctgtccccaattcctctctcagccctctcctcactttacccagactcctttcacaggaagtcataagccaccccccattcctctccaggcgcgaatttaccatggctctggacttgccctttaccagttctctattaatttaaaagctgataagtcctctcccaagctcctatttccccatcctctcttcttcgtctatctcacactttatttctccataggaaagaatttgaactatcgatctgtctgctgtataatttggattgagaaacagagcatgaaaacactctttgaataccttcagggaaacatactctattcaaactatgtttctttcaactctaaatttgtaaactattcttttttttaaggtagttctgcctaaaagagttaaaaaattgactaccctatcaattttgccctcgaggttataccaactatttctatactggcaataaaatcaactccatttcttccaggctagatcacaattattactaggcacatattccaaggctgcaataattcagtggcccaatactatttcaaatttatagcagaaagaggcacaatagtcattttggcctctagggtgccttctcactaaagaccatgagctcagaggttacacataacctataataatagttgtgtcttcctagggtgtgattgaagaaaagaaaataaataaaaatgcccttgccttcttatgttagaatgcgtaaccaaaagcacccaagagctgacattcagttcaggatttctgagacccttcctcctttccttgctgtgaaaaataatgatctgctgttctctgactgtcattcaaacaatgggcccaagaagccagcatctctctcctcactggcctcttgttctctaaatgtactgcccatcaccactttccaaaccacattagtcatgaagtgctgacaataattactaacacattgaaatggttgcccaaaatgatgactgtacaggcctacagaattggtatttttactgcagtaaaagggtatgagtatgaggcttcataagaaattttatggcattttggctactgatcacaggtacaaattatccatgctcaattaaagaaagatgaaagttcagctttctataattaaaccaataacttgttcagcctcaggctggaagtaaatgttaaggattcgtgtcttgcaatcctgcatgaagaattaaagaagcaaactctattatcaccgacttacttaaaatcaaggccttatgcatattggaaattattcatgatgagacttttagatcaggaaaaaataagtcattctcacactcttttggctgccttgcaggcaataactttcttcactattctgtttggaatattgcatcatttagatcattcttcttaagtcaatccagacattttctttagattctgctaagaatattatatgaaatttaaggactggaaaaaatacttaaagagatattttaacatgataaaaaaaagtccaacaaccagctctgcaacttcctaccctctgcttctatttccttacctataaaatgggctgtgatgattagttttatttgttcagtttagctaggctgcaatccttatttattcaaccaaacactaatctaggtgtttctgcaaaggtgttttgtagatgtgattacagtccacagtcagttaattataagtacaggagattatcctaggtaatctgggtgggtctagttcaatccattgaaagtccttaagagcagaactgaggcttccctgaggaagaagttctgcctgtgtcttcagatcatgccaaggagttctagcctccccctcctaacagcatgccttacagattttgaaattacctagcggcccccagttgtgtaaaccaattccttccaataattctatgtccaaccatccacccatccatccatccatccatccatccattcatccatccatctttctgcttgtttctcttgttataccttgactgatacatgaggataataatgcctattctgcagcagtgctataagaataaaatgagattgtatatataaaaattattttaacacaaaataaatgtaaggatgtgtatgtagaattactatttgatttgactaactcaaatcgagctaacaactccatataatcactgctctttcctaacaggccttgtgattttgttttccagattctgcatatctgttacattctaaggccacttcacaacactaccaaacccagctttacagtttggaagactgagagaatcatacccaaagccacaaacatccaaatatggtgttcttcacaagaaactaataatgaacttgagacagagtctgcagggataggtatcagaagtcaagtctaaagtatatgaggtctatgttcaaacaggagcctggacatgactgagataaagaatgattcccgagctgggcacactggcttatgcctataattccagtgactcagaaggctgaggcaagaggattgcttgaggccaagagtctgaggctctattgagctatgattgcaccactactgtccaacctgggggacacagcaagagcttgtctcttaaaaaagaaaaaaaaagattgagtccagagttagagctacaggataaaaataagttaactgaactcagggggagaaaggaggggaacctactccaaattctagctcaggtcttacctaaatgtgggctggctcagctcccaagtggctgagtgaggtcatgactgagaagaaaggacccctggcccaagtcgtgagttgaatgactcttaggttgagaagctttcgtacctaagaatcaagtggccagtggtgcaccatgggagagatgatcaccaaacttttcttctctttgaggtcacacacctagattacctgccccagtctcccttgcagttagatctggctgtgaggttgagttttagccagtgggataaagatggaagtttccactggcctaacccataaattcctccacaactcttcccacttttaatcttatgcccccatgtcgtctcttctcccagccttcttcgtctcaataaatgtcactagcacatatccagtcattcaaggaaaaacacaatggagaaaaccatcctcaactacccattccctttacctcactctttcccagcatcctgcaaaatctcgctccaaatatagctccagtttgtccacttccctcccttttctccagtctataaccttggtttactccatcactatctctcaattagactattgaaataaaatcctacctggaatttaaactcttaactgtctctctgtttctattctcatcctccaatagcctattctatataccatggcagaaggatctttcaaatcactaatccagttttgtcacttcactgcttgaaactttccaggaggcttcccttccttcgtaattaaataaaatttgaaccctgaatgtggcctaaaccctacacattttgcctcaccaacctctgtcaccgcatcgcttaccactaacaccctagctcactgggatttgtgccacaccaaacttcaaacacaccaaacgtatttctgccttatgaactttgaacttgctactccttttcactcccggaacactcctgccccagatctttgctggtgcctttacatctttcaagtctcagtttaaatatcacctcttccaagagacatcctttgactaccatatatcaaatatcccctaagctcattattctttgccattgtactctgttttacttttggaattatttgttttcttgcatgttgtcaatctccctcactgaatctttagcttcataagagcagggaccttacctaacttctttatttcactgctatatccccaacagtataatcttggtcatctcattcccctttctaacccttattttctccattttcaagatgatgacttgggattcggtgcttacaggagactggctcttcacattctttgcatccacagttccaaggaggctttagagctcaatactttccagccagtgacatttctaaatgcattttccaaatgaagtcaatgccctcaggcagcccagtggggaggtcatggagagccagtgagaaggaagtctggtgagttggattacatagttcctttgctacaccattccagccatactaaggagatgcacctcattaggtactaaatgtttagtgactgtcactattaattggtggggattaatactcaaaggagacagtaaatctcatgctgtactcaatgacatcacccccttgcagtcagacaatgcactgggagtttgaatctaaagcactacaaaaaaagaacccagagactatcccttctctgcttataagagtaaatattggttgccaattatatggagcatctcctcagttaccaggatctgtattaaatatcttacatgcttttatcatttcatctttacctcgatcctatggcatagttccaatattatcctcattttatggatggggaaacttccaaatagagagaagaggcaccttccccaaggtcacagagctaataatgatggatcctttgattagggtctgtttcattcagaagcctatgatcttagctactaagtaatattccatttcctataattatcatctcaccatatgattacaattatttttattcaaaccttttccattcttcaagtctgggctcaaatgctactttttttcacaaaactttctctaacccccagaaagacccatactcgccatcagcatcctctgcattggtcatatagaatcaatcacataggggaaggagactcagtaacaaacatttaatagcatatacggtatgcaggcactgccacagtcaaaagcttatgttagtcttacaactaccctgagaaaaatacattcatatctgttttgaaaagtaaaatgccttgagcagagtcttatggctcaaagtggcagaaccagaatttaaacccaggtctgcttgattgcagagcccaaggcatttccacaaactaactatgagctcttcattatgcccttggactaaataattccccctgttataagtcctcatagcaccatgtgcttctttatagcccccaccccagttataatttcatctatgtttgtgtgattaattttaatttccttttttaggccctaactccatgtacaaatgaccatatctctttttgctctacaaaatccccaacacttgacaaatacagtagtcatggaccttatacaagtatatttgaataaatgcacaaaccatgtacatttcattgcatacatttaatacataaatagagcccttccctgctagattctaatttctctgaggcaggttaccaacctaatttatttctggatccctcatgatgttctgcacttcataggaactcaataaacatttactggataaattttgcttatcagtctgtctgtaccatttgaaactctgtaacatccaaggcttctaagtaggccttggatttaattatagaataagatgaccacagaagagttttctaacctaacagatatagatttgaaagccatggggagcatgaaacccatgtcacaaaagtgtatcagtcaaaataagttaagctatgctgctatgataaacacagcagcttaaagaaaaggtttgtttctcacttgcactacacagacattgcaggctgtctgaggtcattgttctacatcatcctaactccaggacctaagctaacagagcatttccagttgccatggcagaaggaaaatggggcaaaggcaaataattcaatagctctcacagcttttactggaggtaatgctgtatcacttcttctcgtatttcactgtctatgtctaccttcaagaaagtgatgaaatgccctcttactccacagcagggagctcatgccaaaatatttgctggatggcactaatgaccaccaccacaacagactgcgtaggagaaaacactgagaaattgaaatgggagaattccctgacaccccttgctgaacgtgagacagggatgtgactcatctgttcagtaaccactgctcctcaaaccccttatgtgaggggagcatgcagacaggtaggttcaggagccagagtaagcacccctgggctccagccccagggcagcattcagggttgagagcctgcaactcccaaagcccaaatgggctgtgttacagtgtactctttcagccttgccattcgcgggcagcttatctgttaaccagctcagtgaattctctgccttttcacaatggcagagggccagtgtgacagctttctgtacccaagctctcgtccaacatcccagaagagtcaggtcacatacagacttgaaggatgaatgtgggggtattattgagtggtggaaattgctctcaatgagacgaatggggagctggaagggggatggagtgggaagatgttcttcccctggagtttggccatccagtagccaatctcctctctgaccatccccagccaaacttctctcagcattcggatggcccttctcttctctctcccacgccattctgccacttgtctactcttctccttgtctgcttctggagcctgcagtctggggtttacatgggtacaggataggggctgtggtgagccaaaaggcagcttttgggcatgaaaacaggaatgcctgtctccatttaggggcatgagtatcctggcttgatagtggggcacttgccagggaaccacccttttctacccagtatttccctatctcctgtccgttctaaatgatccatttagaacctgacctactttccgaaaaaaaaaatacatctccaaggcaatctattgttataaaatcactgaaattgctagagtctttccctagacttttgagcagttgctttctgggtctcaatgtccttatctgtaaaatgggaataaaaatagaatttcagaggggctttgaaaattgtcatgatggccaggtgtagtggctcatgcctgtaatcccagcattttgggaggctgaggtgggtggattgtttgagtccaggagttcaagaccagcctgggcaacatagcaagaccccgtctccactaaaaatacaaaaaattcgtcaggtgtgttggcacacacctgtactgccagctactcaggaggctgaggtgggagaatcacctgagcctgggaggtggaggctgcagtgagccgagatcatgccactgcactccacttcagcctgggcaaccagagtgagaccctgtctcaaaaaaaaaaaaaaaaaagaaagaaaaaagaaaagaaaaagaaaaagaaaaagaaaaatgtaatgatgtacatgaaagcacccatcatagggcctggcacaaacagttgatcactaaatattagccttctaagaaacataatcttcaaatccaagtatgggctttagaaatgtaagaaaatttaattcctccaaatatattaataagtgagagaaaactacgcactcaccctctaaacttgacgttttattttgctgatattgttgattgtctacccgctaaaatgacttgctgcgcacaactacccacatatccctgcaatgcgagtactcaagtaatttgaacagggctaaatatactacattctaaggcaaaaaaaagaaaaaaaaaaagggtggggaaaggaaagcagtggaagaaagctcctaaaacaactggaaactacctgttcctcccaggcagaaccaaccaccccatccaataggctatacaagttaccacagtttttctacccttctgctttatttcctatctccacatccctcctgagcatagggcctggtgcaggatcacagtgttgtacattcctacgttcttttctttgtaactaagtcacaggacaaagagccccaagaaagtggttttgtccagtgatgcacagccttcctgctcctctactgtccacactcgctcaagtgtgcgatccaaggagctgtaaaggaaaaaaatccccaaattaaatattattgtattcccactcctacttatgcctccatacagatgttctacaggcaaggggagaagcacatgttaaagttgtaacgtttctaaatagacgtaccatgtaaatgcctaagagagagaaggctcccacttttttcctccctcctaccatctttgacagtcctcaaggacaagtctcaattccaggacactagccatgcctgttagcagaggggctattaggcaataaaatatcaccacttacatgttcacttctgtcttctctccttttcatgccactggatcataagaatgtagactggtttgcacatcggaaaagacctggctgtctgatcagtttgcttttcttccttcttttctacccctgcagcctaagtggtaaaccggtctgagtaaggtcagtactgcactttagattatgagtgacgtaaaccaagaaagtatcaactaacaaccatagggcactttgattctcaaaatggttttggttctctgtcttactctatcttcatagcaacctgtacttgtttcctaaggctgccatatcaccatgccaaagctggttggcttaaaacaacagaaatttattgtctcatagctctggaggctaacaagtccaagatcaaggcaccagaaaatctggtatctggtaagagcctgtttccctgtttccaaggtcacagatggcaccttctcaatgtgtctccacatgatggacggggcaaggcagctctctttggtctcttttacaagagcactaatcccattcataagggctccactgccatgatgtaatcaccttccaaaggccttccagtatcatcacattaggggttaggaacttaacatataaatttggcaaggacacaaatattcaagcacagcaaaaagtttatatgtatttatctgccccttcctagaactgaccaaagactagagcttggggctagcccactgctctggacatacatgctttcccctcccatctcatgcctcccagagaaactgcagctcctgcatgcttcaagtggaactactctaacaacaaacagctactggagaagcaatgttgccctctcaaatgcaatattcccggactatgtgctaataagttacgtttaagaaaactactacttacccatccactattttctttgcattttttgtctactgtttttgtccacataatcttcttctcgtgataccctcaagagataggcagaacaattattacaggtataccttggacatattgtgggtttggtcctagaccacaataaagtgagtcatacaaattttttggttttccagagttaggtacttgctctagattaggctttggcttaaagaaatgttgtatgtggtttaatgttccatccagaccactcaaacattccccatatcagcagtaagactgtttgctctcttaccactcatgtattcactagagcggcacttttaatgtccttcaagactttttcctttgcattcacaacttggctaactgcttggcaaaagagctctagcttttggtccatctcagcttttacataccttcctcactaagcttaatcatttctagcttttgatttaaagtgagacacacatgattcttcctttcacttgaacagttagagggcattgcagggctattaatgggcctaatttcaatattgttgtgtctcagggaatagggaggatcaaggaggggtggagagatggaggaacagcctgtcagtggagaagccagaacacacacaagatttatcgattaagtttgccgtcttttatggacatggttcgtggcaccccaaaacaattacaatagtaacatcaaagatcaatgatcacagatcactgtaacagatataataataatgaaaaagtcttaaatattgtgaaaatttttcacatttgaaacagacacaaagtgagcacatgctgttggataaatggcaccaatagccttgctttacgcaaggttgccacaaaccttcagtttgtaaaaaatgcaaatctgtgaaaaacaataaagcacaatttttaaaaataagaatcaaaaaagctatgaggaattcacaaatatgcaacacaatttagaaggtggtccagaatcccagaatcttttctccccctaaagaacctccactgccctccgaactgtgacatggcctttgaaatcagggagaatagggtcataaggtttttgaagtggaaggaaattaatcttattaagtagtacagaagggagagtagagaacaaacaattcccaagacacataataaaacattgaacaaccgtcactacctcgaggtgatcagtgttggtgaatattttcacctttccaagcaagagaaatgtgaaatatggataaacttagaaaatgaaaaacataacacctatgaagtccttccaataaaaagtaaagttttatcataattactggctctgaagtaatttggaagccctacaatgacctattctgtgggttaaaaactgccatccatcacaaaactcgtctctaccaaatcaatttctaaaacaatcaatagtaacatactcaaaaaagaatgtctgagaaataataagagccaatgaaactaatcacgtcagagaaaactcaagcatgaccttttgagcaataccatttgttgagctgacactctgcaagataaataacttttaaataaatgaacacaggccaatagtgagaaaaagaactgtatatgagcacaatttcaacacaaagctctagtatggctttcaaagcaatcatgccttcaccagaaacaaaacagcttcaatttaaaggatttatcacaggaatgataaaatcttttgaaatgtcagcactaggtctagaaattatcaaaggaaaagaaaattaaaaataaaaatgaaaaccttgctgacaacagcaaaaaagctatgacaatccaccaccttgtcaaattatctttcttttattggctctctggcatcagtctcccatcctctgaaactcatgcaaatgctgtagcaaacagttaaatattttattcaggtgtatgtttatgtgcctgttttaaaagatatctttacccactaccctccatttatctgtcacagtcttttaccatcaagagcatgcctgttctcagtactatgtaatatttatgagatactcacagtgtgctcaatgcagatatcaactgaaggtctgccatctcactcaaccttcttgacccagaatcccagagaaactgataaataaacaactacagtaacaatatcaacaacaacatcttttaacagatattgagctgttaatttgcaccagcactgtgctaagggctccacgtatagtcttatttcatatgcacaacagatgtgcaatataggtgttctaagtatccccatgttacaatgaagaaaattgagactgagaaatgttagggaacatccccaaggccacacaaccaatgtacgcccagggtctttcctgactcaggggtctccctgactcagatgccttacaaacagcacttaaccaacaggctggatgacttcgctagttcacgtcttctcactgcgtgttgttgaaacagatactgtagtggagtgcgttttcttcatgcagtgtgttgttgacactcatctgaattaatgcatacagtgaaaaggcgttaagaatagttgaaaagtactatggtacaaatgatgatatggcataaatacaatgaaacggaaaaatgtgaaaaggaaaaaagcagattgtaaaacaatacagacaaaagtacaaaataatgttagctagcctttattaagtgtttactatatctcagatattttccaagttattatcctgtattaatatattgactctttataatagctctatttatttacatataccaggtatattagttttctagggctgtggtaacaattcccacaaccttagcagcttaaaccacacaaatttagtatctgttaaatttttattttattttattattaattttttagagacagagtctcgctctgtcactccagttggagtacaatagagtgatcatagctcactgtaatcttgaactcctgaactcaagtgatcctctggtctcagcctcctgagtaactgggactacagatgcacaccaccatgccccactcatttttacattttttgtagagatggggtcttgctatgttgcccagtctagcctcaagtgatcctcctgtcttggcctcccaaagtgcaaggattacaagtgtaagccatcacacttggcctaaaaatttgtatcttacacttagttctatagttcagaattctgaaatggagttcactgggctataatcaaggtgttggcaaggccatattccttcccagaggctctaaggaacaatctgtttctttggcctttccagcttctagccacattccttggctcttgaccatcttcctctatcttcaaagccagcaataacaggccaagacttcctgatgctgccatctctctgattctgtcttccaattccctgttccacttttaaagacccttgtgattacattgggcccacccagataatccaggatactctccctattttatggtcagctgattagcaactttaattctatctgcaaccttaattctcctttaccgtgtaacctaacatattcacaggtttctgggattgggatgtagacatctttagggaccattattctgcctagcagagttgtcttctgatcccaaaagattcacacatgtcccaagccattacaccaggtaattctcattgaattttctctattagagctcctgctatcaaaatacagaaactaaaaaggttcatacagtatgaaataaatcccaaaattaaataataaaatattaacaatatttattggtcagacatggtggttcatgcctgtaacctcagtgctttgggaggtctacacaggaggatcacttgagcccaggagttcaaggccagcctgggccgcatagtgagacttcatctctacaaaaacttaaaaaatagccagatgtggtagcatgctaattgggaagctgaggtgggaggatcgcttgagcctaaactgtttgaagttacagtgagctaaaatcataccactgcactccagtgtgggtgacagagtgagacgtctctaaaaaaaagcaaaaacaatgtttagctctgggtaatagaattatgtgtggtttttgtttctttcttactatgtgatccataattttttttatttattttttttgagatggggtcttgctctactgcccaggctagagtgcagtggtgcaatctcggctcactgcaagctctacctcccaggttcacgccattctcctgcctcagtctcctgagtagctgggactacaggtgcctgccaccacgcccggctaattttttgtattttaagttaagcagagacggggtttcaccatgttagccaggatggtctcgatctcctgacctcgtgatccacccacctcagcctcccaaagtgctgggatcacaggcgtgagccaccgcgcccggccgtgatccataatttttacaacaagcatgaataacttctgcaatcagaaaaagttattttaaaaaataaaatgtgttgaaatgagtgccaataaaagaatgtgcaggatgacagaggggcaacaagggtagcaccaccagctgcactcagatgggaagggaattaaaagctgtcactgagagggagtatgccagatggagaaatgagcaaggagtctgatgggccaatccaaaccaaagaataaagtcaagggctggaggccagttgctcttgtctcctcctcaccatcactcactgcataaggcgtgagttggggatgggcagtttgctcatgataagggactcaggtttggcaaaaaaccgcaaaaggaatctaagaaaaaggaaggacatgggtaaatcgaaaaccaaactcatagacttgtgttgaataaaagaaagaacatagagaaacaagttcaagtcccaccttcacaatttacaactgtgccaacctgggtcagcctagctgcctatctggtctttggtttccataactttaaaatagaaaggagaataatgccctgtgcctcccagagttgttatgaatattaaattacatggtatacttagcaaactataaagaatcatgacggggaaggaaggaggaacctgtggtccataaagcagcagctaaaatgtctcagccaaataaaggtggaaagttgcaggtaggtgcaaggtaggctggcatttgagtagtttatggggatagattatttttaacaacataaacacagaggttccaagaagttaacttgtctcaagttaacaaaaataaatggtagagttggaaccctatggcttcaaagtctgcttttttctctgtctctaatatatgccttgtgaaacaagagattcaaggtgttgagaaagtggcagagcagggattagagtctagatctaccaacaagtataagtgagtgttctctctatgctggacactgttgtaagtactttgtatatagtaacttattaaatcatcccagtatccatggaaggaaattgtccccatttttatagatgagaaaactgatgcattgaaagattcaataaaacccaagatcacacagatagtagatgagcaaatcaagatttgaatccaggcaatatagcaccacaatctgtattcacaatcacaaagccatgttgctcgcgagcaggtatatacacatatattctgcccgactgctctgcaactccttaagcattgtctgcaagcccccacatccattctacagggtcatgtacataacaaatgctcttgaaagatttcttaagttcagaaatggccttcgaatgcagtaatattcagggacatgataaggaatgaggaggaaaaagcagacattctgggtgatgtactagatatggaataccaaagggacaacataaggaaggtgcctagattaagggaccagggactggctggatccacacagaagggggcaggaactctgttgaaagatggctgggagagtaagaggaaaatgaagtaaaaggaaaagaggaggatagggaaatcatttagtaatcatataggagatgagttcctcaagataatatgttgacatagtatctttaagcaaaagaaaatacaaaactgaagaaaaaatcactgctagaaataaagtagaacaggcttggttcctcaaaagacattctgggagaagaaaagttttcaatgaatatgcaaaaacatacaaacaataaaacactccataattctaaccattaacccaatgccccatttccaaacagtcaggcttagttaatagcttttatagtgcatttaattttcaatttgtgagatgtcaatctgggaggctttgttggaaaccaatgaggtgagattactctagcaattacccccaaataatgggtgactgcattcaacaaagctgtaaataaaaaatgcctttcttttcattagagagaatgaacagcagagaaaagagggcatttgggacaacatactggaaaaggtgatcactctaaatatatagtgagctttcatgggacagatttctagaatcctatagaaaaatcccaccaatatacttgtgtttaaaaaaataaaaaggcggcactatttagcttactaaattcagcataaggctcatagatggacagatactatctgtcccactactactcaatgcaaggtctacagtcagatgagcatctaacacaatttggtttgcagagttttcaagaaagcagtgtattttatctgtacagctgcccatttcaactgtcccttctatgctcataggaggaggaaaagaaggcccttggaaattgccattctggaattgaaaacttaaatcctccagacaaccattaacttttaaaggacatctaaaagtgcagctctgtgataaccaagaagatgatggtgatagttctgcctatgactgaatacacaaatctcttaaacctctacagctgctcaacaaaacaaagaaataaacattgcattttgcagagaatccattctatcatgttattcaacaaatttgtattcatctgtgactatgttactgttactgagtatacgcagtcacaatggtgagcaaaaacgaaaacaatttctgccttcatggagttcacagtatagagggaagagaggcattaacgcataatcacaaatcacacaaatgtacaacaaaaactgtgatccatgttaggaatttaaaaggtgtccctgtggaaaaaaaaaaaaaaaaccttgagctgagatctgaaaagtaaatcagaggtgaccagggcaagacaaggggtgatgtgctggataaggagaataaaaatattcctggaacaggggactgtatatgcaaaggtcctgtagcaagagggaccacacaatacagttaaggaactgaaagaaggtgcaggaagcctgaggggctacggatgagctgagatgggagagacaggcatggtcaaaccatgccaagtggaggatttaggttattataaatgcagaagaaagacatttgaagcagaggctgataaagaagttatgatatgaatcagatttacgttttgaaaaatcgctctagctgcccagtggtaaataaattggtggaggcaagcaatatgtcagaactaaagtgatagagattagcgatttctgaacttacatgacatcatatacaaagtatttgggcagagcaatgaatagcagcctcttaatccatgtctggcctgccagggcacagactggttaaaaacacagactgctgaactaggattcctggtttggaatcccaggaatgccactgtgtgcccttgtacaatttatataatctctctgcctcggttttctcactgtaaaacgagaatgataatataggttacaaaatcttcatgaccaaatgtattttgaaattcagaattttttggacttttgaaaggcatgagattacactaaatattctgtaacacccccagcagagtcttgggtaggaccccatattcaaacacattaacattcaaacacattttgaagcaagatgtatgattattaacactatgtggaataaagaccaataagtagacttatgtcaatccagatcaagttttgccatcaaatgagtttgcaccaactttcaagaaaattctgttttttcagaatcttttgaaattcagaactgcaaatgagggactacgcatatgtagtaccttcctcctagggttatgatgaggaataaatgaatcattgtaaacccttgggaaagtgtttggcacatagtaaatagcatttgttaagtaaataaagctcttaggtaccaaactagctagctgcatgaacttaggagttcctactctgtaaatggaaggatgataagatgacctctgaggtccttccagctttcaagttccataagaccccaaagtgtcttgaggaatgtctgtttccaatactttgtggaaaagccagtagaggaccctgagtctattcctaatcagtgttaaaagaaaaacttcagacaaattaactttaccagagtttaattgagcaaagaataatttgagaattgggcagccccctgatccagaatagcttcagagcaatgatgacaccagaccaattgtcccatagcactgatgtttatggtttcttttgaataaacatagaaatggatcctcccaatcttaaaagtggagaaagttagaattgtcttatttgagtttctttctcagaaaaccaaccatcaggactcccagatagtattgaggaactaaaacttaccagacaccacatctggacaatgaaacaccagatctctcacccatcatgattgcctaactgactccctgcttcctgctgaccaattcctcttccttacccctcattaacttatgtttttctgcatgtagttacatttcttccctgctatataaacccctgattttggttggtcagagtgatgaatttgagactgatctcccatctcctcagctgcagcacctcattaaagccttcttctctggcagtactcattgtctcagtgattggctttctatgcagggagcagcaagaactagaccaaactgctggcattttggtaataatggggtggtgggggacacataagggaggtacagaaacagttggactgggtacagcttggcatttgtcttattagaacatgggttgaacagttgacagcctgtgacaggctaaaactctatgattggtacaagagtaggttacagtctgtttacacatctagttaggttacagtgcagtgtgtaaggagaaacctttaggccaaacttaaagtatgtaaggaggccgctttaggctacacttaaattaacaacgggtaatgatgatgctatagccatttgatacctggtcctcccacctcttctgtcccactggacagttcatttacactcagactcgtttctgtatttacctctcctctaataccgtctcaccctctctctcctacacctcagcctgaacagcacccccttcctcatagcacccttaccacagattcagtcatgccctaagctcctaatcactgatacaaatcaccagactcccagaaaaaacaaactcctgagccaacccttgcctgggaaatggaagctgacagctattctcactgtgcttgctttcaaatgtattgggagcatggtcaaactgggcatcaaagagtctagccatatgactttgggagagtcagaaacttaactgctcagaacctcagctcccttatgtgcaacatcagaatgataataatagcaatagaaccttcttcacactgctactgtgagggtcacaccaggtgtaacacaagtaaaagttaccttacaaagtgcagcttattgttattatcaactgttgctgccagacgaggtgtcagagtcccagcatcaggaagtggttggttcatggacaggatagtaagaagaatttaccaacaatcgtataggtttgaagaagaaaattttattagatagaaagaacactgcagaagaatgagtggggtgcctcagcaagagaggaatgagcgcaatgtggtggatttttccttgggaatatttatgaatcttaaagtgggtactttagggtaatttgaaccatattagccatgtaggtcatgaaaaatgattgcatttgtaggcattttggtaccttgatgtcaacaagggttgcacaatgagtttcaatatgcatgcattccggagatgtacagcaattctagttacttatacatttttgggaaagaaacctgcaaccagatgcctgctttagataacagggaagtctaatattctaaattcctcaaataaggagttttgtctctggatggcctgcttgatggccaccaggtgatctttgctttccttggttgccttataattgaaattctttctggaaggaaagatgtcctgataatgaatagtcctcccaggaaaagaaaaatctgcattttcaatgctttatttaaaaaggaaacaagcatttattgacatctttacatatgccaatgcgatctgagagactacacttttatcaattaagacagacactaaggttaaagaaaccaggttacctaccagtagagcgttcagggcctggctggcatggtaaatttctaaatgcccacacatcaactgcctaacaacaggagctatcaggcagatttacaacccagaccactataactgaacacaggaccaagagccagccttacaaacattttctgataagctactgcagaacttagaccagtttcagcagcttacagagactgcacacaaaatgtttttgtgtcctgtagttcactttttgatgtacagagccaaattctacctcattttaatgctaaaaccccaccccaaagtgaacatgggatgtatgttatatatatatttacccgtcaggcatgctcacagctcccgtcataaatatgtgtagcttttccccaaacctgctgaatatgcatgataaagaccctgtgaagcataaaacccaacctgtcctttccctcttcaaagagagagcaccttcagtccatgctagagaccttctcttcctggtttgcaaactgatatcaccaataaaagtctcctttctactatttagccatcctggtggtcttttggaagacaccaggcactattctagatatttttacatgtattatattactcaatcagaaaacttacttttgtggacaatgtcatcatatcatataccttattaaattattatatgtttcttggtctttatttcaaaacaaatacagtttgatgaaagtcagatttattaatcatagattggtagcttagaaataataacaccttaaatcagtacatcacttgacattctataaagggcttggccagtcactgctgagcttgattgtcccaacaagatacaattattagcactgcttgacagagaaggaaactgagggtgagataatggccctgtcagaggcatttgaaccagagtgacttcatcttgaataggagctgggtaaaataaggctgagacctactgagccgcattccccagaggttaggcattctcagtcataggatgagataggagaccggcacaagatataggtcacaaagaccttgctgataaaagaagatgcagtaaaaaagctgaccaaaactcaccaaaaccaagatggcaatgaagtgaccactgatcatcctcactgatcattatatgctaactataatgcgttagcatgctaaaaaacaccctccccagtgccaagacagtttacaaatgccatggaaacatccggaagttaccatatatggtctaaaaggggaagaaaccctcagttctgggtttgcttgcccctttcctggaaaactcatgaataagccacaccttgtttagcatataatcaagaaataactataagtatactcagttgagccacccatactctgcctatggagtaggcattcttttgtttctttacttgtctaataaacttgctttcactcttctgtatggactcaccccaaatactttcttgcacaaggtccaagaaccctctcttgaggtatgggtcaggaccccttttcagtaacagcctgataacaggagaatggcatgaacccgggaggcagaggttacagtggggaactcaggaattgaacccaggtctacagaacgcatgctcttaaccactgtgctctaatcattgtctctgcagtcctgagaaggagtacgcttcagccatattttaatgaacaagtgctaaatttctttgctcagataatttcttcaagctgtgtcatttggaaggaaaataaaacagcatgggacacagcaaaaagtggtgagtttcattaaactgatgtaacaaatggaagcacagaggaagaaacactctaatggtcacttgcaacatgtaaataaaaaagcaaggtttgcaccatggtgcagttctccaccctctctggcaagtcctcctagtaactctgatttatggtatgtaaagttctacagcagaaggaaaatcaactcctgtttaccttgcctcaccatttcccttcccatctcagaaggtactgtgcaaagccactgtgcagacttaatagtttcttccgcatttcaagatgctttttctcactgcttttttgctttttttttctgcaatgagacagagaagcaattacctctccatctgctcatcttgatacctatgcttcactgggctagaaagaagaggaaatgagaatgggaaatctaaaaccaaaggcctagagcctgaagaagatgtacaaagtttttaattcaatgagatttgcatgtaaatctgcagttcaagtttccatcctactccacttctaagaaaaacctaattgcatctgactaaggcaagacaaacagaaccgtatttttaaaaataatacttttaaggttcagagaatctactataactctatcttgcatttctacagtgatttacgctgaacaaagcattcacatacattatctcatttatttattaaagcagtgctaattccttaagcaatcatttgaacttgaaatttaaaaggatttggcagaaaaaaaaaattatcattttgagtgcctatggagtgctagccattgtactgagtgatttgcattcattatctccaatccttacaacaacccagcaaggcaggaacatcagccctggtcccagcagagtttaaagtcatccaacaaggattgctatagtaacctgaggctagcaacagctctgagaactcagaaagggtagcaaatggcaacaccaactatggctttccatggagtgaggaaccaacccttgtgatatgacaggggaaaaaatgaggggaacagatactcttaactcactgctcacccgctgtctgatctactgcttctgcctcccttcctgctccattgtctaaacacaattggaaccagagcacaagggatcccactgacgaaacccaacagaatgagcctcctggggcataaagcagggtagggaagggtgaaaagtggatctggaagggaaacagaagacattcagcacagtccatccctcccccagcaacactcccccaggaaccctcccccatcatttactgttatttttaattcaaaaattgcaaaaatgccaaaacaggatgaaatgatatcagttcagtcaacttcccaacagaaacccaaaacatgagcaaccaccaaaagatggttttcataaaacgatcttttttcatgaaaatatgagagtaaaaagtgaggagataactagttaacataaaatttaactgttatatttctgaaaccaaccaaattgtctcatagaatgatgtttatggttcttgaataaacatagaaattggccctcctggtattaaagcttgaaacttacatttgtcttatccgacaaactttcctttctcaggaaatcgaccctcaggcttcccagatagtatcaaggaaactgaaactcaccagatcggtgagatgccagacccattattcctcctgactgcttccttactctttcttaatttctgttttctaaattccttcctgctatatacacccccaaccccattttagctggttagaaagaacagagttgaggcttggctgccatcttcccggccgatgtcacctgcaatataacaaagccttatcccctggcaaaactcattgtttcagtgattggctttctgagcagtcaatgacaggacctagaccgaacacctggcatttccataacagttcctgtggcttcgcatacgagcataagacctaaggtgatgagcatagcagccagccttcttccaccactattccttgtttgccctatcctctgcccatttctcaactggatggtgttccttactgaaaaattaaccacagtcttgatttatgaagggcctgaattcgttaggggataacctcattatcccctggtaatcaggaccagtcacctcactgaatgcagtgaccccttttctatacaatggtccagctacataaggagctcagaatggccagaggcagcttcagcttccaattcactaggaccatgactcttttagaagtagtctttctttgggcattagcatctccagaacattaagcagaagtacttccaatgggttatttggtgtatcagtaagacaggccactctcatctccacccttggttcccatacctgggcattctggctataagggatgacactatattctagccattggttttgaggcatatataccatatcatgaaggagagcactccaaatttgtagaacgttgccttcccaccatcttcataactgagcctttggcaggccatcccactattctgttaagtagctgcttctagatgatgttgcacatgataatgccaatgaattccatcaggctaacttgactatgtcataccttttgcaagaaaaactgaccccaagtcataagcaatattgggacagataaggcattctgtacaggaggcaattgagcaagctctggggcatccccagaatgggcagctcatccacctggttatggagagcctcatccactctgggtgctctctatggacattaacacagtacacaaatatccgtgctcaatcaaagaaatccattcatatacttttctcccagaattctgatgtcctgcaggtgcccagccctactcaagagagtggggagttttgggtccaaactcaacctgaaaccaattgtcaagagagccctttggtgtcattcataggtcatccccccagagcacagaacaaggtagagaggataaagactgtaaccagagggcaaagatattcagctctgtagatattattgtcccttttttcagataaagaaactaagagtccaaaaagcaaaaatatcttgcctgaagtcacacagctggaagaggaagctgaggttaaaatcttccattctaaaacttgtgttcttccctaggccattagcaccacatggaggaagagaaagcctctgggcttcctgccaggcagaattaggttcatctgagatgcaaaccaattaccagcttaaaacattttcttacattgataagtgaaatccaaagttccctcctgtggtcattaaaattaaaacttaaagattatgatgagcaaggaattcaaagagctttattagcttgctcagtggaatgtgttcttaaagatggcttcacccccaatcctgagccaccacaatcacaacctccagaaagagcaatctgtctaatagaaatataatgtgagccacattatcaaagtttcaaaaatttacattttaaatttgagccacattttaaaaagtaaaaaacaatgatagtaattttaataatatactttaacacaatatgttcaaaatattatttcaacatgtaatcaatataaaaatgtttgtggggttttttacattatttatttcatactaagtcttcaaaattcagtgtgtattttgtacttacagcacatctcaattcaaacttgccacatgtcaaacgttcaatagctgcatattgctgatgcctacgtattgagcagcatggttctagagatgagaaggccttccacctgctggctgtgtgtcttctcaacatctcagatgccacatcttgaaaatagggatcatagtactcttgggactaaaacaaataagaagaagaagaagaagaaataataataacatgaataggtaatatttatttatttgtcatgtgacaggcatgctaaattttagagaacttacagaacttaattcttataacaaactacaacgaaaaatggacacttaaaatgattaagtgtcttgccccaggtcacaactaagataacaatttgagcactgacaatctgactacagggcctgaacccttttatgaaaataacaataataataacaataatagctacaaatattatatttaaatacccaggaagttgatagaatcagcaagaccaacagcaaggcctcagcagggccaaccgtgcatgataaatggagccattgttatgacactgtcctcaagagcttagaatgttgtagggagaaagaacacataggatgagataactagtcacagaaggctgtttatggcatgtaacaggcaaacaaaagtgagctctacacaaatccatgggggcagtgatccgtgtagggtcttagggccctgcaagggagagatgaaatacaacagcaaatgcaagtaggtcccacttcgaggtcatgtgtgacttgtgcaatcacttagggccctgtgctcagaagagtgccacacttggttaaatattcagctgtcatggtcctgaaattcttaataattttatcactgaacttatattttttaagtgaagtctgctgggacaatggagaatgttcatgagcagaggagatacaggtaacatgcaatctatgtgccctcttccatttcttgctacctatttgcatacagcattcatgatgccccatgagcacatgtgtgggagtttactgagatttaaagggagtgtgaggtgagtgtgttatgaatataacttgagaactaagctctgattttttatctggcccaaattcctacctaaggggtctagggggtcatgctctataaaccataaattctgatcagatgggttttattctatatatcatgacttacttttcaatctgactctggaataccattatgagataaggaaaaatatataaccccaaaatatattttcttgccacactttgaaattaccctgaaaagtctcttgtgggaaaaatccacatcctatagagaatcccctttcccctttgttttccttacttccttttcagatccaggagataatcaactaagagccagatacgcttttagctctgataagaaacatacaacctgctctctctgaagtctgctatctgagaaattcctctgcacaataaaacttagtctccacaatcctttatcttaacctgaacattcctttccattgatcccaggtcttcagataaactcaacgaattatgacccagaaaatgtttaaatttactgatagtctgggagctcccactttgagttgtcccacctttctgaacccaaccaatgtatttcttaaatgtatttgattgatgtctcatgcctccctaaaatacataaaaccaagctgtaccccaaccaccttgggtacatgttctcaggaccttctgaaggctgtttcacaggcatggtcactcaaatttggctcagaatcaatctcttaaaatattatacagtgtttgactcttttcatcaacaaacggagtaagaggacagcaccgtgagaagccacaacgtctctttgaaccagaaattgcttcaatcacagcatgaagtcattctttctaagagacacaccattctaagaaacatgaacaaccaatgaaattcatcatatcctttcttaattatgctactttattaactaaccactcatgctgaaaacgatgacatagaagaaaagggaaagatagggcaactcatatttattttcctttcagtcctttctttttcttttttctttttttttaggcagagtctcactctgctgcccaggctggagtgcagtggcgccatcttggctcactgcaagctccacctcctgggttcaggccattctcctgcctcagcctcctgagtagctgggactacaggtgcctgctaccacgcctaattttttgcatatttagtagagacggggtttcaccatgttggtcaggatggtctcaatctcttgacctcatgatccacccacctcggcctcccaaagtgctgggattacagaagtgacccaccgtgcctggcctcctttcagtactttcttactcaacagtaagcttaaggcagagatattggtagactgtgtgcatatcaagaagaagaagaataagttgatttagctttgtgtagtattttcactgttctggtaggaataatacatatatatttgtatatatatatgtaagctatgaaaaacaagttgagtaattttggtgattctacatacaagcttaaaactacatacttgcatttaaaactggcattaggaggtgcttccacgatggctgaataggaacagctccagtctgcagctcccagcgagatcgacacagaagacaggtgatttctgcatttccaactgaggaacctggttcatctcattgagactggatggacagtgggtgcagcccacagagggcgagccaaagcagggtggggcatcgcctcacctgaaacaccagggattgagggatttccccttcctagccaagagaagccatgagagactgtaacaggaggaacagtacactcctgcccaaatactgcacctttcccatggtctttgcaaccagcagaccaggagattccctatggtgcctggctcagcaggtcccatgcccacagagcccagcaagcttaagatccactggcttgaaattctcactgctagcgcaggagtctgagacgacctgggatgctggagcttagtggggggaggggcatccgccattgctgaggcttgagtaggcgtttttatgctcacagtgtaaacaaagctgccaggaagctcaaactgggtggagcccaccacagctcagcaaggctgactgcctctctagattccatctctgtgggaagggcatatgtgaacaaaaggcagcagcctctgtcagggacttagagaaaaacccctcatctccctgggacagagcacctgagggaaggggcagctgtgggcacagcttctgcagacttaaacatccctgcctcacagctctgaagagcagtggttctcccagcatggcattggagctcttataatgaacagactgccttgtcaagtgggtccctgacccctgtgtacctgactgagagatacctcccagtaggggccgacagacacctcatacaagagagcactgcttggcatctggcaggtgcccctctaagacaaattttccagagtaaggatcaggcagcaatatttgctgttctgcagcctcctttagtgatacccaggaaaacagggtctggagtggacctccagcaaactccaacagacctgcagctaagtggcctgactgtcagaaggaaaactaacgaatacaaggggcctgactgttagaaggaaaactaacaaatagaaaggaatagcatcaacatcaacaaaaaggacatccacaccaaaaccccatctgtaggtcaccaacatcaaagaccaaaagtagataaaaccaaaaagatgaggagaaaccagagcagaaagcctgaaaattccaaaaaccaaaacgccccttctcctcctgagggtcacaactcctcaccagcaagggaacaaaactggatagagaatgagtttgacaagttgacagaagtaggcttcagaaggtggataatcacaaacttatcagagctaaaggagcatgttctaaaccatctcaaggaagctaaaaaccttgaaaacaggttaaaggaatggctaactagaataaccagcgtagagtagaacataaatgacctgttggagctgaaaaacacagcacgagaacttcatgaagcatacagaaacttcaatagctgattcgatcaagcagaacaaaggatatcagtgattgaaggtcaaattgatgaaatgaagtgagaagacaagattagagaaaaaaagagtgaagagaaatgaacaaagcctccaagaaatatgggactatgtgaaaagaccaaacctacgtttgactggtgtacctgaaagggatggggagaatggaaccaagttagaaaacagtcttcaagatattattcaggagaacttccccaacatagcaagggaggccaacattcaaattcaggaaatatagagaacaccacaaagatattcctcgagaagagcaacccaaagagacaaaaccatccgactcaccaaggtttaaatgaaggaaaaaatgttaacggcagccagagagaaacgttgggttacccacaaagggcagcccatcagactaacagcggatctctctgcagaaaccctataagccagaagagagtggaagccaatattcaacattcttaaagaaaagaattttcaacccagaatttcatatccagccaaactaagattcataagcaaaggagaaataagatcctttacagagaagcaaatgctgagagattttgtcaccatcaggcctgccttacaagagctcctaaaggaagcgctaaacatggaaaggaataactggtaccagccactgcaaaaacatgccaaactgtaaagaccatcaactctatgaagaaactgcatcaaccaacaggcaaaataaccagctagcatcataatgacaggatcagattcacacataacaatactaaccttaaatgtaaatgggctaaatgctgcaattaaaagacacagactggcaaattggataaagagtcaagacccattggtgtgcagtattcaggagacccatctcacatgcaaagacacatataggctcaaaataaacgtatgggggaagatctaccaagcaaatggaaagcaaaaacaaaaagcaggggttgcaatcctagtctctgagaaaacacactttaaaccaacaaagatcaagagagactaagaaggccattatataatggtaaagggatcaattcaacaagaagagctaactatcctaaatatacatgcacccaatacaggagcacccagattcataaagcaaggtctcaaagacctgaagagggacttagactcctacacaataataatgggagactgtaacaatccactgtcaatattagacagatcaaggagacagaaaattaacaaggatatccaggacttgaaatcagctctggaccatgcggacctaatagacatctaccaaactctccaccccaaatcaacagaatatacattcttctcagcaccacatcacacttattctaaaattgaccacataattggaagtaaaacactcctcagcaaatgtaaaagaacagaaatcacaacaaacagtctctcagaccacagtgcaatcaaattagaactctggattaagaaactcactcaaaactgcatgactacatggaaactgatcaacctgctcctcaatgactactggataaataacaaaatgaaggcagaaataaagatattctttgaaaccaatgagaacaaagacatgacgtaccagaatctctgtgacacatttaaagcagtgtgtagagggaaatttatagcactaaatgcccacaagagaaagcaggaaagatctaaaatcaacaccataacatcacaattagaagaactagagaagcaagagcaaacaaattcaaaagctagcagaaggcaagaaataactaagctcagagcaggactaaaggagaaagagacacaaaaaaacccttcaaaaaatcaatgaatacaggagctggttttttggaaagatcaacaaaatagataaaccactagcaagactaataaagaagaaaagagaagaatcaaatagacccaataaaaaatgataaaggggatattaccaccgatcccatggaaatacaaactaccatcagagaatagtataaacacctctatgcaaataaattagaaaatctagaagaaattgataaagtcctggatacagacacccacccaagactaaaccaggaagaaattcaatctctgaatagaccaatgacctgaaatgctctgaaattgaggcaataattaatatcctaccaaccagaaaaagtccaggaccagatggattcagaaccaaattccaccagacgtacaaaaaggagcagataccattccttctgaaactattccaatgaatagaaaaagagggaatcctccctaactcattttatgaggccagcatcatcctgataccaaagcctggcagagacacaacaaaaaaaagggaattttaggccaatatccctgatgaacatcaatgtgaaaatcctcaataaaatactggcaaactgaatccagcagcacatcaaaaagcttatccaccaccaagtcggcttcatccctgggatgcaaggctggttcaacatacataagtcaataaacataatccatcacataaacagaaccaacgacaaaaaccacatgattatctcaatagatacaaaagaggacttgacaaaattcaacagcccttcatgctaaaaactctcaataaactaggtattgatggaacgtatctcaaaataataagttatttatgataaacccacagacaatatcacaccaaatgggcaaaaactgaaagcattcccttggaaaactggcacaagacaaagatgccctctctcaccactcctattcaacatagtattagaagttctggccagggcaattaggcaagagaaagaaaaaaagggtattcaattaggaaaagaggaagtcaaattgtctctgtttgcagatgacatgtttatatatttagaaaaccccatcatctcagcccaaaatctccgtaagctgatgagtaacttcagcaaagtctcaggatacaaaatcaataggcaaaaatcacaggcattcctacataccaataacagacaaacagagacaaatcatgagtgaactcccattcacaattgctacaaacagaataaaatacctaggaatccaacttacaaggaatgtgaaggaccccttcaaggagaactacaaaccactgctcaatgaaataaaagaggacacaaacaaatggaaaaacattccatgctcatggatagaaagaattaatatcatgaaaatggccatactgcctaaagtaatttatagattcaatgctatccccatcatgctagcactgactttcttcacagaattggaagtaaagctactttaaatttcacatggaaccaaaaaacagcccacattgccaagacaatcctaagcaaaaagaacaaagctggaggcatcatgctacctgactttaaactatactacaaggctgcagtaaccaaaacagcatggtactggtaccaaaacagatatatagaccaatggaacagaacagaggcctcaaaaataacaccacacatctacaaccatctatctttgacaaacctgacaaaaacaagcaatggggaaaggattccctatttaataaatggtgctggtgggaaaactggctaggcatatgtagaaagctgaaactggatcccttccttaacaccttatacaaaaattaactgaacatggattaaaaacttaaatgtaagacctaaaaccatgaaaaccctagaagaaaacctaggcaataccattcaggacataggcatgggcaaagacttcatgaatacaataccaaaagcaatggcaacaaaagccaaaatagacaagttggatctaattaagttaaagagcttctgcacagcaaatgaaactaccatcagagtgaacaggcaacctacacaatgggagaaaatttttgcaatctatccatctgacaaagcactaatatccagaatctacaaagaacttaaacaaatttacaagaaaaaaacaaaaaaccccatcaaaaagcgggtgaaggatatgaacagatacttctcaaaagaagacactggccgggcgtggtggctcacgcctgtaatcccagcactttgggagaccgaggcgggcggatcaggaggtcaggagatccagaccatcctggctaacatggtgaaaccccatctctgcttaacttagaatacaaaaaattagacaggtgtggtggcgggcacctgtagtcccagctactcgggaggctgaggcaggagaatggcgtgaacccgagaggcagagcttgcagtgagccgagatcgtgccactgcactccagcctgggcaacagagcgagactccatctcaaaaaagaaaaaaaaagaagacatttatgcagccaacagacatatgaaaaaatgctcatcatcactggtcattagagaagtgcaaatcaaaaccacactgagataccatctcacaccagttagaatggtgatcgttaaaaagtcaggaaacaacagacgctggagaggatgtggagaaacaggaatgcttttacactgttggtgggagtgtaaattagtttaaccattgtgcaagacagtgtggcaattcctcaaggatctagaactagaaataccatttgacccagcaatcccattactgggtatatacccaaaggattataaatcatgctactataaagacacatgcacacgtatgtttattgtggcactattcacaacagaaaagacttggaaccaacccaaatgtccatcaataatagactggataaagaaaatgtggcacatacacaccatggaatactatgcagccatgaaaaagaacaagttcatgtcctttgcagggacatggatgaagctggaaaccatcattctcagcaaactatcacaaggacagaaaaacaaacactgcatgttctcactcataagtgggagttcaacaatgagagcacatggacacagggaggggaacatcacacaccagggcctgtcatcgggttgggggctgggggagggatagcattaggagaaatacctaatgtaaatgtcgagttcatgggtgccgcaaaccaacatggcacatgtacacatatgtaacaaacctgcacgttgtgcacatgcaccccagaacttaaagtataataaaaaaaaactggcattaaactatataagatgaatagtaaaattcatgctaataatttaaatttaaatttttatttattaacaatactaaatagtaagtaaaaagaccatgctaagtcaagagaaagagaccatggaagaaagaaaaaagcttgatattttagtccttttcatggcatttttttcttgcttttaaacaagagggcccatattttcactttgcactgggactcacaaattatgtagccagccctgttggcaagagcgcagcttcccctctcctatgctaatagcagacactactgattgcatatggtactgttccccactgagccgaaatatgacctcaaaatctttttgaaagcagggttcaaaagtgcaatctgagcaggcatacaagctgaatctatgggcatccctcaaaatcaaactatgcagatggaaatggggctggctttccagacaatgaaaatactggctggtgtgttaccagagtaatgagtaggccaagcttgctaaactcaaactatccactacctgtgaacgtatcatcccagttccaaatgtaaaacaacataacaaaaatcagcttgacaaacaagataattagacttaactttgatcatgtgtttcattagttacagaaacggcccacaatttagagttctttctgattatgttagagtaggagcctctaaaaaaatgaataatgcaataaatggatcaatatttatatggtgctaattatatgccaggtgctatttttaaatgatttgcatacattaactcatttaatccatgtaacaggcccagtgtggtagctcccacctataatcccagcactttgggaggccacagcaggagaatcacttgaggccaagagttcaagtccaagaatttgagtccatcctgggcaacacagtgagacccccatctctaaaaaaaaaaatcaaaaaaagttttaaaaatccatacaacaacctatgaagtaggtactgtggttatctcatttttataggtgaaaaaactgggacagagaggggtttaataactacctcaaggtcatcatctaatcaataacagagccaggtagtgtggatttaaagtttatactcttaaaatctcttgaagaagtcgctgcagaaggtgtccatcacagacttggcaatgttttgctaaagatgttttctcgggaagctctcggttttctctgggttttttcctcctcctatgtgacattgtttgtcatctgtacctcagagcagttctgcgtgagtcgcctcacagtccctgatgagcaatttcacccattttagcccttcccacactaaccgcgaattcaagatcagcccaagaagtaacaacatccatgtcatcagctcagccagccaaaataccctgtattccagcttctgtaaatattattagctaacacctcgcttcaatccttgaaaccacacaccagaatcttagagttggaagggtttttggaaatcatctaatacagggataataaaaaggtttacctcacatgcccattttgatctgatcgattggtagtagatgcctggagtgacatgagaagggttttgataccatttggagtttactgaaataaggtacatgcctgacatgtacctgagagagcagcagaagctcatatgctgtcctagcagtacagtgtagctcttaggaatatgggctctggggttagatttcctaggatcaaagtcttgcttcactgtttgctgatagaaacttgcttaagtttgcactaaatctatctaagttctcttgtttgtgaaatgaggctgatgaaatctacctgataggttggttgtgataatttagtgaaataatatatggaaagtacttattggaatatctagtatgccctaagtactcaacatgctgttaacacatattgatcttaagcaacttgtcgtatctggcatgggtcctggaggtgacagtggcagtaacagtgccatttatatgccatttctgatctagtcctatcttttaaacctacagatggagaagctgaagctgcagaaactgtggggctttcccaaaatcacatatattgtctccttcaaaactaaaggcactcaggaaacataataatcttcttgccctggctctgcctctccctgcgtgcaacctcaggcaaagcactgctctctggacttcggtgtccttatctgtataataaatgagtcagaatccaaatgatcttcacagagtagtcactcccagagggtcctgtatttccagggggtgaggaacacttttacccgtagttcactggacgttacaaacagcaattctttacttccagttttgacagtttcagtgttaactaatcactccagtattccttgcacaaatgcacacgtacattccatttgctttgatctcaaacttaagttttttatgaatgaaggctacagctggacaccaaaagattataccattaatttttaagtatgcctcagagggtctaatgggctatgacccacaatggtcatatcagcggcattccacttcctcttgagccactggccaagctggtattgaggtgcatgtcccagtttatctccagccctcctaatctcagactttctgcacctatgctaatacttgaaccaactcttcttttttttaattgaatccaatgcaatgtacctgggaaccctgcttcaaaatctgatgccaaatctaaaacactggacaaaatccaggtttttattcattttctgatgggcactagctgctaattaagcatccaaacaatgttctaaaaaggaagaaaaatcataaaatatggacttaacattaatcacacagacatacatgtaatatacgttacctttatagcaggaaccaataaaagaatacaatataaaacacatatttgtactagataattttgtataaatattttaaaggtttcttagctcagggattagagcactggttttataaaagagcaggtcacatattcaaatttcacgaagactttcctgatgtctttcaaagaagtataacacacatattaagaatctggactcaggagccacattatctgaattcaaatcttgactttctcacttcctagctggtgaccatgagcaagtcattaaataaattttcttacctcagtttgctcaactgaaaaatgggaataatgatgatctggtaagaattgtttaaaggactcaatacacattaagcgtttagcccagtgactgcccaggtttcaagacaaaggtgaattcaagcctcttgacataatgacctcacttttcaacttatgtattgcctcctattttacagataaagaaactaaagttcagagaagagctgttgcctaaagtaacgttcactgagcaggtcaggacaggacactacttagtagcaaagccaggaccagaacccaatttttctaaacctcagagcactactttcctcaaatcagtgttccttctgcctcatctagggtagatacagatatccatcctctttcttcactgcctgcttctactcagatgggcttcctgagagcaagatccctgtcatattctcattggctggcaccgttcctagcatatagtaaactttattatctaattgagttgaattcattcatcagctctttacattatacacctaacttcttttagatgttgccaataagctgattgtcagttatttaggtcttaaggagacagtccagtagagtggtttagaaaaaaaggctccacagctgggctgtatgggctcaaagagtacttctgccacttcctaattaatttgaccatggccaggttacttcacctcagcttcttcagttataaaatgggacaataacacctctgtcatagggttatgagtgataacttggaataatatgcaatggtcaattgtatgtgtggacttgactagcctataatctcggttactcaatccaacacaactaggtgcagccacaaaagtattttgtagatgtgtttaacatctacaatcaggaactctgactgataaagtatgtaaagctcatacctggtccatcatacttaatgaatgttaactgccaatagtgttagtgatatttccattgttgttgaacacatactgaaagccttaacacaataactttaagtgtaagggtataagtctttgcctacagttctccagaagggattatgcctgcaacttactttcaaacaagtagtttggaattgtgtatagatagatattgatcaagcacatatgggaaaatattaacatttggggattctgatgacaggatatatgggaattctttgaactacttttaaaactttttatgtctgaaatcattattttaaaaaagttagcctgggcatggtgactcacacctgtaatcccagcattttgggagcccaaggtgggcagatcgcttgagctcaggcgtttgagaccagcctaggccacacagtaaaaccccatctctacaaaaagtacaaaaaaaatagctgggcatggtgatgcaccctgtggtcccagctactcgagaggctgaattgggagaatcgcttgagcctgggaggtcgaggctgcaatgagccgtgttcatgccactgcacttcatcctgggcaacagagtgagacccaccctgtttcaaaaattaagtaattaattaatttaattaaaagttaaaattttaaaatcaatagaattaaattatatttaaaatgttccaacagatttactctggcaacaaccaaaggtctgagacaaggattgctgatgtggagtgaaagagattagtcaaaatgcctattgtaaacattttaaaattattaatctatttaataaacaactcaattacccatattttaattgtgcaatattacctctatgaactattaatgaatagacattttaaaaagagagaaagagagattacatcctgtttgggggagattagagagagaatgggtatgatttcactaggaaaaaatgaaagatggaaaaggagggtctctcaggcaatcaaaacaggctaagttaagtcaatctattttagatgatgaaatctatgtctgtttaaactctttttctgtgtaataagtgcccagcagataaacgaccagagtggtgcactgcctgacagaggttcatatttaaaagttcctcctccaagcacagtgctaagaaatttatttagaaaatatctaaatgtctcctgggtctagaacattagagacaatggcaggccctccggctagatcaaagtgcaccccgtggataaacatgcccagactgaaaaggatgaaatcctgggccatctgctgggatgcagctgtgttctaacacctcacttttgattaagagatcgcaaactgacttgttaatattgtaattcaaactttgttggcggctacacaattggaacctcacggacagtctgcctaccctttaaacatgacatttgagttaataccctgtcctttttccaagacacacgttactaaaaatcactggaacctgaaggcagcaaaagttcagcaatcaaaccctgaatcctgatcaccacccttcaatgcccattgtgaggagctctagttaagctgatgaggatgtgtcagcaaaccagagctcatcaccagggtgcctatcggctgcaccccagcgtgactatgaaacacccagaagaagcaaagaaaagtctatgtgtcttgttactttatctaattcccccaatattctgctaccactatcgtccatttgcaacttgttccaaggaaagcacattccatccaaaattagggtcttatagaagaacttatacctctggcttattttaaaacatatatttgaaagcctacaaaatatgtaatgccttattagacactgtacaaagatatatgtgacatcatgcctatcctcagagaatttatattctgtgggagagataaaacataaatattaatcagatacaaatacaaatacaaatatgacatcatcgttggcacacaggcatgtcaaaaaaaaaaaaaaagagcttagaaatggactttgtaggattaaggtgttcaccaaatgttatcgtgtttctctgagtggtcggtttggggatgcttcttgcctttttctctgtactttatgatgtctttcaattttacagtaagtatgaatcatttttacaaaaacaatgatgtttatttcaagatggaataggaaagaaaaatgggttcatggaggaaatgacactttttaaatagatataattcagaggagtaataatgaatttgctggttatctgacccccactctaattcctttggaagtcattaaatgaagaaaggcatctcttccatgagcctgggcaaattcacaactccctgcttcttgctcctaattattctgccagtcaagtccaggaaaaatgcaagtggcataaaagccaagggtctttgcaaccactggacccaatagattgactatacaggaggctactcaggagtagatgttttgagaaatgttgtaatttcccaaaatgtcaataacaagtacagctcatggttctgacctgcctgtgagttttcctccactcagcagtcatagcagccaatggaatgatgtggaaataattcacctctgctctagagaatctgcttgagaaattacatacaacaaaactttcccagacacaggatacctgaagaaaattacttgattagtaagaaccaaagcatttccagaaccaaggcaaggagctaaagtagacagaacacaggacaaagaaactcaagacttaagtttcttcctgactttcacacttagcacaaagtgtgatctttgatccatagaactgctcttgagtttattagcaatattactttgtaaattgggaagatagtaccttatccttaatactataaagggttattttaaagattggtaaataataatgttctttgtatcttgcaaaagggtatgattaaaattcctagagtttagaaaaacattgtgtggttatcttgtttaaagatgaggagaggaccattatccctcagaagtgccaattttacgtctttcccagttttcaacataacaggtcaagtttcaaacagaccatcttgaatcttccagtgactacaagtcaatgaaatatcagctttacagtatgtgtcttgattcatttattcaggaaatagatgatgtctatctactctatgcatattaaaatagaagacccatcctatattacagactcagagacagattaggggtgggccaaccattcaggtaatcagggccccatcaaataggggaagctaaaaaaatggctcttgggatactaaattgtattttaaatgtaatgagatgaagaacatgtgtttcccagtacttcaagtagggataaaatatatgtggctgggaacaattacttaataaactgctttgggtgctctgtgagtccccagaaaggcaagtccaagatgacgccttctaagaagggtggatgtgaagagcctagagttttggttttgctgaggggagaatataaatttggggaccagagcttagacaatagaggtgaggttgagagcttccaccagtgatgatctttcttcatctttaccccatagagtgctcaaattcacctctaaatgaactattaagtacatctcttcaaagagccatcaaattattagcctgcaagagatacccacatgtcttgttaaattgtgaatagtcccttttgtcactcatagtcagtcttaaagtattgagaaacataattaaaacaaaagttcattctcccagtcattcaataatttccatatcccttctccttcacctagaccaccctggccagaactgatgtcatatataaatgctacagagacttagtattttttgttctactttgtccttctcttttacctaaagaactacaaacatgagacatgcagttgttttaatataaagcccaaaagtggacaaaaatattgctttcttgacattatactatacacctttcctacaaaaatagacaatactcccatgatttgatattgttatcaatcattcctttcctcttctgcctctcaaaaaaaaagaacaaatactcaaaccacctagtctagcatgaaaagtgtataaaactgaaatttgcaaatatctgaagtgaaactcagtcctgagaagcaatctatgcatcccctggtgcaagttaaagccaattgcctccaacaagatccacaacacaataaggctggggttctaaacacagagaacacagaaacaagggccattaaacaacctggctgttaggcaaaatatacattacccaaaccatgataactaaaccactaaaacaatagccctgcagtgtttatacacttagaatcagaaaaaaaaaaaaaacagaattattgtcattaaactggggtaaactaaaacatctaacaaagaataaaagaatccccatcccacatttattattttagtttcttctccaaattatttcagtcctttgtgcccttggaaagtcacttcacctctccgggacttattttcctctgtgaaattaagaggttgggttagataatatttacaatattggacagctgtgtactacaacactagggaattagaagacctggtgtctcatgcccgatctgtcatgaaatgttaggcaagtcatttaacctttcctgagtaccagaattcctcatctattaaatagagacaaaatcacctgctctgcttatcttacagggatgaagataatcagattgcaagtggttagagaactgtaaatgtcatacagttataatgaactagaagtatggtatggtttggctgtgtcaccacccaaatctcatcttgaattttagctcccataataccctcatattgtgggagggatccagtggaagataattgaatcatgagggcggtttcccccatactgttctcatggtagtgaataagtctcatgaaatctgacggttttataaggggaaacccctttcacttggctgtcatttctgtcttgtctgctgccacataagacatgcctcttgccttccaccatgattatgaggcctcctcagccatgtggaactgtgaatccattaaacctctttttctctataaattacccagtcttgggtatgtctttatcagtagcgtgaaaacagactaatacaaagtactatcatcattttaacttcccaaaaaacatctaatagaaaagatcttttccccactttagtttccaaagagcgatcactaaataatgattctatggcgctgagcaactttggagcgaatggctgataaaggtactggaaagccaacgtggggtagtgagaatcagaagacaagtcctgacacagactctgtgtgtgacctcagccaaggtatttaatctgattgcctcagctttctgatctcgcagacatggagctgggcaagttataataccagacatctactgaatagttaccatgcagcatgccttctttcaattacacctcaaaatagccatatgacataggtaagatgaccattcccatcttgcaggtggagtgtctggcactgcacaggtatgtaacttgctgagggtcacctaaagctcagtaaaaggcagtcagtctaacttcaatgtccatcttcttgacctctagccagtagttctcaaactttttggtctgaggattcttaaaaattaaactatatttttccaaaaagtaaaatagtaagaagaatcacattgttttaaagttttagaagtctctttaatgtctggcttcatagaagacagtaggagaaatggccattacttccccaccacagcccccaatagcaatcaaacaaaatattatataatcaaattgaaaggaaactggaaaaaaataattacaattaaaacagcaccattttaatatttatctaataagcatcttaagtttctaaattagaaggtcaccatatttagtgaatgaaatgtaataataatcatgagattctaaactgcattttatacttcagtgataatctcagataaatcagccattcccagcaattactgatattttatttttgttaacagcctgaaaaagtttttgaagagaaattaatgattgagagcttgatttgaaaaaaaaatgcacactcctatttgattctaagaaggtgtaatacaatttttcctaagcagaagtatggactaaggaagaaaatgataacctgtgtaggctgatacgtcagtgagatgtatactttgactcctactgagaagatggggatccaggtagcctctgaactcaggtgagtgttctctttggacacctctgatttacttccatgatttccttccttaaacctgtgccagaccactccttcttccatctattccttccactctccatactcaggtaagaccagtctgctttttacaatgccctgatattgacattcaaccttaggaaataggcaaaaatcatattctgaatttctttcactgcttggtccaccaggtaaacatcacctcacactgagacaatatatatttgcccaaaaaatgttttgtgaacaactattatgcacctttatcttctccatgtctttatgcaaacatcatcttagcaaggccttcaagagccatccattaccacaaacaccactaatatcaccacgtctctacttcttccctctcctcccttcctcctttattttgtctataatatttatcactagcacattttaaatttcatttattcatttcatttacttattttctatctccccagctaaaatgtagattccatgaagacaaatattgtttgttatgcttccctcactgttgagtccccagcgcctaggatggagcctgacatatataaatttatttctgcctttattgcacatagtttcttccttactgaagagaatttaagatgcacacgtctctgattggccatcccgatcaatttccccacctgactcaatatgtgtaagctctttaattccagagagagagaaatgggatgagaaaccacacacagaaaaaatgtgttgaatgaatgaaagtgattagaatgaatgaatatatggacaaatgaatgtagcaatctaggtgggatgaaaaagaataatttaagtcatggactatcctctcaaggagcccacagtccaccaatgactctcaaccaggtatgtgtgacagatgacatatacccctgtcacacagttctatggccatgacccacactgtggaagctggcactaataacatgaagtgcagattatgtataattatccctcatgtattctgaaactccacccttttgctcctactcacaaagcatccaagatctagactggacatggtgtttgcataggggtgaccttgaatcagttctattttgtaaaataaattttcttaaaatgtaatactttccctatgattagtaatcagttactcataatacaactctcaacaattggcaacacttcagaatgtccagctctgctttgtaaaactgcttgcctagaaaacaggatgaagaatgtcacttgagaaataaggaaagctacttgctctattagagaaatgtgtaataaacaattggaaaatacttggtataaaaaaatacaaacattgttttcaggtcttattctttgaaatgtgagctcttattctttgtctattttcccaatgcctttctatcacagagcctatcatatacctggaactccagggattatgaataaataaataaagcactggataaaaaactaaattgcagaacaagggaagaataatatattagtcattaagtgatataccagagatcctaaaggcctcaaacctatgcaattcctaactcattctttgaaactcaactaccaccttttagcaaagtctttctgacttccccaacccaaatttcattttcctacatgttgatcacatcatatttttgtagtgtcttctttaagatactcatcacatttcatctcatgctggtccttcattttcagcttcagagttctttcatttgctgatcactactgcaatctcagactggttcctttgatctacatactcatggaaccatgttccattctttcagggcacttatttcagcggtagttacacaattatctttttattcatttggcttgagactatctcaaatcaacaaactgtgagctccatgaccctagtgaccacatatgattttgttgaccaggtattcccagcactagcacagtgcctggccatagcaggtgcttcattaatatttggtaaatgaatacattaatgaataatatgtaatttgagcgcatgcacagcaggtcctcgaataatgctgcttcattcaacattgttttgttatagaattgatcagaggaaaaaaaatcatttcctaacccaggtccactatctgtgtggagctgacacattcccccatgtctgcatgggttttctctaggtactttggttttctctcacatttggaagctgtgcatgttaggtgaactggcatgtctaagttgtcccactcagaataaatgcagctatgtgtgagtgcacattgtgatgggatggggtcctctccaaggtcagttcccaccttgtaccctgagctgctgggataggctccagccacccatgaccctgaattggaattaagcaggttggaaaagaatgaagggatgaataaatataaaccactgtaaaataaaaatttgtgaagtgtacagtgaatatacagatgcctgacaacaaactgtgcagtataaaagcatccagcaaaccccccatatttgttattgtttgtttttgaactgcatggtggttggaggggctcctgacaattttcactttgcatttattccttgatttaacctgccattactacaaccactgtcactcactgattcattaaaaattgggtaaacattatcttgtttttatcattctttcttaaatatatacatagttcacatttatttcaatgcttaatagtagaagtatgatgggaggccgaggcaggtggatcccatcctggctaacacggtgaaacctcatctctactaaaattacaaaaaactatccaggtgtggaggcacgcacccataatcccagctacttgggaggctgaggcaggagaatcgcttgaaccagagaggcggaggttgcagtgagccaagatcgctccactgcactccagcctgggcgacagaacgagactccataaaaaacaacaacaacaacaaaaaaaaaaacaaaaaacacacattttgggtctttaagtagaagtttggtgatgttttgtgaccagaaatatgccatagaaacttaactcttatttatatcaattagtttcattatacattgtttcacttagtgttgtagcttctaagaacctattggctttaagtgaagacttactgtggtatcttcccaaaagacagcacactccttcacctcttgtaacagggaatctgacgccttgaacatgatagtggctccataaatattaacttggatataatttcctaaagctgtgtatatttgtgtatatgtgcatgagggtgtacgtgcatctatgcagcaaggaattgaatgtacctttaaaaatgtatcacagctttctacctttcacctgtgtcttccttcagaagacttcttttttatgtacaaattgaatattcagttaaacaattacaaggttgtcacactgttgacaaaaaacctgttgcagcctttaagacaacctcgaataggataacagccctttatgactttaacaaaaattcatttttattgcaatcaaccagcatgtactagaatcaaaaggaaaaaagaaattctgccagacttggcagtgtggcaggaccagtttgtgcaacctatatttactggtaataatggttatgtaagaggcccttgcatgggaccatcatttactcacaaggacatacagctcacagcctggttcagaacatagtcattattctggatgctcccatttcaattcaactgtatttctgagtgtgcaatttaaaaaaaaaaaaaaccatcttccagggaccattaagtaatacttggacccccctcaaaggacagctgcaatacatttaggcacttagtcatccagttatcacctcttctctcaaaaggccacatcagcaaggagtaaaggagtagactggaaatgccttgctgggtatcctggccagctgcttctacttggcctgatgtattattgtataggccaactatcaacaatcaattctttagtcctctcttagagctgcttggctgcttgtcctgctccatagctcactatcataatctcctctgacacacagtggtgtccaaagcacaatttcacacagggccagggttccagtctgggacctgaagcccctgtccaaaggagagatagcacaggacttgaaatcaccagaagatcccaattctctatccaggctttgcatgtaaagtgggagatttggagcaaggcaagtagcagcacaagcatcccccagtttccttttctgttttcagagggtggtgaatttcatgacttcaaagaatcctttccacattgagcatctatgcctttggtgataccactattttaatgtgtcagctttattttgctttacattctctctttgttgaaagtagttaagcctttcctaagtgaagaaaacttgacaaagattaaccttcaaattggttaaccatgtcatattcctagcctgcctccaatcttctaaagactcatacaagaaaaacaacgaaagtgaccaactacttatagtataaaagcaataattcttgttaagttctactaagtgtccagaactgtagtgtgtgtgtatatcgggggtggagtagtgtgtcatttagaacacaatccaagtctagagagagtcaaagaattgataagaaaattgttgcatgtgaaacattcatgctaaagtactgaacttcatatggccaagtgagtgaatatataagaaggtaaggctgataatagtcatggaagaaatggttagaaaagtaaattttggtgtgtgccttacaatatagaaagctttgataaaaggaaaaaaaaacaaggaggaagttattccatgaatgtgccaatgtttatagagatagaaatgactgaatacatgcagtgcttaaaagtaagagctctgcaattgggtagactggcttctgatcctggttctgtcatttgtagttgggtgttcttgggtaagtcaccacttgtccactctgagcctttaaatttctttgcctataaaatggagatatttagaatggctagctcaggaattggttatggggattaagttaaataaaattaaacaaggtaatacctagcacatagcaagtattcaaaaagctttagtcataattgatatcactatcaactaacatttgtagataacttgttatatgtcaatcactcttaggcccaagaaatacaaataaattaaaactaaagtgctggccacaaaaactctcactctgaagaccaactgacaaatcaataattcaccgtgacacatattgtaccaaagctttgcaaataggaacacagggagcaagcacctaacagtggttggggagaaggaaaggaggaggaaaacagatcacaaagatggtgagtattctaagtctaaaagaatgagtaggagcatacaaacactaaacaaaaaaaaagttttctagatagaatattacatgcaaagatacagatatttaagaaacaatctaagaattgcaaatggtttggtggaagatagagtacaggatatagaggggaaacaataagggaaaaggctggacaattaggaaaaaacagatttgaatttgtttcttcaggcaaaggagtcagatgataatgactaattctaaggaagaagaataaaaaattaacaaggcaaggtggaatatgtaaattattctcagttaatgaagggccttaaatgccaactcaaggagtttgaatttcagcctatggacagttgaaaagtattttcagttctaagagaggggataaatattaaaattctatattaggtagattaggcaggtatatatccaaaatgggaattggaaagagattcgaaataaggtacattcaagaatgatacagtaaggccctggtcctggatttttgaagatatgaatccaagacatacctaaactgaactgatacagaaaataaataagaaagacaatcaaagttgcctggaggaagtaaggtttatgaggtataggtcatgatgaaatgaccttgagtgtagcttgagtgtagatgatttgctttaaaagggaaaagagataacagttgagaagcctatcggacttttggtgttgagctcatttattaatctattcattcactcactccttcaacaagtatttattggtatttctcctgatagggtaatatgaataggcactggagatagaaagatggtataaatatagatcatgccctcatgaacttagagcttactaggggagaaatggaaggtacccaagcaactattaagacaaggtagtaaatgatataattaccaaaagaaggatatcagtgtagtgaaaaatgacttccaactggggaaaccagaaaagtcatgatggagaggtcaggatgtaagctaggctttgaaggtgaggtaagcttattaaacacagagtgaccataagtcccagtttacactacacagtcccagttatgccttttgtcaagcataattgttaacagcaccccagcttcactccctaattttaacaataaattatgcaattgccctagttatggtgaaggggtgccagcctgtgctcaaaaccaatgtcagtgagaaggttgaacagtggagtcaaaaggctgttaataatgtaatacttatagttagggaagtaatgatacagttctccttggtcccaaaaccaactactcactaatatcacaaagagaaaagagaactatgttcaaaggagagggatcgtgatgtaggctgactccaagccatgctaacacttacttcaccagtgaaccctactttgaggaggcatctcatggaaccagtgttctacagaacacacttcaagaaacataaaaccttatgatcaattggtagtgatgttataaagagaaaaatgaatattgaatgaagtattgatggctagtaaggcatttctaaatagaaataggataattgctgtgtcacctacagtgtaatatttatacaggatagatctctctaaattacaagtctcttaataatgtcttggcttgttcaaaggaataatgaaatttttaaaaaatgattttttacagggtagactgtatctatggtcctaaactctatattttaaactccagaacagcttttaaaactctgaccatagggcaccataagcaacagaacaaatggagttctgctttctttttgaaaaggattattgtgcaactcatctctatgaatgtaaaatgccagaaacctccatggctgcagaaaatctagtacctttcaaagttttcttttgaaagctctgaagaatgagattgatgatagaatccctaatgtctcttttttttgtaatccacaccacacaagatttaagagccaagccagaaaacatcaaatgacttgttcagcattgttcaaggagaaacattgatgttttctgccactgacaagaaacactaagatttttataaaaggtaaaatgagatatgaccagcagcatgtctactacaagatgctgttacaccaactaccataagcagaacaatataaaacaaattcatattcctgactgcctgaaaggaaaaagaccctcacaaatccacagtgcatgaaagaaaaatggtgttaacaaaaaaaatgaatataaagctggtcccagtgacctctaagcctgtaaaaatcaaacacacttttacataactttattatttcttgtttacagctagtggtagataactctggtattcactgaacaagggaaagcaaaatactcttatcattttaaggcccaactcagccaatacagacacattttttttctaattgatttttctcttcagtctttaaaaatagaaactacatcaccacctggtaaaataactactaagcacttaactgtatgggattatggtggtcacagggaaaagagaattactaggcatagcccaccggcttagaattctatatgaacaagatatcctaaatttgtaaagactgtatggtctttaagctatttcatttacatggccacatttcagtttctcaatatgcttgtgagatagtcaaggcaggtgatacaacatccaaatcagaacagaaagctgagcatcaccaactcagtcggtcatcatgcctgagaacttccagtaagtacggagtgaggactgcaacacaaggaccctaattccatatctaagggtctttctcccacactatagctgttaagcaatcaagttctctatacttgctccttataacaaagttgttgcttgcctctttcacaataagttttaaaatgaataataacaactgaaagggttaccttcacccagccaaagagtgagtgaaaagtagaaatgggcagcttttgtaggtccctgatatcaaggcagcaaacatcagcctatggactcagacttcagacagccattgtgcacagcagcttctctgtatacaggtgaaatcaatacttaagtaaggactagtccacagaatccaaaggaatctaaatctctttacagattatcatgatagccatggtcatcaggaagacacataccaaaattaggaggagacatgaatctgtaaagataaagcaagaaaaactctggtggtatcttagtcgagggtcacaaatggaaatgtccacagcaatcaggcaggtaacatagtgagggtagtgggctgggtcggaaccagggtgagctactatgtgaaggggacagcactatttagttctaattgagtcctgttatgcaggagaacaggctcagtgttcccaaatcttcccttttatctttaaagagaaactggattattaggaggaatttgattcctggcaacgaaatgaaaaaagtaacatagcatggatccaactaaacatgtctgttgattacatttagccagtatgtcagattcagcctgcagactaacaattttcaacttcaaatttcattattaaaacttctggtttagtcaacaagacatgtttgacaatttctaggttcatgaaaaaatggtatctaattgctcaaaaatgtccaacagagggatcatagaagtaaactagaattttaacctattcactcaataagggttggggaggcaacctaaatatacctactgtaagtttattatttctttaaaacctctggttgagccaggcacggtggctcacgcctgtaatcccagcactttgggaggccaaggcaggcagatcacgaatgaggtcaggagttcaagaccagcctggccaagatggtgaaaccccatctctactaaaaagacaaaaattagccaggcgtgggggcaggtgcctgtaatcccagctacttgggaggctgaggcaggagaatcgcttgaacctgggaggcggaggttgcagtgagccaagatcacaccactgcactccagcctgggtgacatagtgagaccctgtctcaaaaaaacaaaaacaaaaacaaaaaacacctctggtttatattaaaaattcatgtattttttgccttccaattcacaacgcatgtgttcttccttttaatatcaagaaaggtgattttcacccccaaaatctctagtaaagactctccaggacaatgtgccacatttattctgtggctttcaaaacctctgcaaaccatgtttaagaagcatagccctagattaaccagagttctttcaagagtaccaccctttcttacatccagcagtccttggacctaaagctttagctccagctatccatcagactgacagcagtcaagggccagaagttggtgtggcattcacaaagagagacatgcttccaaaaattctcaagacacagcctgctggtcttgcttaatctgatcaacaccctgactactctcagaaacaatggccatgatttttcaggccttctctggcctcttgcctttcaaaacaatgtctccgctgaaatgcccagaagaataacgtatcttcctgtcagggttgagactacaaaacttcctccaaaattgcctcatactgcttttatctttaatgctaaagttcactgagaagtagtgggacatcagaataactcagtggtagagcatcacatggaaattgaagctcccctagcagcaccagggcattctcagagacatctcttcagaggatcaacaaaactataaaatatactaaatatttagaagcaagtatgtttctaagcccatatctctaacaaggtagactcaggaccagcatacataaacatttcaaggctacagacacatagggacacacaatattatatattaaaatgtggtagagcctgaaaaactgtgtgcctcacctacattttgttttttaatcttgtttgatttcaaagaggattcttaagtgtatttctcttgtattcttctatctccagacaccagaaatgccctttgtgtggcaatgattaatggctctcaaaagcaaaagaaactgtctactctgaaagctttctgagtctctagatgtagcctattttttctgtgataaatatcaccatatttttatgcacaatattttccccctagaaactgcataatcatgctagctaaacattggtataggattttactttgaaacctttgggatgtttcctccatctgccaagaggcattctgcagataatcatccttcatggtttcaaaccaaaaggaaaaaaagttaaagattaaaactgccagaaaaccatagagttaacttacttccattcacaggcctgagaggaagccacaaaggaatttctgacaattgcaatttttaaatatgccaataaaatgttaacattcgagactcattaagcagatttgtagcattcacttcacatctgatgtgctagggcctcagaaaatagattttcttacccactagcgacagtaaagaagactctggccactgcagtccttaacaaggcaaaataaagcctattctccatgagttatgagatggcataaaaagaagtaaggatctgccctgataacatccagataatggtggcttgggtataatctgctgtgcctccaaatcaggagttaaatgataacagatagttgtggactttaaaccaccaacctcccttgctatacacctccccactccgtacaccagcaagatattataagaggttgtggtggaatgatgaagtgagaattatccctgggaggcaagtttggttcaacatacataaatcaataaatgtgatccatcatattcacagagtgaaggacaaaaaccatacgatcatctcaatagatgcagaaaaagcatgtgacaaaagtcagcatatttttataattaaaactctcaacaaattagatatagaagaaatgttcctcaacacaataaaggctatatatgacaagcctacagctaacattatactcaacactgaaaagtcaaatgctttccatctaagatcaggaagaagacaaagatggctactctaactacttctgtttaacatagtactagaagtcctagccagagtgattaggcaagagaaagaaatacaatgtatccaaataggaaaatatgaattgaaattgtctgtttgctgaggacatgatcttatatagaaaatcctaaagactccacacccaaaacctactagaactgataaaagcagtaaagttgcaggatacaaaaccaacatgcaaaaatcagcagtgtttctatacactaaccacaaactgtctgaaaaaagaaactaagaaaataatcccacctgcaatagcatcaaaaaaaatacataggtgtaaattaaactaaggaaaaaaaagatgtgtatactgaaaactacaaaacacagatgaaagaaatagaaaatgacacaaataaatggaaagatatcccatgttcatggattggaagaattcaatctaatttaatttaataataccaattcaattcaatccaattcaatttaataatatgaattcttccaatccttggattggaagaattcatattattaaattgtctatagtaaccaaagcaatctacaaatttaatgcaatccctatcaaaattctaacgtaattcttcacagaaatcgaaaaaaaatcctaaaattcatatggaaccacaaaagacactgaaaagccaaagcaatcgtgaccaaaaagaacaaagctggaggcatcacactacctgattacaaaatatattccaaagcaataataatcaaaatggcataggactggcataaaaacagacacatcaaccaaaggaataggatagagagctcaaaaataaacccacacgtctacagtcaattaattttcaacaaaggtgccaagaacactaatggggaaaagatggtctcgtcaataaattgtgcttgaaaagccacagataaaatttaaatgtccttcatctcactcttataaaagaatcaactcacaattagttaaagacttaatgtaagacctgaaactataaaactaccagaagaaaacatagggggaaacctacatgacagtggtctgggcaatgatttcttggagatgaccccaaaaacacaggcaatgaaagctaaacaaattagattacatcaaactaaaaaaaatgattaatagagtgaagagacaactcacaaattgagagaaaatattttcaaatcatgtatcagataagaagctaatattcaaaatatataaagaactcaaactacccaataacaagaaaacaaataaccccatttaaaaaatggacaaagaactttaaaagacacttcttagaggaagacatagaaatgatcaacagatgtataaaaaatactcaatatctctaatcatcagagaaatgcaaattaaaaccacagtgacatagcaactcacatctgttagataagctattattaaaaagataaaatataacaagtattgccaaggatgtgaagaaaagggaacttttatacaccgtcggtgatattataaattcatataaacagtatgggggatcttcataatactaaaaataaaattaccatatgatcaagcaatctcattaccaggtatatacccaggggaattgaaatcagtatgttaaaaaaaagtctacattttcatgttcattgaagcattattcgcaagagtcaagatatgaaaacaacctgtgtccatcaacggataaatgcatttttaaaatgtggtatatacacacaatggaacctattcagccttaaaaaacacaacaggaaattctgtcatttatgacaatatagatgaacctagagggcctgcattatattaagtaaaataagtcaggcacagagacaaatatgtgatctcacttatacatgtaatctaaaaaagtcaaatttatagaagtagagagtagaatggtggttaccagatctgggggtggagaagatgggcagggaaaggtgagagcttggtcaacagacacaaagttacaattagatagaagtgataagttctggtgttctattgcacagcaagtcgactacagttaataataatgtatatttcaaagtagctaaaagagagtatttttaatgttctcactgcaaagaactgataactatttgaagtgacagatatgctatttaaccagatttgtttcatagagctatagttctagagtggatccacagaactctgttatcaatttttttcagagaggtagaaaatgtgagttttattaaaatgtgctatttactgtattatttcattctcacactgctataaagaactacctgagactgggtaatttataaaggaaagaggtttaattgactcacagttccacatggctggggaagcctcaggaaacttacaatcatggtggaaggcacctgttcacagagtggcagaagagcgaatgaatgagtgctgagcaaaaggggaagccccgtaaaaaagcatcagatctcatgagaactcactcactaccaagagaacagcaccatgggggtaactgcctccatgactcaattaactcccattgggtccatcccacgatatgtggagattacgggaactacaattcaacatgagattttggtggggatacagccaagtcatatcatttgcataacataatttctggaatattcttgctaatgtcattaaatctatacaaagacctgattctgaaagaccaggaggttgtaagagatatcaataagcatttgtacaaaaagtttaatattagaagatgttttctctggaaagctgtgacaaacaggttagtgccaaaatggccatcaagaaacccttattaacaagaacataagttcctctagactaaccttactgctgtgtatatccctgaaatcccacaatagcagtaatgatagagtccagtcttcctttgccttcatccgctcctcacttagtcagtagtgagggtaaactctcaccttaatttctagccatttgtcaaagctttctttgctgaggtcttgtccattattcaaagcttatcttactaaggtctaaatatgcaaagacttcaactgagattttctaatagtgcttcccatgttctacattgcttagtattatatatggaataattatgattgtggttatttgtgtactccatctctccaactgtaccttaagctctacaagggcagagtcttgcaccagaagcacaggatttgataggtgcttgataaattaatgtagcttacttgatagggtgaaggaaggagtagggaagaagagaagaaagagaaataaggaagggaagaggaaagacagggagaagaagagagaggaaaggagaaagaggcagaagaaaaaatggatagatgaacagaaacttctttttttttttttaatttgagatggaatctcactctgtcacccaggctggagtgtagtagtgcaatctcagctcactgcaacctccacctcccaggttcaaatgattctcctgcctcagcctcctgagtagctgggattacaggtgcctgccaccacatctggctaatttttgtatttttactagagatggggtttccctatgttggccaggctgatctcgaactcctgacctcaagtgatccacctgcctcggcctcccaaagtgctgagattataggcatgagccactgtgcccggccaacacttttaagcataaaaaaaaaaagaaagaaaaaagattatgtttctcctcaaaaagcttctgacctagttgggtagatagaaatatatttttttataacaggaggtccatattagatgaattataaccacacagtctagtacttggcctctaaaaggaatactataggaattcaaatatgaaggtcagcatggctgcagaactcagagaaggttttatgaaatggaggggatttttttttgctggaacatgaagaaagtggtgaaacggataagcaaaaatgaaagaggatggcaagtcctagaatgttccttgatattctatctcccttctcgtatttgtcattagtgattagtggtttctgctttgaatagcacagtaattgcagcttgactttcttaggcatggagaataattttcaccccaatagaaaataaacaccaacatttaatggatacacttactatgtatcaggtcctgtgctaggaacagaacataaatcacataatcagatccttagacaaaccaccatgattacgtcctctctacagataagaaaactgaacagaggccaagaaccttgctccatatcacacaactggaaacagctgatagaagaatcaaccactgatgcttagaaagtttggaagagcagaagcagaccctccaattacctcacacatttttcattttgatgataacacagagtttacttgacagcaaaattttctgtggttaacctaagtttttgtctttacatcctatatctaagttttcagaagtctggatatgagaagatgagagaccatgctggaaattttcatttagcccttgatatggtttttctgtgtccccacccaaatctcatcttgaattgtagctcccattattcccacatgttgtggcagggacctagtggcagataactgcataatgcaggcagtttcccccttactgttctcctggaggtaaataagtcttacaagatctgatggttttataaggagtttccccttatgcttgactctcattctctcgtctgccaccatgtaagatgtgcctttcaccttctgccatgattgtgaggcctccccagtcatgtggaattgtgagtccattagacctctttttctgtataaattaccctgtctcaggtatatctttaccagcagcatgaaaacagactaatacagcccttcagatccactccccactcttcatcctgctccgtgccccaacaggtgatctgtggagcctgcagcagtgcatctgctctttagcttcccagagaggttatccagcagaatgcacccacaggcaatcaggaaggagagagagaggtcagggtccgtattctccggatacccaccctgctgggccacctcaggttggtgtcctgtactaaaggtggaggatctagaggatcctagtaaatctcgatttctctctctctctctctctctctctttctgtctctcctcccagcccctaccaattcccctgttctccaatgtaataatttttttcctttaacctttccaggcctaaaaatttgcctaccatcagcctctttcaccctttgcttctttttctatgctcaaacatgtatagagtccttttacaccataaaatgcagcaataccacttctggtatacattcaaagggattgaaatcagtatgttgaagagatacctacattcccatgttcatttcagcattactcacaattgccaagatatggaataaacctacgtgtctatcaacgaatgcataaagaaagaaaatgtggtatacatacacaatggaatattattaagcttttgtttttaaaagagaaggaaatcctgtcatttgctgcaacatggatgaacctggaggacatgataagtgaaataagccaaggacagaaaggcaaatactgcatgatctcacttacatgtggaatctaaaacagtcgaactcatagaagcagagcacagaatgctggtttccagggtctgggagggtagaatgagaaaaggggagatgtctgtcaaatgcacagagttttagttaaacaaaaggaataagattttgagatctctcgcataggctggtgattatagttaataacaatgtgtatttttaaaaagagtctccttaaattttcctcaattacaaaacttaagttttctgcagtgagcctgactaacacaggtgataagtttgtgaattagaatagtgatatttaaaataaaaggaaaggtccagatctgaggtacattttggaagaaggaacatcattgaatgaaatactgaaaagaggtaagaaaagcagaataatatcaaaaatcatcaaagatttttgggtccaggtaatctggaaaatgataatactgacagaaataggaatattattaatggaaacttaggagttcttcctgtgaatatctgtctcttcatttgaatgtctgtttggggaactaaaatttttttgttaaaaagaaataagacaagacgataaaattaaagtctacactgctcctactagtcccctttaccagagaaatctatatcataaattgaatatgcattcttacaaactatttttatatgttatttacataaatgtgtatcctggtccaaggacattattattctaacaatacaattataaaatgatatgtggtttatttaataaactacaaatcacgatttccataatttggcaacttaaaatttttactcaaaattatgttttgaagatctatccatgttggcatatacacctctacttcattttttttttaacagttatgcaataattggtcaaaattgctttatctgtttgctttatctgttcctctaccaacaaacttttcactataataaacaatacttcagtgaacctccttctctaagtcaccttaggagaatttctgtagggttcccgtggcattgctgggccataaaaaacaaaatgagtttagaaacttttatttttgaggtttaggctatgtgatcgggcatcaaaatggaattttaacagtagtcattagtaaacattggcctaaagaaaagataaaatgaagataaagatatccgtttgtagtgatatttctacttcttttttcagctaggggatgaaaatagcactgttcaccaggccataaaccaggcaccttgcaatcattatctcatttagttttcacatatacccttcaagagataactgacattcactaatgcctcattgtaggtaatagtttccatctccactataactcccttttcttttaatcagaacaatataacagataggaaattccaactgtttgaagtgtatccttttttaaaatcatcttttccaacgtaaacaaagagtaaagtcactaataaagaaataacgagaaacttgaaggcaacaggaaaagtagaagccgaataatccacaaagtagtcaaaccctggagaaatcaggaactgactctacttgaatccttaaaattaatttgtcctcccaatgagggtttgctggtttgaggcaaaaagatctattcttcaattaactgaagatgtcaaacttgcattagaaaccctcgataactcctgacagtgaaacaaattaggatttaccctagataaacataggccacatttattagaatcctcataataaagctataccatcaggtaaaataaactatatttttccagaacatgatggttttaagacaaaggcaaaacataaaagagaaaaaaaattcagatatttctccaacccgttcagaaaggctgtacctagagggctttgagggtttccttttgtttcctgttgtgttacctcttcaacttcattctaccatcagctactgagatcaatagcccaaggttgggcatggaggagcttcacggacaagcagcagaagctagtgtctctggtgtcactaaactctaagttgagaattgttcttggttttcagataaacagtaaactgtccaggagctaagatttgccaaattttctttctctgatgcccatactgaataaatgggaagataattttccttaggagagctgtgcacagagttaaccttaggaatacaggcagtaataataaaacaataactaatgttttgcagtagtgtgctgttttatttactattcacaacaccctagagaggcagctatcactgaggctcactcacacagctgcctaaggatacaaaatgggcaaatgacaaagttgagactgatatccatggtttctgactcatcattctcctatcagtactatcctgcctagcttttagtaggtgtttatttgatatttgtgaataaaggactctcttcgttgtaatcccacctgtctcctacccacctatctgaattgcctgacattcaatgatcagccattcagccctctagtggaagaaattattccctattaaagcgcaaatatcagggcctagtgtggcaactcatgtcggtaatagcagcactttggaaggccaaggctgaaggatcacttgagaccaggagtttgaggctgcaatgagctatgaaggcatcactgcactccagcctaaaataaataaatgaattaagtgcaaatataaagagctatacttttttaaaaataatgtttgacctagtaattccattcttaggaataattcaaccaaagcaaactactaaatacatgagctgtttggtgtggtattttctgtgataagtaaaagaaaagaaagaaagagataaggaggtcaggaaagagatggaaactagaaaaaacaatttctggaaataacccaaatgcccaacaataggggaataaactatagtatatcgaaggctagaacagtgtttttcaaactgtaggttgctattcataaagagagatgattctggtatgttgtgtttttgttctcattagtttcaaagaacatctttatttctgccttcatttcgttatgtacccagtagtcattcaggagcaggttgttcagtttccatgtagttgagcagttttgagtgagtttcttaatcctgagttctagtttgactgagctgtggtctgagagaaagtttgtaatttctgttcttttacatttgctgaggagtgctttacttccaactaagtggtcaattttggaataagcgcagtgtggtgctgagaagaatgtatattctgttgatttggggtggagagttctgtatatgtctattaggtccgcttggtgcagagctgagttcaattcctggatatccttgttaactttctgtcttgttgatctgtctaatgttgacagtggggtgttaaagtctcccattactatggtgtgggagtctaagtctctttctaggtctctaaggacttgctatatgaatctgggtgctcccatattgggtgcatatatatttaggatagttagctcttcttgttgaattgatccctttaccattatgtaatggccttctttgtctcttttgatctttgttggtttaaagtctgttttatcagagactaggattgcaacccctgccttttttctgttttccatttgcttggtagatcttcctccatccctttattttgagcctatgtgtgtccctgcacgtgagatgggtttcctgaatacagcacactgatgggtcttgactctttatccaatttgccagtctgtgtcttttaattggagcatttagcccatttacatttaaggttaatattgttatgtgtgaatttgatcctgtcattatgatgttagctggtgattttgctcattagttgatgcagtttcttcctagcctccatggtctttacaatttggcatgtttttgcagtggccgataccagttgttccttttcatgtttagtgcttccttcaggagctcttttagggcaggcctggtggtgacaaaatctctcagcatttgcttgtctgtaaaggattttatttctccttcacttatgaagcttagtttggctggatatgaaattctgtgttgaaaattcttttctttaagaatgttgaatattggcccccactctcttctggcttgtagagtttctgcagagagatccgctgtaagtctgatgggcttccctttgtgggtaacccgacctttctctctggctgccctgaacattttttccttcatttcaactttggtgaatctgacaattatgtgtcttggagttgctcttctcgaggagtatctttgtggcgttctctgtatttcctgaatttgaatgttggtctgccttgctagattggggaagttctcctggataataacctgcagagtgttttccaacttggttccattcttcccatcattttcaggtacaccaatcagacgtagatttggtcttttcacatagtcccatatttcttggaggctttgttcatttctttttattcttttttctctaaacttcccttctcacttcatttcattcatttgatcttccatcactgataccctttcttccagttgatcgcatcggctcctgaggcttgtgcatttgtcacgtagttcttgtgccatggttttcagctccatcaggtcatttaaggacttctctgcattggttattctagttcgccattcatctaatcttttttcaaagcttttaacttctttgccatgggttcaaacttcctcctttagctcggagtagtttgattgtctgaagccttcttctctcaactcgtcaaagtcattctccgtccagctttggtccgttgctggtgaggagctgcgttcctttggaggaggagaggcgctctgatttttagagtttccagtttttctgctctgttttttccccatctttgtggttttatctacctttggtctttgatgatggtgacgtacagatgggtttttggtgtggatgtcctttctgtttgttagttttccttctgacagtcaggaccctcagctgcaggttgctggagtttgctggaggtccactccagaccctgtttgcctgggtatcagcagcggaggctgcagaacagcggatattggtgaacagcagatgttgctgcctgatcgttcctctggaagttttgtctcagaggagtacccagacatgtgaggtatcagtctgccactactgggggatgcctcctagttaggctacttgggggtcagggacccacttgaggaggcagtgggactgtaaactagttcaaccattgtggaagacagtgcggcaattcctcagggatctagaactagaaataccatttgacccagccatcccattactgggtatatacccaaaggattataaatcatgctgctataaagacacatgcacacgtatgtttatagtggcactgttcacaataacaaagacttggaaccaacccaaatgtccaacagtgatagactggattaagaaaatgtggcacatatacaccatggaatactatgcagccataaaaaaggatgagttcatgtcctttgtagggacagggatgaagctggaaaccatcattctcagcaatctatcgcaaggacaaaaaaccaaacaccgcatgttctcactcataggtgggaattgaacaatgagaacacttggacacaggaaggggaacgtcacacactggggcctgttgtggggtggggggaggggggagggatagcactaggagatatacctaatgttaaatgacgagttgatgggtgcagcacaccaacatggcacatgtatacatatgtaactaacctgcatgttgtgcacatgtaccctataacttaaagtataataataaaaaaagaaacttacaatcatagcaaaaaaaaaaagggagagattaaaatatttcagttgatcaaagtcagcattttttttaatgaaatgattaagaaagaaaatacacccctccctcaggatattcgcagattggttccaggacccctacatgtaacaaaattcacacatactcaagtcccacagttggcctagtggaacttgggtataggaaaatttggccctccatatactgagtttcacttcccgccaatactgtattttcattttcaatccatgattggttgaaaaaggtccacatggaagtggacctgtgcaattcaaacccatgttgttcaagggtaaactgtagtataaaacagaataaaatgaaatagaaaatatcagactacatcattccttgtgagggtaagaattatctcataaaacctttatttctcggccgggcgcagtgactcacgcctgtaatgccagcactttgggaggccaaggcgggtggatcacgaggtcaagagatagagaacatcctggccaacatggtgaaaccccgtctctactaaaaatacaaaaattagctgagggtagtggtgcgcacctgcctctacctgcctctagtagttagtcccagttactccggaggctgaggcaagacaatcgattgaacccagggggcagaggttgcagtgagccgagattgtgccattgcactgcagcctggcgacagagctagacaccgtctaaaaaaaacccaaaaaaacctttattgctctgtaaatatgaatgtgtttacgtgtatgtataccaagtacaacgtaaaaggtgttttagtatggaaaatggcaaaaaaaatttgaagtgcactggcctaggttattattcattcattagaatttacttgagagaaattctggaggaaatttataataatgttaaagaaaaagttggtcacaaagtggtgtagatattaggatggcaattatagaaaatatgaatgtgtatacataaatgacaggaaaggcatgagaaaacagtcattgttctaagaagatatatgtgattattacccctcattttgtttttttatttctaatctgagacaaaaagatctacaattaactctagtgcagactagccttaaactctgttgtaaattccaataaataaagcaaatcagaatgcacttcaagcaagcaaagaaccaatctactgaggatacttataaatgaaactagtacaccagatacataaaatatgcctggtggatggaacaaaacatttctaagcccaagagcatgtttctttctttatacacatgccaatgctgagagggatagccaactaaatcatctcttgttcatttataccttagcattacttagtgtacctggtcccttccaataaaagagttagcttgtgccaagaatagataaaattgctaatggtgagaagaaattgtaaaaagaggcaatagaagatgctaagttgtttctcttcagcatcttctagtatctctttttaattcataatttgcttaaaattggctgtttcatagaaaagtatcttgtgaccatcataaagatgaatgagacccatatcaagttaaagtacttcatgaagccactttagctagtctggagttactctgggtaagaagctagacttgggggctggatgaggaaagaaaggggcaagggaaatggttaatgaggctataatcagcataagtggaaacagctggagaaagcaaacagcaaacttgagatttcttcttatcccctccaccccactatccaacagagtgagaacaagctgtgctttcagacactaaaagctgtagatgcttaccaacaaactcaaataattgcaagccctcatggtgctagctagcccacagaatctgaattgatcttgtttgtcaatcaaatactgaatgccagtctgcataaatagttacaatttctaaagtatgtggcaggatgaggtgttctgatcccatacgcacttatttcctggtcctcatcactcattgagaaaatacatttggtaaagctgatttaaaatgagatttaaaaataattgtaaatattttacacatttatgggatacatgtgatattttgttgcatgcatagaatgtgtaataatcaagccaaggtacctggggtatccatcacctagaatatttatcatttctatgtgttgggaacgtttcaagatctctcttctagctactttgaaatatatattacaacctgggcatagtagctcatacctgtaatctcaatactttgggaggccaaggcaggaggattgcttgaggccaggagttcaaccatcctgggcaatatagcaagaccttgtctctataaaataaaaataaaaattagccaggcatggtggcttgcacctgtagtcccagctatgtggggggctgaggcaggaggattccctgagccaggaggttacagtagcagtgaaccatgatggtgtcactgctctccagcctgggtcacagtgagaccctgtcaccgccccccacccccaaaaaagaaagaaatatatatcatattattgctaactatagtcaccctactctgctatcaaacattagaactaaaagagaggacttttaaactagtaatgctaaaagaggtggtcaatactaagagaaaatactaaaggtttttttggaagatatgccactcttaacaacaggaaaaaactcagtctctcttcatgtggcacaattacgatgtaccaccactcccagatcaggatcaggaaaaaaggtcatcatgaccttaatgtggggtaggcagataggaacaattactgaaagttaatccacagatccggatgcctcctcaaaaggtagaataatatacaaagtgcatttgtcttctctaaatttcctttagatagtggtaatatgaacattaacaacatatcctatatagaagagagcaaacagaaaggtcatcacttctctacaagctgattttaaaagatgctgattggacgtttctgagatcccacttcatctgtagattcttggtggaaatttcatcagctaatttcttgggtagaaggtgggagatgtcccacacttaaattgaggaaccaaatacctaaaatcaagattgagctctctttcctgttacaccactgaactttctgatccaggacagatgttacccatgaataaagagaaaattacaatggggaaggacatgaagtttttgagtaaggtaccatgcagagtttgctatggcagaatcaaagcttttatattctctatcacacccctatgtcatctacagttacaaacccctgggacaaaagaaaaaggaaatgagtctagactaccatgtgatgaaagtacctctaaattctagtgtaattccccacatttaaggcaagctgctagaaaaatacagcttcatcaaaggttaagtgtaactgttcatatgatttttagaatccttaatatgctgcccttattgactaagttactatcactagttaatgtaaactattatttgcattttataatacattacattttgtaagtactttaagtggccaacataaaaattaatgagacccgtatcaggttaaaccactttgtaaagctacttcagctgatctggagttactttgggtaaggagaggctaaactggaggtgatgggacactggggagtatgtttagcttcttccctaacattacataacagagaagtatttaagaaatcattaaacataatttgtccatgtgcattagacacacccatttacacacaagttcagttcacaaatgagaacatcaactgccttttaaaaatattttcaacttatttaaaatatgtagcctttatttctgagggaaaatatctagtccttgtgatatgggaagaaggcagggaagcactgggtggagaaacgcagggtccccggctagggctcttcccttctggcctgtgcccacggaactaggtgaggacaggcactcctgcttttgcccccaaatgttgcatttttccaagaccaccctggcccaccacacccgccactctgtgcctatgaaaaccccaagaccctcgcgggcacaaatgcagacagctggacctcgagaggagcagaggagcggaagaggtcaccgacaggcaccagtggactctggcaggccatcaacagcaggacgacatggaattcggctgggggcagccagtctccaggggaagatcaccttcccactccatctcccttctgtcctccccatttacctcgctgagagctacttctactcaacgaaactctgcactcattctccaagcccgcgtgtgatccgattttcctggtacaccaaggcaagaaccccaggatacagaaagccctctgcccttgcaataaggcagagggcctaattgagctgattaacacaagcagcctgaggatggctaaactgaaagagtgccctgtaacacacacccactggggcttcgggagctgtagacaatcaaccgtagatgctgccttggggtcagagcccaaaaacgctcctcacgacctgccagtatgatgcatgttcctccgacgggtttgggcgagccacacccgcatcgcaccctctgcgagggggataagggaactttccccatttacctggactagctgagcagactgattatttatttccttgctaatttttcatctttttaacgaattatattctttgcatgtttgagtccaatttctgaatgaaatggtcttatgttttattctcaatattttgatgctgaaactttctagatacgaaacgatatttaaaaaaacataaaaaatctattttgtaaacgactaaattggggcagatctgccatttgggctggcagattttctactgtagagctctatcagtgaaaacagttctggtgtttaaacattggactctggaaacaaaaaaatcaggcatttgattgaacacaaataaatgaaagttattgatatttttcatgaccccgtaatttgcagagctttacacttttcaacatgtctccaaacccattatatgattatgtcacttgattcccacatatgtttatgaggtagatcaggccacagttaacatcatccccaatgtatatgaggatcctgagacacaaagaggttgtgtgacctatacaatgtcacacagaaagttaacgtagaagagggatcaacccaggtctcctggttgctaatttgttttctaccacgtcacttcactacccaacatcaagggccacatctctttagtgtgttcaagaaacgcaagtaagaacaatgattattattccccgggttctcctctctttattgcgcagaataagcaatttccagctactaacatacatagttgctttcctgcaaagttttcccatagaaaccctaaattttcaaaagagttatttattgctagatggaggtgtgaagaagcttttggttttatcttcccatatcccagtttgatctattaaattttgaactcagcgcctctttaaaggtgtttaaaattcagtgctcaaatcccaaatttctcaagggtcagcaagtcaaattcatttacactttatccctgagtttctttcctttttatcctttcttttatatgaaaagcaataaaccagtgacccatgcttttcactcagagactctttggtctgtactttaatcacttcttatctggtatcttcagtatagggtatcgtgctgaaaataagtactaaacaactatttacttctcactggacaattccagcaatttctatcaggtcacttcaatacttactgagattggcagttatcaaatcatgagtccaaatctgtcaccacttggaagataaataaggtcagggatgtgggattgcaaaaaacaaaggaaatctatttgagactttgcataaaacaaagtttgcaaacagctaatgaatgctaggtgaacaaaacaaagctctacttatagttatacatggaaaaatctacagtcattaaagacaatggcatagatctatgtttactgacacaagatattcataatattttatagaagtgtagataatgtgactgcatcttaaattttatccatgcatagaagaaaatctggaaactaattttctctaagcaggggaattatggcttttttatatttttaaatttttgtttatactttctagtttttctctaatgagtttatctttcttactttataagtaaagcctctctgtggaaatgtaactaaagcaaaggttaatagggccatggacctccctttccatctttcaaatgagttacagaatacaacaagtgtaaaggaaaaaaaaatctcatgggacaaaatgacaaattattcctgggaaagaatttaaactatgatacatgctaattaatactcaagaaatcaggtaaacagggacttaagggcagcttcttccttatcttttctggaacttgttttcttagttctcttcctttttcggaggggaagaaaataggtggcttcgtaagacagaggcctgggcttagagtcagaaggccttgatgaccttattagcctctcctcttaattgggtaggattcaccacctctctgagttttgatttctttatcaagaatgaggacaataatacctaattcaggtaagaattccctgagaaaatatttgtgaaaatttggagcacggcattagaaatcaaaaaatgtaacttaaacatgaatctctcccctgatttctcatgctggttttctgctctgtctgaaataaaaacagatacattaagtactcaggttcttggatctcatttccattggctacatggttctaattggtattcaagttgagacggcatgacagctaggcctttctaatcatcctattatgccaaagaagacatggttcccaccaagagcctgtgactattccaaacttttttaaacatccaaaacaaggcatgaataggtgtctttgaagcaggattctcagcttgaacctaagctgtgtccacccttaacattcatggtcaggacatatcagggcggatctggcagataatagggtagggtaaatgagaattcatttgcataagtaaataggaccctcctctccccacaagacataggaatgttctcctgagttctctttgtactcttgaccatcatcgcctctagctttgcctctctttatttacagagagaagagaagatattgcatgcttgaaaaaaggaacaggatacatgaaaaagaaacagagaacaaaaaagagtcatgaagatgtaagtgtcattatccacatttaaaatgccataaaagaggttaatgattcagtcaaggaaactccaaaatatagagccaaaaaaaaatcaaagaaatggaaataaaagagaaaaaaataagaaaatcagagaatgaatccaggaagtctaacattagttccagagagagggactgctagttttcctgaagaaccttttagtaccatttaaatattttaaatgtgtacctatattgctttaataaaacaaagtagttttcaagtactatttatacttattgtatccactttgtcacttctaattcactcattaaacacaccatagtaactacacttattgaagtcaacattgatcttctaaatgccaaatctagtgggcagtttccaatactcatgctacttgagaagtatgtaacatttgtcatgtgaccactccccaaccctcccttaatttctagaatgtcactcttctttagttctctttctccaagagctcaacatcaccactgctgtttttgcttctacattacataaaacttttatgtcccatctttacttattcttttactctacacacttgctggatagccttactcctaagttttgatttccaatctgtaagtcaataattgccaaatctgtatcccttgagcttgacttccagctgtctatatctttatttgatgtcctacaaacacctcaaacagcatatacaacattgatttcattatttacctattttcctccactccccaaacccaaatccacctaatctgctacatttttcattccagctaatggcctgaccaagctaacaaccataaggtcactctcaactccttcctcaaccttcagattagaaagagctaaaagtccggactgctctctccgcctacattgtcactaccttatcttaggcttatcatttatcttcagatgctattctcttcctatccagtccatcctctgcattactgcctgttatattccttatagccacatctgctcctgcttaaaagctttcaacagctcattatcaggataattttctttgcctgtcattggaggcctttgcagtttgactatgacccatgttccagacaatgtgccttaatatacacagaacctgtgccccagacacactggattcttcactggtcctgaatgcctcaggctccttcatcaccccacctggtccaactgcctggaattccccaccttgatttcttcaactggaaaacttactaattcttcaaggccttactgaaatgtcacattgtctatgaagccatgcagggaaaattcttcttcagtgttcccaatatcctgatatcctgtgttgttatctcctgcagcattgtgagtcaggctttggatctctagcaagaggccacacacacatacacaaacacacacacacacacacacacaaaccaccaagttctcatgtatttagcttgtagtaagtacaaaacttaacagaagtagctgcacagagtacaggcacatgcaggaagttttccttggtccttggttccccacagtttgtgcagctgccactgacactgtccatttaggtagggtacagccatgtttgagaaaaaagttgcaatattgttacactatcactcctttatacttgaacttacagcatcatccacctatgagcttcctttttaggaaatgttaacaaacagcagaccctcctgattcttaatttagcccctgtgcagacatatcctcacagaggagagaaagctgagccaggcacaatgttcctaaatagtgtctctgcctgcagacttccagtctcaggaagtccatcttcccacacctctactattaaagttgccaattttgtattataatttatttatgtctctgtctttaccactgaactgtgagctttctgaaaccaaaagccatatattattcatattcgtatgctcagtgacaagcccagcatttggtacctagtaggacacacaataaattttgttagatgagccaacctaaaacacctttcaaaatctggttttctgaaagcttgttagatctcacaatctatttgtaatcctgagtttctataacttggtgaaggatacacactttacaaaaagatatttcaaagaagtaatcttgggcagctaaaattacaggttatttgtgatggtcttgtacaactctgacctaaaataccatcttctttgtctacctgttgggaaaataatcatgatactgcctggcctcctggagtcacaattacacctatgggaaattcaaggccaaacagctggcctaagaaggaaagggtccctctctcaccacagatatcagatagagattgtctggaggaggggatttccaggatgctaccaggaagaggtttgggcaaagtgacttacgaggtcactctagctgggctggctggactgctggttctatactctacccctccttcaacaagacccccaacttgaggtgtcaggaaaacacacagttttgtattaaatgcacctgaagtctcattttggttccacaatttactaactgtatgaccatggcaaactgccaaaatcccatgaatttctattttctcattggtaagatgcaggataattgtgagggcatgagtatttcacatacctaacctagtatcaagtttgtgctaggtaaataatagctgataacagataggaaataactgaactagaagaagaacttactttaccggatggaaaaacactggaccagacttcagaccagggtaataaacagcaacaacgctgtgaccctgggctaatcacataatctttcaaggatatagcttcctcaactgtaaattcaggaaatttgacttgacaatttttttcccagccattattaacattctagatttcacacatctagctttatatccccagtttcaaaaagaacataatttttaacaataaaacaactgagtccaaaatgattaaatgacctctccaaggtcaaataactaataaattatagaagatgggagctaagatatattatctttactatgtactaggttccacgcattattcttggatctcacttcatcttcttgtaatgggtattatagtctctttgttttatgtttttagcaaggctaccaatcctttaaacatgatagttgtgttctttatgattagtacaactggtgatgtccacttaaggtagaccttctttttttctgccaagaaccaccattgaggctccttgtagcctgtagacataatttgaaaagtaaacacatgctcaaaaagttaaacatatagttaccattatgacctagcaatttcattcctaggtatatacccaaaagaagtgaaaataaggattcaaataagtgcctatatatgcatgttcatagcagcagcactatttttttatttaacttttaagttcaggggtacatgtgcaggttttctatataggtaaactactgtcatgagggttatgtacagattatttcatcaccccagtattaagcctaatgcccattagttatttttcctgatcctctccttcctcccatcctccccgctctgataggccccagtgtgttgttcccttctatgtgtccatgtgttctcatcattcagctcccatttataagtgagaacatgtggtatttgttttctgttcctgtgttaatttgttaaaaataatggcctccagctccatccatgttcctgtaaaggacatgatcgcgttctttttttatggctgcatggtattctatgatgtgtatgtaccacattttctttatatagtctgacactgatggacatttaggttgattccatgtctttgctatggtgaatacagcagcagcactattcacaataagcaaaaggtagaaacaactgaaaagtccatcaacagataaataaacaattatggtgtatccgtataacagaatattatttcagcattctattaagtgaaagaagccatatacaaaggtcacatattatatgatttcatttctatgaaatattcggaataggtaaatccatacaaacacaaagcagattggtggtggctagggttcagggagaaggtatgtgggaaataggaagtaagtatttaatggtatagaattttatttggggatcatgaaaatgttttgggaccagatagaggcagtggttttacaacagtgtgaatgtactaaatgccactaatttgttgactttaaaatggttaattttatgttatgtgaatttcacctcaatgaaaaaaactcatgtccactgatatgagaaaactggacatagggatgaaggaaaaggagcattaagaatccaaagtcctcatggcagacatgggatcaagatctcaacccattctgtccaaagtttaaagtaactaaaatctgttgagaaggacttaagtggctgtgatgtggttaactagtaggagagaagccaaaaggttgaaagggaaaactgccttcaaagcagaggagtgtattggaactgttgcccaggctcagcagcaggatctggtttgctgctggaggaagcagtccacagggcactgtgtggctgacgttgcaacacctcggcatcaaccacccaggcactgggggacagtggatatgtgcccattcaacaacaaatccattcactctacacataggtattcagcatttccttagtaccaggcatcgttctatactttaggtaagacagaagtggcctttgttttcatgcaacttacgaaacattgagtaaagtacacaaaagagaagaaaagaaaaaagataaattcagataattgatcacagctatgaagaaaagaaggcaatgcaatcttgtatagacgtgattagaggggatgagagatgcaatggtcaaggaagcatctttgaaggagtaatatgttagttgagaactaaatcttcagcatgaggaccggtgtgtgggagtgataccacagcacagcagaagctagtttactaatacagacactttatctcacaattcctaactctatacagagctaagttccatattctgcacacagtgaacacttaacaaatattgatggaggtcagaatgagagggagtgtctagatggcatccacatgtttgtttagtttggttttgctttgcttttgttccacttttgtccataggaagcaagacatttgccctaaaacattgtttcttctactcaaatataactgctaacaaggctcagtatgaaacacatgtattgtacttgttctattgatcaagtggtcagaaagagtttagtcattttcaaacttccttgaaaagcagaactaggaaagtagcacagtagagagaaaagacccctgacctaggaattatgagaccattgttctggtcccaattttcttctaacattccatacaatcataggaaagtcatttcaactatttgcaccttgattttctctaaataatgggaaaaatgaactacataatatctctgaggtcttgttcttgtatatgatatatatgggggcagaggagagtagggctcagagagaaaggtttagctagggcgtcacagacattgatcagacatggggactcgacaatggctgatccgtgtgagtgtttatgtctctgggacatatttgctcttcctgtctttgcattcatgttggcacttttcagattcagctccttttctaaaagctctccctccctctctttacttacgagaatgattgagacccctgttgataaataaaacaagaggttgtgaataaagcaataacacttgaaagctacatcaatttctttttgtctttttctttccaaaaaataaaaatctcatttataagcaaattagctttacacgccacctccctgcacttggggagacagaataaacagatttttctttaaaatggcatcaagacagtacaattctactctgaagaaaatgataaaagcatgcaaatgcccattcaattcaatggtaggaggaggaatttttctatatcttggaaagtaggagaagataatgaggtcagtttggtacaagtaatgtttatgaaacacaatgttattctccttcctataaatacagactgcagatcttattagtcagacttcgtttcctccctttgcaaatgtaaaattttaattgttctaatcccttccctgttgatttcttgctacaattttacacagcagcagatcacctctttattttctcagaaatacattagcacagtgccatagtcctaaatcatatatattttaattgaatgaaggaaaaaaaaaaagaggaaatcaactctgaaattcagggccctaaaaatagtcttctccaaaaggacacacatttactatttggaagctaatgttaattatctttggctttcatgaccaagaaacaaaaatcttgaggttctgtttttagcaatacctacctacaaagaatcaatgtattgatttgagaatactacctatctgtatctaatatcaaaaaaaaaaactcaggaaaaatttttactgcttgaccactgaaagtcaatatctaatatacacttatatactcatgaagggtcattttctataatgtggtacatataaaaaatgcactgactggaattcaaagaactgtcatttcagcccctattcatctgatagctatgtgattccaatcaaatcatttaattgccttaggcctaatctttcccactgaaaacagttgtaaaatagtagaagaatatcttagtaaagcagttttatgtttctacaaaataaaatgttaaatacttcttaataaaaaaactttgtgttttattaaaaatttgtagatagcataaagctgtgctgtacaatacaatagccactagccacatgtggatatttaaatttaaaataattaaaaataaaataaaataaatgcctcagttgtactagccacatttcaagtgctcaaataactacatgttaccggttattactgtaccggacagcacagatatagaacatttctgtaatcataggaagatttatttaatggcactggtatgaagtgacagaaaaagcactatgctttattatctttacaaagcactaaaataaatgtttcagtcattcaactgaatattccaatagacatcaatctatacattaacacccatgggtacagttattcaactagttacaatctatctgctttttaccattaactcacaaactttctccttcttatttatgagaatgtcatgagaaatattatcacattgcttgctgaaatccaagtgcccactgtctgttgtaacagacatctgtaactctgtcaaaagaaatacagaagagaaagttcttctgtcataatcaattattatttgtttatttttagagacaggatcttactctgccacccaggctagagtgcggtggcatgctcacggctcactgcggccttgacttcctgggctcaagcaatcctcctgtctcagcaccctctgggtagcagggactacaggtgtgcatgaccacatgtggctagtttttgtatttttcattgagatagactcttgctttgttggccaggctggtctcaaacttctgggctcaagtgatcctcccacactggccttccaaagtggtgggattataggcatgagccaccatgcccaaccatcacttattattaagcccatgctagtgcctcgtgccattttcctaagcatgcacaaactatccctagaactgcatcccacctgtcagtgccatgctgatcattctcctttcaaataaaaaaaaatcagaattatatatagatgcttcttttctgttttgtgtctcttgtgtcccaggactcctgaaagatcactaacaatagtctagccaattctttgtacccataaatataatttgtgcatcctagataatttttaactcagttaaaagtaggactgtatatgtcagctcttttttcttcatgcttgttctacttattcaagtttaaaaataatatttcttgacagctttatttcttctatgttaatttagcttttcctctttcttctgttagtgatacatcattaggacttccttccttactcttctttctctaaacacaactatacatagaattttgttcatcttgtctttaaaactttttttgcagattttagtacatcttagcctctagaccatctactagactcactacattcatccttagttaataagatttgtttgttaagacctttgattgttagaagcagaagttcccttgagctaacttcagcaacaggagtctaagaaagtaaggatatgcccccaaaacaagggtatgaatacaaccacttttcaggaagaactaaaactggcagtggaaggggtgtcagatttcaaagagggcaaaagtcttactggttgataaacctataatataaggaaagtaaaaaacaagacagttaaattgaaaagatatttgaattcataatcatgaaaagaaataatttttcagtcctgtcactatcaagagtaactcaatgaaagcggcagtagtcttacctactttcaatctaatgtgtactcaaacttaaatctctaatattcttccctgaggtaagtcactgatacttaaaagagggtaaatgattccacatcgtgaagaagaacaaaattacaatagggttagaaatctactgtgaccaaaaagtaaagattgcttccaaggattccagaggacaaaggagcccatttaagaggtctctcactgaccaggttgtgtctatttaagcaaataataactaattgaaacaagttggatgtataaaaggctatgagcccacagtgatgttcaaacaataaaattaccgtaaagctacaaaaatgtagtgataccaacctagagagctgaaatggctaaaaaccaaacccaggatttcatcctgaaagtggttggttacaaagcaaattgtattcccaacctcacagggtgttgtggtggttaatattgggtgtcaacttgatcggaatgaagaatacaaagtattgatcctgggtgtgtctgtgagggtgttgccaaaggagattaacatttgagtcagtgggttgagaaaggcagacccacccttaatttgggcaggcacaatctaattagctgccagtaaggctagaatataagcaggcagaaaaatgtgaaaagagagactagcttagcctcccagcctgcatctttctcttgtgctggatgcttcctgctctcaaatatcggactccaagttcttcagttttggcgcttggactgcctctccttgctcctcagcctgcagacagcctattgtgggaccttgtgattgtgtgagttaatacttaataaacccccctttgtataaatattatatatattccattagttctgttcccctagcaaaccctgactaacacagactttggtaccaggagtatttctagacgaacagaatataaaggatggagttctttcattggttttggggtttctggagttggctgcttaatatgattagacccaaaaatgggaaggactttacttctaacagtatggagaacagtgatagtccttggcatgaactgtttagagacttacacaaaataaatgcatttgacactcctgattcatcgctcatgaaaggcaaggagtttagtgactctatacataatacctttgaccatacgtggagaaccgaggaacataatgaagcaggttagttgctcctaagttcagtggacaaagtgatgaaagaaaatgatgaactcagggattctatctcctggcttcagaagcagatactgagcttcaaatctgctaagattgccctgagtaagattcttatctcctgtagaaaaagctaaagttgtggaaaaacagacaggagctcttatcatgcgagtgactgacctgcaacaaaagttgcacgcacagcctcaccaggtgtctactgttaaagtgagggcattgattggaaaaatattgggccctgaaacttggaatggggatgtgtaggaggaccctgatgaagcaggggacaccgagtttgtaaactctgataaacttttcttgccagaagaaacagcttccctatccccagtagtggcaacatcccctaaccaatccatgctgccatcagcctttccacctttgtctgaggagatcaaccctgcattgcctggggcaacagtgttggcctcccctgaggcagctgccaggcaagataatgtacattctcctcaggagccatccacaacagccctgtttgcttctagacctatcactaaagtaccgacaggcacttagaagttaggttcagagcgtgacccatgaaaaggtgtgctacactcaaaaagaactgcttgagtttatataaattagagtttatataaattagaaattagaaataatttatataaacagaaatctggagaacgggcatgggaatggatagtaagggtgtgggataatggtggaaggaacatagagttggatcaggctgaatgtattaatttgggcccactaagtagggactctgcatttaatgttccagctcaggcagttaaaaaaggttctaatagtttatttgcttggttagctgaaatatggattgaaagatgacctactgtgagtgaattgggaatgcctgatctcccttggtttaatgtaaaggaaaggatccaaaggcttaggcagattgggatggtggagtggattagtcactttagacctactcatcccagctgggaggatacagaagataaaccctcgaccaatgccttgcaaaacagattcgtgagggcagcacttgcatctttgaagagccctgtaattgcccttctctgcatgtcatatctaacggtgggaatgacagtcactcaactacaaaatttaaatacaatgggaagaattggatcccaaggtggcaggggccaaatggtagcactcaactgtcaaaggcatagtgggtgtacctactgtaatggacagcagaggcaaagcagcaatcagaataatctgactaatgtagagttctggcattggctaatcaatcatggcattcctagaagtgaaattggtaagaagcctactgcattcctacttaatttatataagcagaaaacttctagatcaaatggaaaaaaagactaatttgaattataaaagcagtgaatcatggcccctcaatcaattttcagacttgagccagtttacaaacccagaaccccttgaatgaaggggaggccgggttctcttaaggaaggacaccactacaatactgaaaatttatacagtgaatctttctgccatgcttccccaaggagacctccagccgtttaccaggataactgtgcattgggaaagggaaataatcagacatttggggaaatactgaacactggctctgagctgacgctgattccaggggaaacaaaacgtcattgtggtcctccagttaaagtaggggcttatggagcttaggtaattaatggagttttagctcaggtccaacttacactgggtccagtgggtccctggactcatcctgtcatcatttccccagtgtcagaatgcataattggcacaaacatacttagcagttggcagaacccccacattggctccctgtctggtagggtgagggctattacagtaagaaaggccaaatggaagacattagagctgcccctacctagaaaaatagtaaatcaaaaacaatatcgcatcctggaaggactgcagagattagtgccaccatcaaggacttgaaagatgcagaggtgaatgattcccaccacaaccccattcaactctcccatttggcctgtgcagaagacagatggatcttggagaatgacagtggattatcataagcttaaccaactggcgactctgattgcagctgctgtaccagatgtgatttcattgcttgagcaaattaacacatctcctggtacctggtatgcagccattgacttgacaaatgcctttttctccattcctgtccataaggcccaccagaagcaatttgccttcggctagcaaggccagcaatatacgtttactgtcctatctcaggggtatacaaactccctggctttgtatcataatcttattcagaaagaccttgatctctttttgcttctgcaagatatcacagtggaccattacactgatgacattatgctgattggatccagtaagtaagaagtagcaaacacactgaacttattggtgagacatttgtgtgccacaggatgagaaataaatccaactaaaattcggggaacttctacctcagtacaatttttaggggtccagtagtgtggggcctgttgagatatcccctctaggatgaaggataagttgctgtatttgtcccctcctacaaccaagaaagaggcacaatgcctagtgaccctatttggattttggaggcaacacattcctcaattaggtgtatcactctggcccatttatcgagtgatccaaaggctaccagttttgagttgggtccagaacaagagaaggctctacaacaggtccaggctggtttgcaagctgctctgccacttgggccatatgacccaacagatccaatggtgcttgagatgtctgacaggtagggatgctgtttggagcctttggcaggcccccataggtgaatcactgcagagccctgtaggattttggagcaaggccctgccatcttctgcagataactactctccttttgagagacagctcttggcctgttactgggctttgatggaaactgaacatttgactatgcgtcatcaagtcaccatatgacctgaactgcctatcatgaactgggtgttttctgacccatctagccatgaagtgtgtcatgcgcagtaactttccatcatcaaatggaagtggtatattcatgactgggctagagcaggtcatgaaggcacaagtaagttacataaggaattggctcaaatgcccatggtctccatttctgccaccctgcctgctcttccccagcctgcaccaatggcctcatggggagttccctatgatcagttgacagaggaagagaagactaggccctggttctcaaatgggtctgcacaatatgcaagcaccacccaaaagtggacagctgcactactacagcccctttctaggacatccctgaagcacagcagtgaagggaaatcttcccagtgggcagtacttcgagcagtgcacctggttgtgcactttgcatggaagtgcatatggaatggccagatatgcaattacatactgattcatgggctgtagctaatggtttggctggaaggtcagggacttggaagaaacatgattggaaaattggtgacaaagaaatttggggaagaggtacgtggatgaacctctctgagtagtcaaaaactaaaggtattcgtatcccatgtgagtgctcatcaatgggtgacctcagcagaagaggattttaataataaagtggataggatgacccattctggggacaccactcagcctctttccccagccacctctgtcattgcccagtgggaccatgaacaaagtggccatggtggcaaggatggaggttacacatgggctcagcaacatggactttcactcaccaaggccgacctggctacagccagtgctgagtgcccaatttgccaggagcagagaccaacactgagcccttgatatggcaccattcctcagggtgatcagccagctacctggtggcaggttggttatattggacctcttccatcatggaaagggcagaggtttgtccccaccagaataaacacttactccggatatagatatgagttttcctatcccgctcacaatgcttctgtcaaaactaccatccatggactcacagaacgcctcacctaccatcatggtattccacacagcattgtctctgaccaaggcactcactttatggctaaagaagtgcagctgtggactcatgctcatggaattcactggtcctatcatgttccccatcattctgaagcagctagattgatagaacagtggaatggccttttgaagtcacaattacaatgtcaactaggtgacaatactttgcacagctgggtcaaagttctccagaaggccatgtatgctctgaatcaccatccaatatatggtactgtttctcccatagccaggattcatcggtccaggtatcaaggggtgaaagtggaagtggcaccactcaccatcaccccaagtgatccactagcaaaatttttgcttcctgtttccattacattatgttctgctggcctagacgtcttagttcctgggggaggaacgctgccaccaggagacacgattccattaaactggaagttaagattgccacctggacactttgggctcctccgacctttaagtcaacaggctaagaagggagttacagtgttggctgtggtgactgacacagactatcaagaagaaatcagtctactactccacaacggaggtaaggaagagtatgcatggaatacaggagatccattagggcatctcttaacattaccatgccctgtgattaaggtcaataggaaactacagcaccccactccaggatggacgacaaatggcccacacccttcaggaatgaaggttaggttcactccaccaggaaaaaaaccacaacctgcttaggtgcttggtgaaggcaaagggaatacagaatgggtattggaataacgtagtcattaatatcagctatgaccacatgaccagctgcagaaagaggactgtaattgtcatgagtacttccttcttcttttgttaaaaacatgtttgtgcatgtatacacttgtactaagaaaaatcttcattttatttcctttctcctttatcatgtgacataagatttattgatttcacatcagcatttaagaattgttaactttatgtaatagtatttgggttggggattagtgtgtttcgggttgtatgaaggatagttatattaggcataattatgaccttattattgtccttatttgaaaattatgtatgatctcaggagatgtgtatgggttcaagttgacaaggggtgaacttgtgatagttaatactaagtgtcaacttgactggattgaaggatacaaagtattggtcctcagtgtgtctgtgagggtgttgctgaaggagattaacatttgagtcagtgtgctgcaaaaggcagacccacccttaatctgggtgggcacaatctaatcagttgcctgtgcagctagattatatacaggtagaaaaatgtgaaaagagagactggcctagcctttcaccctacatctttctcccgtgctggatgcttcctgcccttgaacatcggactccaatttcttcagttttggaactcagactggctctccttgttcctcagcctccagatggcctattgtaggaccttctgatcatgtgacttaatacttaataaactcccctttatatatgtatatctattctattagttctgtccctctagagaactctgactaatacaggtgtctactgctaaagtgggggcattgactgggaaggaacagtatcattaaaattgggatgggaacacacgggcagactgacgaatctggggatactcagctcctaaattccaatgactcttctctgccactagaaggggcacacacaataataatgggagactttaacaacccactgtcaacattagacagatcaacgagacagaaagttaacaaggatatccaggaattgaactcagctctgcaccacgcagacctaatagacatctacagaactctccaccacatatcaacagaatatacattcctttcagcactacaccacaaatattccaaaattgaccacatagttggaagtaaaacactcctcagcaaatgtaaaagaacagaaattataacaaactctctctcagaccacagtgcaatcaaactagaactcaggattaagaaactcactcaaaaccactcaactacatggaaaacgaacaacctgtccctgaatgactactgggtacataacaaaatgaaggcagaaataaagatgttctttgaatccaatgagaacaaagatacaacataccagaatctctgggacacattcaaagcagtgtgtagagggaaatttatagcactaaatgcccacaagagaaagcaggaaagatctaaaattgacaccctaacatcacaattaaaagaactagagaagcaagagcaaacacattcaaaagcagaaggcagaaggcaagaaattactaagatcagagcagaactgaaggaaatagagacacaaaaaacccttcaaaaaattaacgaatccaggagctggttttttgaaaagatcaacaaaattgatagtccactagcaagactaataaagaagaaaagggagaagaatcaaatagtggcaataaaaaatgataaagggggtatcaccaccgatcccacagaaatacaaactaccatcagagaatactataaacacctctacacaaataaactagaaaatctagaagaaatggataaattcttcaacacatacactttcccaagactaaatcaggacgaagttgaatctctgaatagaccaataacaggctctgaaattgtggcaataatcaatagcttaccaaccaataaaagtccaggaccagatggattcacagccgaattctaccagaggtacacggaggagctggtaccatgccttctgaaactattccaatcaatagaaaaagagggaatcctccctaactcatttgatgatgccagcatcatcctgataccaaagcctggcagagacacaacaaaaaaagagaaaatttagaccaatatccttgatgaatattgatgcaaaaatcctcaataaaatactggcaaagtgaatccagcagcacatcaaaaagtttatccaccatgatcaagtgggcttcatccctgggatgcaaggctggttcaacatatgaaaatcaataaatgtaatccagcatataaacagaataaaagacaaaaaccacatgattatctcaatagatgcagaaaaggcctttgacaaaattcaacaacgtttcatgctaaaaactctcaataaattaggtattgatgggatgtatctcaaaataataacagctatctatgacaaacccatagccaatatcatactgaatgagcaaaaactggaagcattccccttgaaaactggcacaagacagggatgccctctgtcaccactccgattccaacatagtgttggaagttctggccagggccatcaggcagaagaaggaaataaagggcattcaattaggaaatgaggaagtcaaattgtccctgttggcagatgacatgattgtatatctagaaaaccccatcatctcagcccaaaatctccttcagctgataagcaacttcagcaacatctcaggatacaaaatcaatgtgcaaaaatcacaagcattcttatataccaataacagacaaacagagagccaaatcatcagtgaactcccgttcacaattgcttcaaagagaataaaatacacaggaatccaacttacatgggatgtgaaggaccttttcaaggagaactgcaaaccactgctcaatgaaataaaagaggatacaaacaaatggaagaacattccatgctcatgagtaggaacaatcaatattgtgaaaatggccatactgcccaaggtaatttatagattcaatgccatccccatcaagctaccaatgactttcttcacagaattggaaaaaactactttaaagttcatacggaaccaaaaaagagcctgcattgccaagacaatcctaagccaaaagaacaaagctggaggcatcatgctacctgacttcatactatactacaaggctacagtaaccaaaacagcatggtactggtaccaaaacagagatatagaccaaaggaatagagccctcagaaataataccacacatctacaaccatctgatctttgacaaacctgagaaaaacaagcaatggggaaaggactccctatttaataaatggtgctgggaaaactggctagccatatgtagaaagctgaaactggatcccttcctcacaccttatacaaaaattaattcaagatggattaaagacttacatgttagacctaaaaccataaaaaccctagaagaaaacctaggcaataccattcaggacataggcatgggcaaggacttcatgtctaaaacatcaaaagcaatggcaacaaaagccaaaattgacaaatgggatctaattaaactaaagagcttccgcacagcaaaagaaactaccatcagagtgaacaggcaacctacaacatgggagaaaatttttgcaatctactcatctgacaaagggctaatatccagaatctacaatgaactcaaacaaatttacaagaaaaaaacaaacaaccccatcaaaaagtgggcaaaggatatgaacagacacttctccaaagaagacatttatgcagccaaaaaacacatgaaaaaatgctcatcatcactggccatcagagaaatgcaaatcaaaaccacaatgagatactatctcacaccagttagaatggcgatcattaaaaagtcaagaaacaacagatgccggaggggatgtggagaaataggaacacttttacactgttggtgggactgtaaactagttcaaccattgtggaagacagtgtggcgattcctcaaggatctagaactagaaaaaccatttgacccagccatcccaatactgggtatatacccaaaggattataaatcatgctgctataaagacacatgcacatgtatgtttactgaggcactattcacaacagcaaagacttggaaccaacccaaatgtccaaaaatgatagactggattaagaaaatgtggcacatatacaccatggaatactctgcagccataaaaaaggatgagttcacgtcctttgtagggacatggatgaagctggaaaccatcattctcagcaaactattgcaagaacaaaaaaccaaacaccgcatgttctcactcataggtgggaattgaactatgagaacacttggacacagaaagtggaacatcacactctggggcctgttgtggggtggggggaagggggcgggagagcattaggagatatacccaatgtaaacgatgagttaatgggtacagcacaccaacatggcacacgtatacataggtaacaaacctgcacgttgtgcacatgtaccctagaacttaaagtataattaaaaacaaacaaacaaacaagaaatggaagaaaatttcctcaacctgataaagggaatctacaaaaattccacaactaacatcatacttaatgaaagactgaagcttttcctttcacatccagaacaagacagagatgctcattcctaccacttttatttaccactgtactggaggttctagccagagcaactgcgcagaaaaagaaataaatgatccaaattgtaaaagaagaagtacaaccatctctatttgcagatgagataatcttgcatatagtaaacactaataatacacacacacacacacacattattagaactaataagtgagttcagcaaggttgctgaatacaaattcaatatgcaagatttaattgtatttcaatacagtagaaatgaacaatcccaaaataaaattaagaaaactccccatttataatagcatcaaaaaaataaaatacttaggaataaatttaaaaaggtttgggtcttttgcgatgaacatggtagaaataaataaaagacctaagtaaatggaaagataatctgtgtccatggattgcaagacttaatattgttaagacgacaacactacccaaggtgatctacagtttcaacataaatcctatcgaactctgtatagtgaaaagttaacttcactcagaaagaggactgacctttcacctcaactatcagaagctgatctctacatctctgggatgtcctgcctaataggaatatctttgtttgcctgaagatttgaccactggacagtgaacactgtgatttatgatgggggcttttggatattccatgtcaattccaacctccagaggaatcagagactaaacttattagcctgaccttccagaagggactggagactaaaaatcagccacatggacagtatgtgataaagtcttactaaaaactctgaaaaccaaagctcagtgagcttccctagttggcaataccctttgagctttgagtattgtcacacatcacagctaggatgaggtaacgccatccaggactccatgcagagaatatgactataagtttcctatttgggcccctttcagacttcactttatgcaacttttcctttgcctggttctaatttatacctttttgcaataataaaattgtaattatggttatagcgagtatagcactttcctgggttctgtaagtcattctagtgaattactaaatctgaggatggtcatgggaaccctcaaatttgcagccagctgatgcgatgttcttgaggctatttacccatattttttctgtatgctggattttttatatattatgacatagtatggtaatgagcatttcttctcaactccactttcagtgattcatgttggtaccttgaaatcaaccatgcggaaagtatatcacagaaatcagccaatgctatgaatcagagcttaatttattattttcctaataccaaaactattaataatacagattaaacataaaattttattgtattgatagtcattacattgcaaatagtacaaaaagttgaggaaatattctgtcagtttttaaaaattattatccagttcagcaaagaagttactgacatcattgacaaaagagtaaatttccaatatatgtcctcactgtttcagtttcgtatcagtcattattataaatgaaaagatcaaccaacactcatgttagagctagactcattcatcaactgcaaccatagcttggctatggatataagaattcagaaaaaaatcaataatagcattctgtgagaatcaattggcaatatggaatttataataaagagtcatgtatattttattattaagtgtaaattgtgtgctgcacatctttcatgttgataaaatgtataataaacttatatacatgcatgtgtgtgtgtatatatgtataataaacttatatatatgcatgtgtgtgtgtgtatatatatacacacacacacacatttcttaaggggagagccagttgttaatcatttaccagggcacgactgattttagtgttatcttcctgcaggaaagaggactagtcatatggcaaacaattgcatagtaagtctagctgcacaattgcctttaataatttctagagagaagttaggctgacaagtaaaaaaaaaatcccccctttacacttccaggatctccatcttttcttgaaaaatagtatagaccagttctgcaatgattccagcctactctttaagacagactacagagtttatttgggctatttgaacacatgctc

SEQ ID NO: 15 - DNA, 64337 bp, Homo sapiens
ggtgtaattaggatataatgtccttcaaatggcagacttaaagggggaaaaagtcactaagaggtgaccagaagggttagagctgagcaagagaggttcctgccctgagccctgcattttagagtgcctaaggttacatacatacacacacacacgagttaaagaagacatggataccataaccagacacatgagttaaagaagacatggataccataaccaaagacattactaggaaagaaaactaataccaatatcccttttgaatacagaggcaaaaaaaaaaagtactagcaaatgaaatccagcaagatatcaaaagaattatacactgtgatccattgggatttatcccaggaaagcaagattggtttaacatacgaaaatcagtaaatccagtatattaatgggataattcacaaaagataaatacataatcatttccatagacacaaagcatttgacaacctccagtagcctttcatgataaaagcagtgaacagactagaagtaaacaggaacttcttcaacctgagaaaggatatctatgaagacccacagctaacatcatacataatgatgaaagactgaaagctcttatcctaagatatggaacaagaaaatgatctccaagctcaccacttctattcagcattgtactggaggttctagccaggacaattaggcaggtaagaacttaaaactcagggccgggttcagtggctcatgcctgtaatcccagcactttgggaggccaaagcagacagatcacctgaggtcaggagttcaagaccagcctggccaatatggcaaaaccctgtccatactaaaactacaaaaataagctgggcatagtggcacacacctgtaatcccagctactcctgaggctgaggcaggagaatcatttgaacctggggtggaggttacagcgagctgagattacaccactgcactccagtccaggtgacagagtgagactgcctctcaaaaaaacacaaaaaaagccgtaaaaataataagacaaatgacccaatttaaacatgggcaaaaggtctgaatagacatcaaaaataaacatgaatgtgaaaatgtgctcaacatcatttgtcatcagggaattgcaatttaaaactataagttatcccttagcacccactaggatggtagaaagcgaaaacactaaaaatgccaaaagatggcaaggatgtggagcaacaggaactcttcattgttcattgaaatgtgacatggtacagcctctttagaagacagtttggtgggctcttaaaagagctaggcatagccttagcattgatccagcaatcatgctcctgttaccaaaatgacagggggttcagtcctgctgctcaccacacagaatgtcaatcactgagacaatgaatgttgccatgaaagaagtatttcactgggtgctgcagccaaggagaatgggagataaagtctcaaatccctgaccaactacaactggggaggcttacatagtgagggaaggaattaaggggggtaaagaagcaattatgatgaatgagggggtctggcatcttatttcgatgtggtgatctggtgagtttaagtcccttgcctgaggatcagttccctgagggaggaactcagatgagacaaatgtaaatttcaagttttaagacctgaagggtcaatttccatgtgtgttccaaaacttttaaatgtcatttctatgggacagttggaacagtttcacttctaggtatttactgatttgaaaacttgtccacataaaaacagcacacacgtgttcataacaaggttataattggttaaaacttgaagcaacacacatttcttcaataagtgaatggataaacaaactggtacatccatatgatggaatactattcaacaataaagaaatgagctatcgagccacagaaagtcctgtatgaaccttaaatgcatactgttaagtgagagaagtcattctgaacaggctgcatactatatgagtccaactatatgacactctggaaaagacaaaacaatagagaataaaaatgtcagtggttgccagagtttgaggagagggaggaatgaataggtgaagcacaggagttttttagggcaatgaaacaattctgtatgatactgtgatggtgtatacatgacattgtgtatttgtgaaaacatatagaactttactgcacaaagggtcaaaattttatgtaaacaattttaatcatttaagaagtcagggaatcacaggaatgcagactgtgacaagagaacataactattagtacaaatgtaggaaacaaactcaaaagagtaggggtgaaaggtgctgatctaagtaactttggaaattactgaagtttgtaagactaaaggcaaaaggaactgcaagtaagcagttcctagttgatacaagttgtttcccatgggggttatagggaagcttaaacattccctctggaggtttgataattaagtctgctgaaatgaactgacaataaacagattaagaagagaaagaccattttaattacatacatgcaaatggaagcctcagaaaaatatgagactcaaaggaggaggcagatggttgaaggtttcatagcataaaatgaataggggcttgaaggggaggtgatgacagttatgagaggaaaaggagaggaactgcatggtgaacaaagattgtcttatgtaaataaagtctctcaggtcataaaagttgtttaggagttttttattgctgctgaagaataggcaatagcctgttttggtgtggtgacaacttttaatctcctctggtgataaatctttcctggttgtttgatgaaattcctagggaggagtctcaacacaaatgtattccttttggaagaacttccctcagtcagagaagggaacttcaggagagcccctccctgcacttatgggagtagggtgagaaacaagagaaagccagacaggcctccatgggggcagcttctaaggcctttcaatttcctttaattctaagtgctcagcatgttaaaggaccatacgttggggtatcattttctgagccttaacaggatataattctgatattaacaactctgctattgccttacatgtatactggaattaaacaaattgatggcagatcgtgggagccaggtttctcactgttggattgggaatttacatttaagcaaaggaaggatgatccatgtggtaatggatcaattggagacatcagcatgaactcacatttagcttagtatagatacagaaggttacatatagaaatatttctagattacagttagtatattacagttagtatgcacacatatatttcctttctttgtcagctcagacagcctagaagcaatgatgctccagtagcaaggagcacatttagcacccagatcttgatttttataccattctccaacaacaaaaaaacagggttctttggagaaatggctaattctgctactaaagaaggaaatcaacaagctgagactggagcatcttgtagtgccagaaagtaaggaaatgctaaaaaaaaaaaaaaaaaaaaaaagaaaaagaaagaaacctacattgatgggggtgtcaaaggagtatagaaacaaattgtaaaagctcccagtgaccaaatctggaataatttgagcaagataataaataaagtagtactggattataaaacaaaatataaaaatctgagtccatactgatataaataaatgattgaatcaataaataaatggggtaaagacaaatctaactttgcataagaattctaaataacttatgtagctatttctgcccacgaaaagggggaccataaattcctactcctttagtgtaagctatacatagtgacttcctcccaaagagtgtagaatggaaagttgagggtggaggaaagggaggggagcagagtaactttactctggggaaacttgacaaatgacctcagctaggtgatcaaggtcaatatgaacagtcataaatcatgttggtagtatatgccattgacaggatgtgataaagatggtacattaactctgtggtcttgctccccaaacccataacccaagactaatcatgaggaaaagaatcagataaatttaaatacagggtcatctacaaaatacttgaacattattcctcaaggtcttggaaaacaagaaaagtctaagaaattgtcacaaccaagaggagtcaaagaagacatgatatgtaactgtaatgtggtgtcctggatgagatactagaaccaaaacagacaggtaaaactaaaaatctgaatcaactatggtctttagttaatgatgtatcaatattggttcttaattgtaacaaatgtatcataatgtaatgatatgtataatatcataggtatgtatcaatacataataatatatattgatatgtataataatgtaatataaatgtaccataactaatgttagtaataggggaaactggctatgggatatataggacctttctgtattatcttctcaatttttatgaaaatctaaaactattccatgaaagtctacggtaaatgaaaatgtgccaatgccagaaatggtggtgcatgcctgcatgccttcagtccaagctacttaggggtctgaagcaggaggatcccttgaccctaggagctcaaggctgcagtgagctatgatcctaccactgcacttcagcctgggtgaaagagggagacctgcctataaaaaaaaaaaaagaaagaaaaaagacagacaattataagcattgacaaggatgtggagaaagtggaagcctcatatattggttggttggttgcaaaattgtgcaactactctaaagcagtttggcagtttctcaaagctcacatacaattaccacatgtcccagtaactcccctggcatggatccaatagaattgaaaacatgtctacaaaaagtgtatgcacatccagcctggatgacacagcaagatgctgtcttaaaaaaaagtatgcacaaatgttcatatagcattattcataacaacaaaaaagtggacacaacccaaatattcattagccgatgaatgaataaacaaaatatagtatccatacagtgaaatattatttagccataaaagtatgcacaaatattcatataacgttattcataatagcaaaaaaaagtaggcacaacccaaatatccattagctgatggatgaataaacaacatgtagtatccatgcaatggaatattgtttggtcataatattatttggccattccataaaaaggaatgaaataccaaaaaatgcccttgatatggatgacccttgaaaacattatgttaagtgacagaaaccggacacaacaggtcacatttgtggtattctgtttacatgaactatctggaataggcaactccatacagatacaaagtagattagtggttgccagggccgggagcaggaaggagtatagggattgactgctaacaccaacaagtacatggtttcttttgggggtaatgcaacattctagaattagttgtgatggttgcacaacttgtgactacactaaaaagcattttaattaggtggattttatggtatgtgaattgtatctccttaaagatattataagaaaaagaagaaaaggaaggaagaggagaaagagaaggaggagcagcagaagaatgaggaggaggacaacaaccacctggtacctctggtttagaaactggtaacttgtgactctgaacatttgtttctgggaagaatgctttaggccccaggaaaatgctactccacttactttctgtcctcaaaaacaaaacataactgtgcctaatgctctgggttgggccattaccaccatcagagagtgacacagctttggggtgcagggagaatgtggacagaagtgctcagtcagatagataagagatagattaattaacctgacagctcttcctctcagcataaatgtaacagattcatgaataacaatgtacagttttcaattcctattacttagaattccaattcctattacttttaaatctgtgtacgtgtaagtctagaaatttgatactggttctttatattactgtatagatttagcagatgatgaaaaagacagcataagtgatagcttatgtgatgaaattaagattttttgttttctgcaataataatttaccaaatgtggccccattagaatgtttgaacatgatacatacatttcatggtttgttttcaactctgtctcagcagagtgacgctttctcaaattgaaattaattaaaaaaaaaatgtcaaagacctacactgactgaagaaagatggcctcatttggtatcattgttaatagaataccaactatgtgaaaatcttttttataatatagaccaaaaagtgactgaggcaggtctcaatcaatgagaggtttattttgccaaggttgaggatgtgccaaggaaaaccataaatcacaagagcatctgtgacctatgagttttctaaagaggatttcgtgaacttgaatatttaaaggggaaaacgtaagcaggagaggggacaaaaagaggtgggagtgagcatgagcagtgaggtagatggttagattcttgtgaggctctgattagcttcactaaatctacattttacatgtgaaaagtgggaggagaggaaaaagtcgattatgcattgtctcatgctcagtaaatctacatttttacatcagatgaagtaaacatgtgaaaagagggagtagaggaaataaggctgacatggggttgtgaaattacagttatctgtttgggctcaaaagaaatacagtattgatcgattaccaagttaatttcccaagctcaactttgcctttggcatagtgagtttgggggccctgcaattctatttttcttttacatttcccccctgtattatcccattttcatgctgctgataaagacatacccaaaactgggtaatttataaagaaaaagaggtttaatggactcacaatttcacttggctgggaaggcttcacaatcatgttgaaaggtgaaaggcacaccttacacagcagcagacaagaaagagtttgtgcaggaaaactctcccttacaaaaccatcagatctcatgaaacttattgactatcacaagatcagcatggaaaagacccagccccataattcaattacctcccaccaggtccctcccatgacaaatgggaattgtgggtgctaaaattcaaaatgagatttgggtagggacacagccaaaccatatcacccctgttcttcaaaatatttcaaagaaagtactgtagaagaaaataaatcatcactagaatgatttattcctagaaggctagtatccacatggctaggaaggctcatttctaagatgtcatgaagtctcataccccacagagaaagatagggggagaaaggaagaaagaaaaaaaagaccaaaaacagaaagagaaaagggaccaaggacaaattgtagcagcaaagggaaagcaattctggaaaaccaattcagcctgtactactgagaagtccatacatcagtggcaggcacgaaggtggcatatatgtatgtgtgtgtgtgtgtatatatgtgtgtgtctgtgtgtgtatatatatatatatgtatgtatatatctgtgtgtatatatgtgtacacacacacacacacacacacatatatgcataggttgctgttatttctactgaattttaaggtgtctaagtgcagtctggagggctttaaggaaagcacagttttagtttctagtgattccaactcagaaaaatgggataaaaaaattgattaatgttagtttggaaacatgtagtcaagaaagaattcagaatccagtccaaataaattgtagacaaataataaaaactgaaaaaaaaatgaataaagctagaatctaacaggtatactatagtgaactcagctcactacaacctcctcctcctgggttcaagcaattttcctgcctcagcctccaaagtagcggagactacaggcatgcaccaccatgcctggctgatttctgtatttttagttgaaacagggtttcaccatgttggctaggctggtcttgaactcctgacctcaggtgatcctcccactttggcctcccaaagtgctgggattacaggcgtgagccacagtgcccagctatcttttgaaacataacttttttctctcaatcctttatttttaccaaagacaagtcacagaaagaccaatttatttgcaaaaagttttagtctcattatacttggcctgattagttgcataaagtacagcaagaataattattggccaataggctttttttaaattggctttgctggaactttttcataaggaatctcagattagacttttaaagctttctcaagcacagccaagaatttgtctgtgcctgcagatacctgtctcaattcctctcttcttgaggtcccaaaataaatgagattcctgggcctgtcagaaaatgacattctctacttaccacaggtcaataaccctataaaggaatttcataaacaatgtacaaggccagtttttccaagggtttttttttttttgagatagatcctcactctgttgcccaggctggaatgaagtgacatgatctcagctcactgcaactgctacctcctggattcaagcaatactcatgcctcagcttcctgagtagctcggactacagatgcatgccaccataaccagataattttttttgtatttttagtagagatgtggttttgccatgttgcccaggctggtctcaaactcctgagctcaggtgatctgcctgcctcatcctcccaaactgctgggattacagacataagccaccatgcccagcctccaaggggcttttattggctctctaacatcatctcaatttctcaaagcattctggtcatatctgaaaatatgccatgccagtcaaagctttggtaaaataaccagtgtctccaattatagcctattccaaaagaaaacagattcttgctgaacttatgcaaataactatattgttataagttaagaatacttacaaatagtttctaaattctggagaaatcaggtagagaaaaggaaatatgcttcaaatttggctcacaagggtatactttacaaaactgttaaaagctaaaaatagatcgatttttttcttgaccaaaaaaacacaaaaatatcagcaatgtttcaaacaaaaaagtcatagaaacattatttcagtcctctattagttcagtcccatgcaattaactcattccatttgattggggttagcaagcctcatgaacacattagctctccagtgagaatcctggaaattttctctctagcctaatggcacaatgtctaaaattatctgaaatctgcctttaatagcacccagaagagtcttttccataaatttcccaaaaaaagcaagttgttgttgttgttgttttctgtagccgactataaacagctttttgggaagaatcaaagtaaaacaataattgtctgtggatgacaaaagtcgtaggacagtcatggttaaaaacacaattgtcaaggaaatttggttatctttttggtatgtaacaatttaacataatataattatagctgataacattaagacagcagaattataggaatcttatacaattttggaacacatattaataacatataaaatataacccaaagaaagttaaacaccatttcatatttgacatctcttgtataatttttaacatagcaaataagctcaatatgtctcctttggacttaaggggacctaatatctaaaaaagttaatgagataaaaaagaatttagaacttgaaattttgattttggaaaatgtgttaaatatcaaagatttaaaacacttgatatcacaaaataggtacacaggtcactgtaaaataagtcattagtttagccaaatgataattcaaggattttaaaagcaaaaaccactgcactcagcagctcacacttgtaatctcaacactttgggaagccaaagtcagaggatcactcgagtctaggaattcaagaccagcttgtgctacatagtgaggccctccctgtacaaaaaaaaattaaaaattagctgggtgtgatggcgggtgcctgtagtccaaggtacttaggaggctgaggtgggaggattgtgtgagtctgtaggttcaggctgtgatcagccatgattgtgacactgtacattccagcctgggtgaccaacaagaccctgtctcaaaataaataaatataaatttaaaaaataaatgaataaaaatatttattaaataaattaagcaaaaacttttactgttttatggagaggagactcagtttcccaaacaatacaatcaaaataagatagcgtattagtcagttctcatgctgctaataaagacatgcctgagactaaataatttataaagaaaaagaggtttaatggactcacagttccacatggctggggaggcctcacaatcatggctgaaggcaaaggaggagcatgcacatcttacatggtggcaggcaagagaacttgtgcaaataaaatcatcagatctcatgagacttgttcactaccacgagaacagtatgggggaaactgcctccatgattcaattttctccacttggtcccgcccttaacacattgggattattataattcaaggtgagatttgggtggggacatagtcaaaccatatcattctgcccctcacccctaccaaatctcacgtcctcacatttcaaaaccagtcatgccttcccaacagttccccaaagtctttaatcattccagcattaacccaaaagtccaaatccaaagtctcatctgagacaaggcaagtccctttcacctatgagcctgtaaaattaaaagcaagatagctacttcctagatacaatgggggtacaggcattgggtaaatacactcattccaaatgggagagattggccaaaatgaaggggctacaggctccatgcaagtctgaaatccagcagggcagccaaatcttaaagctccaaaatgatctcatttgacttcatgtctcacatccaggtcatgctgatgcaagaggtgggttcacatggtcttgggcatctctgcctctgtggctttgcagggtacagcccttctcctggctgctttaacaggctggtattgtctgtggcttttccaggtgcatggtgcaagctgttggtggatctaccattctggggtctggaggacggtggccctcttctcacagctccactaggcagtgccccagtggggactctgtgtggtggctccaaccccacatttcctttccacactgccttatcagaggttctccatgagggctctgcccctgcagcatacttctgcctggacatccaggcatttccgtacatcctctgaaatataggtggaggttcccaaacctcaattcttgacttctgtgtacccacaggctcaaaaccacgtgaaagctgccaatgcttacggtttgcaccctctgaaacaatggcctgagctctatgttggccccttttagccatggctggagtggttgggacacagggcaccaagtctctaggctgcacacagcagcaaggccctgggcccagcccacaaaaccatttttccctcctatgcctccaggtttctgatgggaggggctgccctgaggacttctgatatgccctggagacattttccccattgtcttggcaattaacacttggctcctcattacttatgcaaatttttgcaaccagcttgaatttctccttagaaaatgttttttttttttcctatcacatcatcaggctgctaattttccaaacttttatactctgctttccttctaaacatagttgcaattccaaaccataattttgtgaatatataaaactgaatgcttttaacaatacccaagtcacctcttgaacactttgtatttcttagaaattacttctactagatgccctaaattatctctctcaagttcaaagttctgcaaatctaatgcagggtcaaaatgccactagtctctttgctaatgtgtaacaagagttacctttgctccagttcccaacaagttcctcatctccatctgagaccacctcagcctggactttattgttcatatcactatcagcattttggtcaaagccattcaacaagtctctaggaagttccaaactttcccacaacttcctttcttctgacctctccaaactgttccaacctctgcctgttacccagttccaaagtctcttccacattttttgggtatctttacagcagcaccccactctaccagtaccaatttactgtattagtcagttctcatgctgctaataaagacatgcctgagactgcataatttatacagaaaaaagaggtttaatggattcacagttccacatggctggggaagcctcacaatcatggctgaaggcaaaggaggaccatgcacgtcttacatggtggcaggcaagagagcttgtgcaggggaactcccatttataaaaccatcagatctcacgagacttattcattgccacaagaacagtatgggggaaactgccaccatgaatcagttttctccacttggccccgcccttgacacatgggattattacaattcaaggtgagatttgggtggggacacagccaaaccaaatcagacagcatgaggccagatgaatttgtcactcaactgtctttttttccagctcattcaaaagataaatgttttcttatctcttagtatttcacaaaaatctttttaaaagagaaaagcaaattttaccattacattagtgtattactaatgctgaagccaatttttagtaaaacattgtcaacaaatccatctcaatctcaatcagtttgatcacaaagtaagatttccataagtctttttataacctttttacagttttctattaaagaacaaatcaatgctcctgtaaaactctgttattccaattcaagggcccagactctaatatcaatgtgcttttgatattaatatttactgtatagaaaaagtaaataatcattttaaattttagacaacttaactgcacatacaattcctttcacaaggtcagtcttctacaaaccttctacaatttgcttaaaccttcagttttgtcctgtcatcttactttaggacaaaaatttaccttcttttccaactttttatatttgtgtagttttatctgtcctttttttattcctttaatttaaaaaaaaaaaacctttaaactaggcaaaattactttccttttaacaaaaaccacattttcatgccttctgataacttttcttaaaccaaaaacatgtcctacttcccttatacactttcgatggagaattttttctcttgtatttagtaatttcaattatatacatttattacaatgttaacttttagtaactcttatttttagtgaaaaaccttggaggtaagccgttttaattatgtaccagatgcaaagtccagaacaaaggacaatgcctggagctaggcctagtcatagcctaaaaacttaaatctaaagataaaaggctgggcacagtggctcacgcctgtaatcccagtagtttgggaggctgaagtgggtggatcacctgaggtcaggagttcaagtccagactatgccaacatggtgaaaccctgtctctactaaaaatacaaaatattagcttggcgtggtggcacacacctgtaatcccagccactcaggagtctgaggcaggagaattgcgtgaactcaagaggcggaggttgcagtgagccaagatcgcgccactgcactctagcctaggtaacagagcaagactccatctccaaaaaattaaataaataaataaatctaaagacataagtttatagacaagttaggtatcaaaacaaatcatagaagcaagttttatgccttaaaacatctggtagagatagtatctaatcaatagactcagacaaaatgtctaaattaaattctgaagactttttttattttaccaataatttttaaattgtcttaatttactaaagattaataaagtcatgtgaactacaaggcatttgaattaaagtttctatttttgtgataacacatttgatttaagcacttccttttttctttaagccaattaattagagcccttttacatattttggtagtgaaacatcacatacacacaacacgtataaacacacagacccatagacagtagcagatcttatatatttataagattcttcatttgccagttctcaaaatctcacctccactttagactatcagtctcttgattacctgtttcctgccctaaacaattgtcagctaggcaaccctaaatttacatttctaaagggacagctcttatgtgaaacaaggtagaaaatttatatctcaaagcacagagctaaggcattaggcctaaatattgtaacatcatttgctcaaaccaaaggggttttaaagggtgtaagtaaaagttcaattaagagaccaggaaaaccaccttaagcaaagtatgacttgtcacattaaaacaatggtaaatgtttctagtgtataccggcagacacccttacaaaatgggaattttcttaaagatgtttcttttacaaaggagtttaaagatagccagctaaatgcctgaaagttgtattttggaattttggcttagcttgttttcttaattagattactggcttcatggtgatacagacagaagacagggaaatactgggtagaagagagcagttccctggtaaaggtcccaccctcaagcctggatacctgcggccctaagtgagaacaggcattcctgttttagtactcgaaaagttgccttttggcccaccatgccgcctatcctgtacccatataaaccctaaacccctggctccaggaggcaacaagcagacaaatggtagaacagtgcagcagagaagaaaagaaacattgggaggagtttggctggggagaatcggccactggatggccaaactccaggggaagattatcttcacactccatcccctatccagctccccatccatcctgctgagagccacctccaaccctaataaaaccccacattcaccatccttcaagtttgtgtgtgacctgattcttccaggacactggacaagagctcgggatacaggaagctgtcacacttgccctctgcccttgcagaaaggcagagggtccactgagctggttaacatttaagccatccacagatggcaaggctaaaagagcacactgtaacatatgcccatttcagctcctgcacctgtctgtctgcatgttccccctcccataagggggcttcgagcagcggtggtgaccaaacaggcatgccacatccatgttacacatcctcaggggggtgtcagggaactcactctcccgcctcatcgggtggaaccatttagtgaatacagaaaggaaagcatgcaatttttagggcctaatatttaaatatgtgagaagcaggtatagctggaaagcaaaacacaggtcccccaaaatttcaaggatcccattttttataccaaatactgggtccccaaaaagaagcaaaagccatgggacaagacagtacaatgcttccacagtgcacctcactgcaaggacattccttcaagtctgatggacaactcaaccccaatcagcccattttgtgatcggcccatatcctatgggatgaggactcagagcaatgaagatcgcaaagaagaaggaggaatagtgtggagtaaatataaacaggagaacaatttttttttaaagaaagccaacaaagatactaagcacataattttttttttttttaagttttagccagccaggcatagtggctcacacttgtaatcccagcacttttagaggctggggtggggggactgcttgagaccagaagtttagaaccaacctgaacaatacagtgagaccccatctctacaaaaatatttaaaaagtagccagatgtggtggtgcacacctgtagtatcagctactgaggagctgaggtgggcagatcacttgagcccagaagagcatggctacagtgagccctggttgtgccactgcactctaacctgggcaacaaagcaagacccatctttaaaaaaaaaagtttaagtcaactaaaaaaaaaaattccaaaaaacaggaaacaaaaggtgttgaaagcataaaggctagatatcagcttctaattaaattgacttctaaccatagagctctctaaaaaaatcctttcagatcttttgttaccagattttagctgggacaaacggttgatttttttgcttttgaacttcttttgcaaaggtatcttccccagtgtttcaaccaaggttataacaaccacagacacatgagatgtctccaaagaggtggcaagcagttttttacaagatctagaatcaccccaaagacagctcagagaaggaaaatttcactatccataaagagggtatagaccacatttctttcaggacatgttctctaggatcttagcttctcaactgactgtccacacacaaaggctcaaaagccttgtgtgaccccaaacagacagaagaaaacaggaaatcaaaagcttcccaaggaaagggaatggatcaataataagttggtaccctaaaagacattcacacaagtatcaaaccaagaggggtgggttccctgaccaggaatcaaacccatgcagtggaggtaaaactgcagaattttaactattaggccacaaggtggagtagcctttgttgttcccagattaggaaacgaactcaagccctgatgggaattttaactaccagaactattttaggtcagacttttttgcacctattttagtcaagagaacttttttaggctagcctttgtcctgtaaaacagtttatctttttcattaattgcttaatataagagatcactaaaatctttaacagcacagagagagaggctgggaaggcagtcttacgtaaataaaacctctcaggtagtcaaattttgatttttcttaaccagccagggattttagaggtaaaatttgtctttcggcagctgcagggatttcagttgacataagaggggaccagaagttggtcaaatctaacaaaagatggactgaaacaaacaaacaaaaacagaaaaaagtgatctctgcctgcagcctagccatcctcccacccattcctcacaatgcattttccacctttaaactcttcaatgacttctcatcactctcaggatgaaagatgatgcccaaacttaacaagaccagaccaccctacctacctcttcacctcatctcttaaaatttacatatagcctagatctctgattataaggagaagtgatagccagctgacaattaactttgacctacagctaccaaataccaaaatgaatccccaaatcagcctcttacctggagatggggtctaagctaaaggctactctccaccatcacggaagtgggaaactcatcttccttgctgaaagtaaactaaactcccataaaggagttctgcagcagaattaacctcatctcaactgaaaatttgggcgaggtcagggacctctgaagggagaagctcccagacctcagcaaatcatcccaatagtcatagaaataaaaatagccccagctggccaggcacagtggctcacacctgtaatcccagcactttgggaggccaaggcggacagatcacgaggtcaggagtacaagaccagcctggccaagagaccagcctagtcaatatggtgaaaccccatctctactaaaaatacaaaaattagcccagtgtggtggcgggcacatgtaatcccagctactcaggaggctgaggcaggagaattgcttgaatccaggaggcagaggttgcaatgaactgaagatcatgccattgcactccagcctggacaactgagtgagattccaactcaaaaaaaaaaaaaaaaaaaacagaaaaaacccccagccagtaccaggcattgataggagagttgttgctggccaagggccaaatctacccggagaatccctctgtagctaccaaaacggaagccaaaaagtgactgagggaggtctcaaacgattcaaggttgatttggccaaggttgaggatgtgcccaggaagaaacacaaatcccaggagcatctttgacctatgatttttccaagggagattttgtgaactttagtatttaaaggggaaagagcaagcaaaaaggggaaaaaaggagatgggaggaagggtaggcagtgaggcagatggttacagtcttgtgagggtctgattagcttcactgaatctacattttacatgtgaaaagagggagtgtggaagagtccattgtgtattgtctcgtgctcagtaaatctacattttacataagataaagtaagcatgtgaaaagagggagtagagcaaatgaggctatgacacgggttgtgaaattacagttatctatttgggtacaaaaggaaaaaagtattggtggcttgattcccaagtttaactttccctttggcatagtgagtttgaggtcccgatagtctacttttcttttacaataacaacacaatttatgattttgctgaaaggaagccaagaagaacaaattatatggaaaaatatatgataatttattaatcaggtcattattttattactcatccaaatatcaccagctcagctgaatgcccaggcatgatcaaagataattcaatttagatacatttgatattctgtcaacttttagtcacataaaaaccatagtttcatacatgtttttcattcttgtggttatgaagacactttcatcaatctgggaaaatacaaattacttgatgtactgaataactatctctaccatgtaccactttgctaacttttcttagtcctctggtccagatatattcaatgttccctaatttgtaagggcagccaattgcaaactgctgatcccacgaattccaactctacatgctcttacccttgccttctttgcaaaacactctggattttctttgtcctggtttctcttttagatattgctggcatttcccatattccatctcttatgattcttgtttacatagccactaggcagctaaaacaacaagagagccagcaatatgttctatttctctgtctcttttctgtccctccctccctccctccctccctcctttcttccttccttccttccttacttccttccctccttccctctctccctcactccccctccttttgtttcttcctgtttgctgtcaaccagctatccatcacctccatcaccctactgtccccttgtcattcatcttcctgcagccagctgcccagcctcatcctcactgctacacccctgggaaaacacaaattacttcattactggatgaccatctctaccatgtatcactttgccaacttttgttagtcctctcgtccagacatatttaatgctcccggatttataagggcagccagttacaaactgctaatcccactaattccaaccccacatgcccacaacctctgctcaccatggtacctacctgagcagcccacactctaccctccctccatcccttgaccacttccctcctctttcctaacttgccactacatcaaagcatttgtgcatagtaggtggatacagaaaagtgctttcaaacaaatctaaaacccatttctcctatcctgcattgaacataattgcatctcttcaattaaaattttcatctgccctcaaacagttttacaaagtgggtttgtttttgttgcttattttggaagtgttttcttgccaatctgtatctcctacccaactcttgaaaataaccttgtttccctttcctctcagtaatcacctcacctccctcccagtaaacccccaatcatagacatcctcaactttttcaaggataaaaaatcaagggcagctcaaagattaatcctttatcttcaacagacaccaggcctcccctctatcccaacttgctttgcagaaattgcttccaaatttttgactagttcaaaaattaattttgacaactaaattattgactattttgagtagtaagaatattttagagcttggcacagtggtgcatccctataatcctcactactcaggaaggtgaagcaggcggaggatggcttgagcccagtctctgggagctacaatctgcagggagctacaatcacaccatgcactccagcctggcagacaaagtgagaccctgtctctttattaaaaagaaaaaaaaaaaagatactttaaagtaatatttactatcgtcatccattcaaaaagaaaaggcatcttgacacagggaaggtctcttaaaatctctcagcagttcttaaaataaagtcagtgtggctttatgaacaacatgacaccttatcagcactttggaagtagttctggttgaaccaccttgacaccaaaacaattcattcattcattcacaaacgtttgtcaagaatctagtacatgctaagtggtgggaagttgagtccctgagctcataattcattcaaccaatgttttcgagcatctactgttacattctggagaaatcaggacgcaaagcaattttcattctcaaagaattcatggtctcataagggaaaaaccaaaacaaaatttgaatgacagagtctatgtactaggtctacctagtacctatgtatatctagtacgtagagtctcatatgtatacctagtacagagtctctcacaggtatacctagtacatatgtatacctagtacacagagtctttcattgggtctttgagcccctataatttagtgtgtgtgtgcaaatttggcattcgtgtgattgagttatgtctagctactctatgagactgtaagatcctggcggactgggaccaggtctgtctttgctcaccagagcctcgccagtgctgaatgggtattgctgactgagccaactaatgttagtgtgatgagcctgacgttaactttccaaccaagttcaaactctttatttggggaccttaataccttccacaaactacttcctcagcaatatcccactactccctcctcattctgtgacgtagcccatttctgtggctctcctgttcctaatgggccttaggctatgtttcactcatgctgctttcctctcttgggacacctcccatgtccaatccttccgcccctcccttcatcactgattgacttcttccccatcctctttaaagtctcaacttgtcccattttccttgtgaggtatgccccacagctcagggggtacccaaggaagcagtctctgggaggaaaattggagcacaggaagatcaagagctgctgctaggattcccacctgtggaatggaaggaaaggaagcaggctgggcaaaggaggagttgggctgcaatgaaatctcaacgaagacctcagccaacccgcaggtagctctgaagccaaggcagctttttagggtggctccatgttgtagctgcggacagggtctttagatttctgcatcaaccagtctgttgtagctgcggacagggtctttagatttctgcatcaaccagtcagtggatgtagactgccccctggaaagaggtcttgggtaggaaggctgatagcactctcagcaattagatgaatacatctttcagtccttctaggacatctgggcaatgcacacaacaactgctgtacaaatattcccacatttttgcacccatccaaatcacccagaggctttttgaaacactgactgggccaggcatggtggctcacgcctgtaatcctaacactttgggaggccgaggcaggcagattgcttcagcccaggagttcaagaacagcctaggcaacatggcaaaaccccacctctacaaaaaatgcaaaaattaaccgggtgtggttacacatacctgtggtcccagccactcgggaggctgagaccaggaggatcacttgaagccagaaggtcgaggttgtagtgagccaagatcgcaccactgcactccagcctgggcaacagagtgagaccttgtctcaaaacacacacacacaggcaccaatgtgcacacacacacacacacacaaacacacacacgcactgcttggccccaactccggagttgttaatgtagtagatctggagtagagcctgagtatctgcatttgaaacaagtttccagatgatgctgatgctgctgaatccgggaccacactttgagaaccacttaccacacactgtacccacacaaagcctcaacccacataacttctgaccattcacattgtgcttaccacttgctgcttggtgccatgttatttgtgtcgtcttttcctgagctgcatccttttgtgaatgcagagctctacagactgtgtaatagtttatggtcttcatgaaagtaaatggaaagccactgctggaatctgagctgcatgggatagggtcacatgtatatttcaaaaagatcactttcactacagtgaagagaagtgacttgcgatgggggtgcaaagggatgttgccagagaggactcaggtggagttaggagtttgattctagtagtccaggggagagttaataaataggaggagcttgcactaatgaagatggagaaaaacagagagattcaagggatatttaagaggcaacagtgacaggacctggagatggatcagttgtcggggaagagagatcgtgtgagagcaagaatgactctgcagtttctgctcatgcagctgaatgtgtgttgaagcgccatttcctgaacactggaagagaaacagcttgtagaatatgagggcctcatctacagggcttttacaacttttttgtttttttattcctgaaagtatcaagttgcaaatgttttaaaaagattaacttgctaattgcttcaattttttttcttttttcttcttctacacaaacattgacttttccacacaatatcctttgtgttaggagatatacgtgctgtagcttttgccatcagggagtgcatctttgaagatttgattgtcaaaaactaatttaaagtctcctaagagaacattttctcctgaactgtctgtatcccccaaaaagtaacaaaaaacatcacatgagctggcattattgccagaaagtacatcagcatcttgccagatttgttctcctcagtcacaagttctggccattatgatgacaacattaaaaaaaaagaaaaagaaaaataggagagttggcataaagaagaatatgatcaaacagtgtagacatcatgatacaattcacatacctcctaccatgccggagtggctcttagaaaataatgaccctggtaaactaagggcattttggtttttttaaaaggaattttcaggctttaacttgtaagatttaggactctttctttagttctgctgtgaatgaatacatagcttttctttatttttttttaatctgccaaatggacaaagggttttttgtttccagaatacaatagtgttatatccaatagacatctttttttaaaaaaattccagaattttaagagacttacaaggctacatgcaagagagattttttgacacttgtcatttgaaatagtttaaggtgtgacaagcatttataagtcatttgctattgaacaaagatcaaatggattcactccccatttaaaaaaatttgtatttcttatttacatttaaaaacccctatttctttaccaagacacctataagtggcttgtggcttttgtagctattagacttcttgccttgctcacctagacactgtcacaaaatatcaaacgctatttatgtgtgtgtgtgttttttaactaagaagtcattcatttgaaaatactccaattccagttgcagcttatttgtttataaatagtgccactctaaggacatacaaggcaataagtaataatttatactttagcacgaatccaatttgattataaggatcttacagagattatgggacatgaaagttctaaagctccaagtttatattgaaaaacccacaggttccaacaaagaaagcacatgccagatgtaatctagcaggctaactttaggtcttcaattccaacaaatgtcaaaactcaggtcatttagccaacatttattaagcacttactacataccagctattttgaggtgcttcaacatcatggtaaagctttctgttatcatcgttgttgtttttaaaagttggccaggcgcagtggctcacacctgtaatctcagcactttgggaggccaaggcaggtggatcacttgaggtcaggagttcgagaccaggctgagcaacatggtgaaaccccatctctactaaaaatacaaaaattagctagatgtgatggcacatgcctgtagtcccagctacttgggaggctgaggcataagaatagcttgaacccagaagacaaaggtttcagtgagctgatatcatgcccctgcactccagcctgggcaacagagtgagactctgtctcaaaaaatatataataacaataataattataaaacaaaagtcactcctcagttttatatggctggtttcacatttgaccttcctttactcctggacttcagttacagaattccacagtggaaggtcctcaaagaatgtgcagtgagagttctacaacaggtttatgtcaagggagcattttttcagtcttgttttctcaccaactggcttactattactcgagaaatagagcctaacacagaagcagcaccctaccaatatctgcagtcacagaaccatcaaggtagactcactagtgaccctcaggagcagctgtcctaaagtctccaggcagaattttcctggcaacctctttcctctttctcctacaggagagctcaacattattcaagtcctcattttacagataatgtaactaaagctcccaagggataaaaaagccccacggctcaggggatgtgaatggggactttaaaagtatataatctccagtctcagtttagtcctatgaacccagtcttttagagggagagctcaaataggtacattttgaacaatttcccctgcttctaacacaagccaggcctaggccaaggaccagctctgaggactataacatggagatgggagatgggagagaggaggctgatgagactggataatacataaggtccttggcctacagaacacgattttttaactttcacgagtaagtgaggtcagaagcattctcaaacaagccgtatgtaggaaaggtcaaaattattaactcagtgaggagctccagatcaccaaaccacagggataaaaagagcatggcaattacacacagttaagaggtcactgtagattgtgggcagagaggggagtgcaaacaatttattcctgaagactgatttcattaacagtgagtcacttttgcagactggagtcatttgcatctacagttggaccaattagcataccccagggttgtatttcagccacagaaagcagagaatgctctagaactcaggccagatgaagacctcagtttgatttcattcctctcccctgacaactatgcctgcaccctacagaagaatttctcctatgctgagctaccttggctgttctcaaattagttttagaataaagaagaattgaaatgctgcaaattcactgtgcatggatgtaaattggtaaactagtacgacctttttggagggctgtcaatatccaacacaatttgaaataaccatatgttttgatgcagcagctagactcccaggaatttatctcacagaaatatctgcacaaattggcaaagatataaataggtacaaataggtttattggaaaaaattttaacaatgaaaactgggaataactcacatattcatcagtagggaaatgcttaaataaattaattcagctattttaaaaagacctagacctttatagaactttcacaagatatacaaaataaattaaatgaatagcctttatagtatgactcaattttgttttataaaaaccatatataagttgtgattgacaggccaagatgactgactagaagcagcagcattctgaggctcccatagaagaaaactataataagcatgagaatccttcaccggcaaccaaggtatccaggttctctcatcaaaattgactagaaggctgtcgtgacccacggagagaaggaagagcagtgtggtgtggcggccaccctgagagccacacggggaaggggaacccccattggcatcaggtcagtgcccctcgagggcagagctcccagaaggagtaggcaaccatctttgctgctctccagcctccttgagtgacatctccaggcacaggagcaaatcagacgaataaggcctgaaatgaacccccaccaaattgcagcatccctacagaagagggacctgacttttgaaagaaaaacaagcagaaagtgacaacaacagcatcaacaacaacaaggcccccacaaaagccccatccaagggtcagcagcctcaaagaccaaaactagacaaactcacgaagatgagaatcaatgaaaaatgctgaaaatccaaaaggccagagtgcttgcctcttctcctccaaatgattgcaatgtctctccatcaagggcgcagaactgaatggaggatcagacggatgaattgacagtaggcttcaaaagatgggtaataaaaaattacgatgagctaaaggaacatgttctaacccaatgcaaagaagctaagaaccttgataagaggttagaggaattgataactagaataaccactttagagaggaacataaacaacttgatggagctgaaaaacacagcacaagtacttcgtgaagcatacacaagtgtcaatagccaaatacagcaagcggaagaaaggatataagaattcgaagaccaccttactgaaataagacacacagacaagaatagagaaaaaaagagtgaaaaggaatgaacaaagcctccaagaaatatgggacctcttaaaaagaccaaacctatgattgattggagtaccagaaggagacagggagaatggaaacaagtgggaaaacacacttcagggtattatccaggagaacgtccccaacctagcaagacaggccaacacgcaaattcaagaaatacagagaacactattaagatactccatgagaagatcaacccaagacacataatcgtcagattctccaaggtcgaaatgaaggaaaaaatgttaagggcagccagacagaaaggtcaggttacccacaaagggaagcccatcagactaacagcggatctcttggcagaaactctacaagccagaagacagtgggggccaatattcaacattcttaaagaaaagaattttcaacccagaatctcatatccagccaaactaagcttcaaaagcgaaggagaaataaaatcctttccagacaagcaaatgctgagggatttcattaccaacaggcctgccctgcaagagctcctgaaagaagcattaaatatggaaaagaaaaactggtagcagccactgcaaaaacacaccaaactataaagaccaatgacactacgaagaaactgcatcaactagtgcacaaaataaccacatagtatcatgatgacaggatcaaattcacacacaacaatactaaccttaaatataaatgggctaaataccccagttaaaagacacaggctggcaaattggataaggagtcaagacccatcagcatgctgtattcaggagacccatcttacatgcaaagacacacataggctcaaaataaagggatggaggaaaatttaccaagcaaatggaaagcaaaaaaaaagcaggggttgcaatcctaggctctgacaaaagagactttaaaccaacaaagaccaaaaaagacaaagaagggaatggtaaagggatcaatgcaacaagaagagctaactatcctgaatgtatatgcacccaatacaggagcacccagattcataaaacaaatttttagagatctacaaagagacttagactcccacacaataatagtgggagacttcaacactccactatcagtattagacagatcaacaagacagaagattaacaaggatattcaggacttgaacgcagctctggatcaagtggatctagtagacatctacagaactctctaccccaaattaacagaatatacattcttctcagtgccacatggcacttattctaaaatcggccacataattggaagtaaaacactcctcagtaaatgcaaaagaactgaaatcataacaaacagtctctcagaccacagtgcaatcaaactagaactcaggattaagaaactcactcaaaaccacacaatttcatggaaattgaacaacctgttcctgaatgactcctgggtaaataatgtaattaaggcagatatcaggaagttctttgaaaccaatgagaacaaagagacaatgtaccagaatctctgggacacagctaaaacagagttaagagggaaatttatagcactaaatgcccacatcagaaagctagaaagatctcaaatcgataccctaacatcacaattaaaagagctagagaggcaagagcaagctaatccaaaaaccagcagaagacaagaaataaccgagatcagagaagaactgaagatgagatagagacacaaaaaaaccctcaaaaaaaatcaccaaatccatgagctggttttttgaaaaaattaatagaaagatagaccgctagctaggctaataaagaagaagagagagaagaatcaaatagatgcaataaaaaaatgataaaggggatatcaccactgatccctcagaattacaaactaccatcagagaatactataaacacctctacacaaataaactagaaaatctagaagaaatggataaattcctggacacatacacccaaccaaaactaaaccaggaagaagttgaatccctgaatagaccgataacaagctctgaaattgaggcagtaattaatagcctaccaactaaaaaaagcccaggaccagacagattcacagctggattttaccagaaatacaaagaggagctggtaccattccttctgaaactattccaaacaattgaaaagaaggaactcttccctaactcattttatgaagccaatatcatcctgataccaaaaccgggaagagacactacaaaaaaagaaactttcagcctaacatccctcatgaacatcaatgcaaaaatcctcaataaaagagtggcaaaccgaatccagcagcacatcaaacaacttacccaccacaatcaagtgggcttcatcactgggatgcaagggtggttcaacatacacaaatcaataaacataatccattacataaacagaaccaatgacaaaaccacatgattatctcaatagatgcagaaaaggcctttgataaaattcaacatcccttcatgttaaaaactctcaataaactaggtattgatggaacatatttcaaaataataagagctatttatgtcaaacccacagccaatatcttattgaatgggcaaaagctagaagcattccctttgaaaaccagtacaagacaaggatgccctctctcaccactcttattcaacattgtattggaagttctggccatggcaatcaggcaagagaaagaaataaagggtattcaataggaagagaggaagtcagattgtctctgtttgcaggtgacatgatttcacgtttagaaaactgcatcatctcagccccaaaacttcttgaactgataagaaacttcagcaaagtctcagggtacaaaagtcaacgtgcaaaaatcacaagcattcgtttacaccaacaacaggctaacagagagccaaatcatgaatgaactcccattcacaattgctacaaagagattaaaatacctaggaatacagctaacaagagatgtgaaggacctctccaactacaaagcactgctcaaggaaataagagaggacacaaacaaatggaaaaacattccatcctcatggatgggaagaatcaataccatgaaaatggccatagtgcccaaagtaatttatagattcaatgctattcccatcaaactactgttgacattcttcacagaattagaaaaaactattttaaatttcatatggaaccaaaaaagagcctggatagccaagacaattctgagcgaaaagaacaaagctggaggcatcacactacctgacttcaaactatactacaaggctacagtaaccaaaacagcatggtactggtaccaaaacagacatatagaccaatggagcagaacagagacctcggaagcaataccacacatctacaaccatctgatctttcacaaatctgacaaaaacaagcaatagggaaaggattccctatttaataaatggtgttgggaaaactggctagccatatgcagaaaactgaaagtggaccccttccttacaccttgtacaaacattaactcaagatggattaaagacttaaatgtaaaacccaaaaccataaaaacctcagaagaggccaggcacagtggctcaagcctgtaatcccaacactttaggaggctgaggcgggttgaccacctgagatcaggagtttgaggccagcctgaccaacatgcagaaatgctgtctctactaaaaatacaaaaaaaaaaaaaaattagccaggtgtggtggcacatgcctgtaatcccagctactcgggaggctgaggctggagaatcacttgaacccagaaggcagaggttgcggtgagccaagatcacgccattgcactccagcctgggcaacaagagcgaagcgccgtctcaaacaaacaaacaaacaaaaccctagaagaaaacctaggcaataccattaaggacataggcatggggaaagacttcatgacaaaaatgtgaaaagaaattgcaacaaaagccaaaattgacaaatggaatctaattaaactaaagatcttctgcacagcaaatgaaactgtcatcagagtgaacaagcaatctacagaacaggagacaatttttgcaatctacccatctgacaaaggtctaatatctagaatttacaaggaatttaaacatatttacaagaaaaaaacaaacaaccttatcaaagagtgggtgaaggatatgaacaaacacttctcaagacatttatgcagccaatggacatatgaaaaaaagctcaacatcactgatcatcagagaaatacaatgagataccatttcacgccagtcagaatggcgattattaaaaaatcaagaaacaatagaggctagtgaggctgtggagaagtaggaacgtgtttacattgttggtgggaatgtaaattagttcaaacattgtggaagacagtatggtgattccccaaggatctagaaccagaaataccatttgactcagcaataccattcctggatatatacccaaaggaatataaatcattctactataaagacacacgcacatgtatgctccttgcagcactatttacgatagcaaagacatggaaccaacccaaatgcccatcaatggtagactggataaagaaaatgtggtacatatacaccatggaatactatgcagtcataaaaaggaatgagatcatgccctttgcagggacatggatgaagctggaagccattatcctcagcaaactaacataggaacagaaaaacaaacaccacatgttctcactcacaagtgagagttgaacattgagaacacatccacacagagaggggaacaacacacaccagggccagttgcggggtaggaggtgaagggaaggaagttggaggatgggtcaataggcgcagcaaaccaacacggcacatgtattcctatgtaacaaacctgcacgttctgtacatgcatccggtttttttttttagaagaaataaaaaaaataagttgtatatattacgtattattttcttttttttttttttctgagatggagtctcgctctgtcgcccaggctggagcgcagtggcacgatcttgggtcactgcaacctctgccttccgtgtttgagcaattctcctgcctcagcctcccgagtagctgggattacaggcatgcaccaccacgccaggctaatttttgtattttttttagtattaaaaaatcaccattttttagtatataaaatcaccatgttgttcagggtgttttcaaactcctgacctcgtgatctgcccaccttggcctcccaaagttctgggattacaggcttgagccaccactttctgtgtgtgtatatgcgtgtgtgtgtgtgtgtgtgtgtataattgtgtgtgtataattgtgtgtgtataattgtgtgtatatatattcaatatatatccatatatacatgtagtataaatgtttgtaaatacgtttttaaaagtctggaaagatagactgttgatagtagtcacctattggcatggatatgggagaagaccagaaactcacagaatgaggagcttctatacaaattttatttatgctttgagtttctaattttacctaggtatattaaagctctgataactaaaaaataataaattttcaaagaaacttgataaatagttaaaaatgagataattcttaattaaagcagtagaagttcagaaaatgattacagtaaaaagatgacaaattattccagagctctcttcacctctgcaggtcacattctctatctccttctcttcctcctctttaaaaagctagcaattggaacaaacactttagaataactgtttcacctatggaataaaattttgcaccccctccctttttgctcatacctcctagccttcccaaatccacactacccctaaataaaaggtttgccaactctagagatcatttgtacaacaaaaaaagaaaaaaaaaaatcaaaccaatacaacaaacccaaactggccactagagggagaacatcacacataaaaccactttgagctaccactccacggaaaaccatacccacagacggaggtacaagggttggctccacaagagattgttcaaaggtaaaagctcacaggcaatcatcaatgtgattcagcctttggcttgcctaatatgtcctgaagcaaatagttttattaataaatataaaattacaaatgtgaatatgtttcccatattagtgaggtctccccaccctccctgctctgaatcaaatttttacaaatgttctggaacagaagcaaatgttgagttggaagctgccctgaaactgagtcttaacgaaacaatacccatttttgagcccagccacagagttaggagaagcaagtaagaaactttagcctcgttttacaaagagcaggggatttaatcttatcaaggaagtcctctcatatactttttcagaccgctatttcatgaggatgacgcagcacacttttcctttcattcttcacacactgatctcagtcgtctttatcagccacattctttttatgtatttgtgcctggaacgaatgagctgataatgcaccttttgatcatgttttccagtggatgaatgtgttccatgcacccaagccttcttccacgccgcccctaaaaaaaagtccatttctttagggtaacatcatcattttaaaaaagaagtgacacatgggtggggagggaggtgtgatggaaacacgtctttcaaaaatgtgtagtcgtagcctcggccacttcattaccacattgagaataatttctgcagtgtgactaagcatcaacccttcaagtttggagtggatttaaagcaggtcaaaggtttacactcagatccctctatactgactgctttaaccctcctgccttgattgtaccttttctagaagtacttgcacataattttcaaaatctgaagaagaaatagatttagtaacttgtccaaagtcacaaatctagtaagtggtaggagaagaatttaagcccagacagtctggctccagagcccatgttcttaaccactaatccattccacctcctcactctttgcctttttactcctgcaagctatcccttgccccagtaatctcccgtcttcagtccaccactccccaccccaaactcacaataaaacaatggactcaatgatacagtagagagaacggaagtcacaaaaatggcgtgagtcctggttctgcctcactcaaccgtgtcacctggggcatcttgagtcctagttttctaagtgcacattgggaatattaaccaaaaataaccagttcccccccaaaaactactctgcaaattaaattaggtcatgtacacaaagcctccagtacagtgcctggccctggaaagcaaaccagccaagacaagagaagacatagaacaaccacaatttaccgcacaatgaacacagtctaccaggagaaagtgagctgtttcagaaagtaacactttcaccttcctcaatggctttataatacagccaccatctggggaaagatggctggggacatggcagggtcccaccacaatgtcaccttgagtggaggctgcaatagtcagggaatcttccatgacttgcaccgaatacttgcaaagccctttttgggagacattttatacaaagtgattccaactacaggattgttgagggtagtccatgcatagaattatgttccaaaggatgtaggtccattattgctgcgtgtaaaaaaaaaaaaaaaaaaaaaaagggtgacaaccccatggcagggccatctgtctgtgaaggggccagggaagcaaattcacctctacatttaagaggtctcccaaaacaaacaggaaggaagtgcttctgaacagttaatttaacttgctcttgaggtcatttaaacccaattctttttgaccgtccttagaagagatggagaaaggctgtcattttctcccaagacagattcagtcactgtcagaccttgctcttctcctagatgaacagctctcaggttttttggtttcaggatccctttacactcctagaaatcattgaggaccccacagaatttctgtaatgtgcaatatatctacagacattgaacatattaaaagattgacccaagtatggtggcttacacctgtatcccagaacttcaagagctggaggcaggaggatggcttgaggccgggagcttaagaccagcttgggcaacatagtgagaccctcatctttacattttaagaaaaaattaagattaggaatttttttgagacggaatctcactctgtcgcccaggctggagtacagtggcgtgatctccgctcactgcaaactccgcctcccaggttcacaccattctcctgcctcagcctcccgagtagctgggactacaggcacccgccaccacgcccggctaattttttgtatttttagtagagacggggtttcaccgtgttagccaggatggtctcgatctcctgacctcgtgatccgcccacctcggcctcccaaagtgccgggattacaggcgtgagtcactgcgcccggcctaattttttaacataaaaatatacaagctcatattctgtgagccctcaggctacatatcatacagtctctagaaaactctactgtatactcttagataatttaaaaaacaaacaacatcttaatattattatgaaaatcagtttgactcacaggccccctgaaagggggctggaggtctctggggtctccagaccacacttggagaactgctgagctagataaaacctcctacaacaggttgtagtgagttctgtctgccacatcctgaacccttctacttggacatcatattgattttcatttgtttattttcatttttatgatttttagggacagggtatggctctgtcacccaggctggagtgcagcagtgtgatcatagcaaactcctgaggtcaagcaatcctgccacctcagtcttactcctgagttgctaggactataggactatgctaccatgcccagctaatttttctattttttgtagagatggggtctcactatgttgcctaggctgatcatgaactcctggcctcaagtgatcctcctgccttggcctcccaaagtgctaggattactggcataagccaccctgcccagcccccatcttgatttttaagtctggtaatttatgtagttagaattaaaatcctgaaccagtaatatcaaagaaggattaaataagaagtaagaatgtaaacaatgaggcagaactacccaaacaactattctctaaaactgaaatgcaaattagcactgaagacaccacagaaaaccttgaacaggcagatcaacacagtatgggccaacagactatcctcccttttcgtttttccttctttttaattattgttatgtccacaaatgacttttccattggtattaaacctgctagaggttctttgtgaggtggattcaagaagaaaatacccagagtttcacaatataggtagcgataaccaggtctcactttccccttccgtgagaacttcgtgggacagaccgaccgcgcaggatcaggtatttccaaattcaagtactaacacaagtttggggattaatcatgccagcttttttcttttttaatgtttgatatgggggtcaaggttaagcttttctatgcagtctctttgttctttcttactcttagcccattttgtcctcttctctgtggctgtaactccatggctgcccaggaccatctggtagtaccttcctgctcctttgcttctaatagtcatatttataacaggaacaagtacctaggaagcacttatcccagtatctgggaagcacttatccaagtactttgtgctaagcactttatttttgcattttctcatatctccccacaaccccacaaggtaggtattattattcccattttaccttagaggacattgcttgccttacagtggcacagttacgtatgtggtggtgcagggatatgatcccagacaatcttatcccaaggctctctacccacgatgctaaactgccttttaaagacagtgacgccggacacagtggctcacgcctgtaatcccagcattttgggatgctgaggcaagtggattgcttgagccctggagttcaagaccagcctaggcaacatggaaaaactccatctctacaaaataaaaaataaaaaaaactagctgggcatggtggcatgtgcctgtagtcccagatactcagaaggctgaggtgggggggatcacctgagcctaggaggtagaggctgtagtgagccatgattgcaccactgccctcgggcctggatgacagaggaagattctgtctcagaaaaataaaaataaaagacagtgattgaagagattaaaacgacatccttcccatgtcatttaaaggtaaataaataaaatcttatttggcaaaggtgtagagcagagaaaaattgtggactttgaaaatgcaaccaatggctcttcaccacaggcaccaaagtaaatgtaggtgaaccttttatcagtgccacctgacaaggaaagccttatctctgctcttctgatagtctgttagtggtttcacttttcccctaagtgttcattcacagcttctagcattaccctgttgaggtccaagctaatatgctagaaaagagttgctctgatcagtcttccattcccctcggcaaagaaaacaaggggtttgtcaaatatggcccagacccaagggcgggagagcaatcctatctgaccttcaattactctgaactggaatcgccttcttccctgacaactgtgactaattccaaaggcccaaccagccttctcataatgatgactctggggtcaattactttgggggcagattagaatctgatctgaagctgaaaaattccgcccccttggtactaatcccttgaactttccaatcctaaatagggcaagtttcaggaaagagcatttctcattttacagcctacctgaatattgtctgtaatgattttgcttaatcaaaaaattaattaaactcttgctctaatggtctaaacacaagtcagaggaaggaagttctggccacgtgccaaagctccatctgaggctctcggagttaataatttccatggtgttttaagcatttgaaacaacaaaggctagctttcactaatagcacaactgattctggaaaacctataaaaatgaggcctgctctagggtggtttgtatccagagaattaagttttaacaaataaaattaaatcaacagtcaataaattaaaattttgctattctctgatactaatctgcaaacttagccataagtgctcaagttaatgaaaatgggctgccagtggctctgctgagatcaccgatggctgttaaatggttttccgtggggacagcgtggggacagcgtggggacagaggacaggagtctcataaggcatttctaggcgagatgaggtccctgggcaagccacgaccctttcttacatttatacatttcttgctagtacattacttacttgatcagtcactcttcagaaataaatacatacaattttttttttttgctctgtgaaacgtatcaactcttcataatctaggctgcaaatgcaaactggcaccccgcagatgaaacggggctgcagaagcaatttattaggtcttcacagtgtttgctttttaaaaatattagttggttgccaacattaaaaactcagaaggcttcacacaaaaatgcaaacatccagccagtcctggaaactggataactgagcaactccaggctgacatttctgcagggcagccatggacgagaacagagcagtggcagcacgcttagaacaggcctcgctcatgcccagcctgcttcacctgttcacacgtcttgcctggctctgcacttcctaaatctagtgatttatttagtggcttcaagaactgctacactttccagtgtgttaagctctgaaaaactgagtgcagataaagatgctgcaaagacactgcccaccttaaagtcgactgatggagaaatctacatcccagatcagattttttacttcctttgttcctccatagccagcctgcaggttaactcccttatgagaaatactgctaatggaatgttaatatttgttggaaggaaggagggaaggagggagacagatatgctaaatatttaaaaaagaaaaaataagcccacactaatcccttgcataaaattcctgaagtttcagaacagaaagcactatgtttacggtgttccagaaagcactatgtttacggtggtttttttttttcaagatattcctgaatatggattttaccacatgcaaaaattctgtttgcagcttgaatactgaggacaaaaatgtgatctatttggaaaaggtgattagcaagagaattagaatactggattctcatggatgaaatttcagtcattattttttgtcaatagaattctcagtaaatatagtccctgaaaaatagaatttacccatgcactactttgaagccaccacccccaccacacccctgccccaaccaacttttatttatttatttatttatttatttatttatttatttatttattttgagacggagtttcgctcttgtcacccaagctggagtgcaatggcgcgatctcggctcactgcaacctctgcctcccgacttcaattgattctcctgcctcagcctccaagtagctgggattacaggcatgcaccaacaagcccagctaagttttgtatttttagtagagacggggtttcaccatgttggccaggttagtcatgaactcctgacctcagctgatccacccgcctcggcctcccaaagtgcagggattacaggcatgagccaccgtgcctggccccgaccaactcttactaaaataaatggtagcttccatttctttttttcctcaagggtcatatcgacaattgagatgctctgttcaaaaaaaagtaaaaggtgggggtgaaaagaaaatgcccatattgacacagatctgtactgcattttaagctgtaggttgaaccatgtagtttgaagcatctatgcagcccattttccatgaagaaaaggtccctcctgattaccacccgtatttcccccagcccctgccttcttctaatcacgtttacagctttaaaaaaaaagagatacaccttgcttctcactcaactgtcatgtacagtccaaaaataaagaccgtccaggattcaggactaaagcagacttgaaaacaaaccccaaattccttccatgcttcaatggggcaagaaatgagaattcgaaaccaactctagatgtaagagttcctaaaacaacaacaacaaaaaacaaaacagttttttaatactgcaactggcacatcgaccaaacggtctgctcggctccaactgtttatctaaagcagaaatagctcacaagtgattaataaacagagaatggaggacagtagaatgtggaagtcatgttggatcacatgtggtttaaaacatgttttgaaacaagcaggcacaaaccttctcataattttaaagaaaaccttagcaatatatgaagaccttcaggaaaaaaaaatttaataccatgaaagtgccttcttttagtgcatctagtgatttatttagtggcttcaagaactgctacactttccagtgtgttaagctctgaaaaactgacagtgcagataaagatgctgcaaagacactgcccaccttaaagtcgactgatggagaaatctacatcccagatcagattttttacttttgatggacgtgatctccattagaagcatatgtcctgaaggtcttacaccttggagaagaaagaaggtgcctcaaaacttaaggctgcaaaggatcaactggctgtaatgctggctgcaaatgccagtggagattgaattaggctactggttttgttaggatagttattttgttagtgctgtggtacaatgtacaaagttccttaagttttgagtaatctgcctctaccccaattttccccgtatgcctctatgttttgtgtacaatgtcacagaaagtgaggcttttcaggactacacctatggcattcaaaccgaacttttcttagtcccattttgctggtctgctcgtatgtcactatccaacattataaagtgtagtgactatagctatccatagtttagggtactctttagttggtaacccagacatgtagttcttaaataaacggcttgttaggatgtcattttattgtattcatttttagagacagggtcttgctctgttgcccaggctggagtacagtggcacaatcatagttcactgcagccttgagctcttgggcacaagcgaacctcccacctcagcctctcaagtagctgggactacaggtacacactgccatgcccaactaattttgatttttcattttttgtaaagatggggtctcgctttgttgctgttataactccgtgttcacactgctatgaaggaataccccagactgggtaatttataaagaaaagaggtttaattgactcacagttccacatggctggggaaacttacaatcatggtggaaggcacctcttcacagggtggcaggagagacagtgagtgctgagcaatgggggaaaagccccttgtaaaaccatcagaactagtgagaactcactcactatcacaagaagagcatgggggttactgcccccatgattcaattactcccaccaggtccctcacacaacacctggggattatgggaactacaattcaagatgagatttgggtggggacgcagtcaaaccatctcagttgcccaggctggtctcaagttcctggcctcaaacgatcctctcgcctcgacttcccaaagtgctgggattataggtatgagccaccgtccccaacttaggaattcattttaaatgccttccagtattatgctgctgctagaaatgcaattctaaaaagtacacccaaaacaccaaaaatacttacgcaatgtaacattaacaagacaagaattcaaaatagacacaccataaatataacaatgtaaaaaatatatgcaggcgggaggtaacaagtaaaaacaaactgtactggagtagggtgactttaaaaataaaatctcttatttcctacattaattatttgctaccaatgtttgttcttttttttttttttttttgcctgggattaatcatcagtaggtggaagtttgtagagaaacatttgatatctacaaaatgaaccacaaatgtggctaaacgtgccagctacatgacttttttttttttttctttttttcctgagacaaagtcttgttctcttatccaggctggaatgcaatggcgcgatctcggctcactgcaacctccgccttccaggttcaagcaattctcctggctcagtcctgagtagctgggactacaggcaagtgtcaccactcctggctaaattttattttttgtatttttagtagaaatagggttttggcatgttggccaagctaatctcgaactcctgaccttgagtgatctacccaccttggcctcccaaagtgctggggttacaggtgtgagccactgggcctggcctacatgactgcttttcaagggaattgttttaacatgttaagaggctaagcacaaaagtagcattcaagtgttggttagacacttttgaatattatttgatttaaacatttctttcaaatggcatgcaagaaatggcttaggggttctcaggactgaggaatcaggatgggaacttgataacagggaccttaggttgaaagctattgttctaaaacaaggtgctttcccggcatgggaagcaaatgctgggttttacaagaccacaagtgaggcagtgcctttgacttggcattatctactgtggcaacaagcagcaaggtcatgatagggttactggtggaatagccttgctttttggaacaaaaattcccacaaattacccacatatcaaagttatccattagctaacaaacatgaacgttttctagcaaataaaacacgcatatcacaaagtcctctctttaaaagaaaacataaagaagagaaagagaaaagaagctgatgacggtgaagcctgatttagcagatacgtttattcaacacagtgcatgattcaaagcatcggatattccacagccaacaaggtttcctattccctattacaaaataccggataccctgaatatagctcattcaaggtcctcgttcctttttccctatatctagaattaaacaggtttccccgtttagcgcacatttcacgttcgctgaaggctttggggagagggggaaacagagcttatgactgcccctctgaaccaaaggcacttaatgttaaaagataaagcacagtagagtcaccccacagacattcctatgtgttcaacggctgaacttcagcataccatcaccggccccatgtgggattcatcataacaacgtaaaagacactgatttccttggaaaaacaaagtgcagtacgaatataaaggagtcaccacacccctcttccgaaaataatacataagagaactcttactttacatgattagtatcactcaaggttcacacatggaaaaaatagctaaaaaataatctataataaattctcactatgaagtcacaatagaatctgataccctttttagaactggtgagttggagagacacccagaggtcatgctgtccatcccttcatttgataggggagggcacttgaggcccaggaaggtcaagcgtcggacctggggtctaacccctgtggcagagcctgcgtaggacgcgggcctcctgaagcctagctcagggttccctccactccccttcctctttaaagactctcaaaagtaaaatatggtgatgatctccaaagatgcaccacaccataaagcacatgcactgacccaggtcagcaatttggtctcacaaggcggttcctttggccattgggcaggtatgtaacccacctcagggtgggaattctttgcatgggatcgttcaaagttctgagaaaagcccaatgtaggtcagacacgactgctccttggactggggaagactttccttggttgtcagtccatagtgggcaggcggtcggctgcacagcggaatcccagattcgaagcagagctatcaggtgtgttctggctccgagcagcacagcgatacctgtaacaataagactgtgtagagagaaagagcaaggtaagtgctactgggactctcagctgaaggctctaacccatcagatgcatattgcaccggctgtagacagtgcttccccacaaccctgcctgtatggatacttaacatgtatgctttaaaaagggcagcacattcaagaactaaccacatattttccaacgtccttcaccttataaatgtaacacggatatagtacaaagatgttcagcattagatataacagcaaaaaagaaaaatgtaacaaccaatgattgcctaagtttaggcacatccatataatagaaaagtaagcagccattgaaagtcatgtctttacatagtatttaatgacacaggaagttttcatgataaaatgttaaatgaggccaggcgcactggctcacacctgtaatcccaacattttgggaggctgaaatgggagaactgtttgaggccaggagctcgaggccagcctgggcaacacagcaagatcccatctctacaaaaaattagctgagcatggtggtgtgcacttgtagtcacagctactctagaggttgaagtgggaagatctcttgagcctgggtgtttgaggctgcagtacaccatcactgagccactgtactaaagcctgggtgacagagcaagatcttgtgtccaaaaaaagaaaaaaaaacagttaaaatgaaaaaggcagaatataaaggtgtatatgtggtatgaccacagtgtagataactacatgtgccaagaagaaaagactggaagattccgaatgcaccacaatgtgcacagtagttatccctcaagcaatctgagtttcatgtttcctatatgaaacctattcagtattccaatacaataagaatatatattaatttttgaaattaaaccaagtaataagtgatagatggccactgaaaaaatactaagaacaacactaagacaccatttaatacctaaataatatttatgatattatttattatctaaatcatatttatgatatcatttaatgccagtagatcggcaaaaaattaaacaacaagtctaggaacatcaaacataggaaaggctgtgggacaacattgctttttaaaaatacattgctcttccatttctttgtatcctcttttatttcattgagcagtggtttgtagttctccttgaagaggtccttcacgtcccttgtaaggtggattcctaggtattttattctctttgaagtaattgtgaatgggagttcactcatgatttggctctctgtttgtctgttattggtgtataagattgcttgtgatttttgtacattgatttcgtatcctgagacgttgctgaagttgcttatcagcttaaggagactttgggctgacacaatggggttttctagatatacaatcatgtcatctgcaaacagggacaatttgacttcctcttttcctaattgaataccctttatttccttctcctgcctaatcgccctggccagaacttccaacactatgttgaataggagtggtgagagagggcatccctgtcttgtgccagttttcaaagggaatgcttccagtttttgcccattcagtgtgatattggctgtgggtctgtcatagatagctcttattattttgagatacatcccatcaatacctaatttattgagagtttttagcatgaagggttgttgaattgtgtcaaaggccttttctgcatctattgagataatcatgtggtttttgtctttggttctgtttatatgctggattacatttattcatttgcgtatattgaaccagacttgcatcccagggatgaagcccacttgatcatggtggataagctttttgatgtgctgctggattcggtttgccagtattttattgaggatttttgcatcaatgttcatcaaggatattggtctaaaattctctttcttggttgagtctctgcccggctttggtatcaggatgatgctggcctcatcaaatgagttagggaggattccctctttttctattgattggaatagtttcagaaggaatggtaccagttcctccttgtacctgtggtagaattcggctgtgaatccatctggtcctggactctttttggttggtaagctattgattattgccacaatttcagagcctgttattggtctattcagagattcaacttcttcctggtttagtcttgggagagtgtatgtgtcgaggaatttatccatttcttctagattttctagtttatttgtgtagaggtgtttgtagtattctctgatggtagtttgtatttctgtgggatcggtggtgatatcccctttatcattttttattgggtctatttgattcttctctcttttcttctttattagtcttgctagcggtctatcaattttgttgatcctttcaaaaaaccagctcctggattcattaattttttgaagggttttttgtgtctctatttccttcagttctgctctgattttagttatttcttgccttctgctagcttttgaatgtgtttgctcttgcttttctggttcttttaattgtgatgttagggtatcaattttggatctttcctgctttctcttgtgggcatttagtgctataaatttccctctacacactgctttgaatgtgtcccagagattctggtatgttgtgtctttgttcttgttggtttcaaagaacatctttatttctgccttcatttcattatgtacccagtagtcatttttgttcagtttccatgtagttgagcggttttgagtgagtttcttaatcctgagttctagtttgattgcactgtggtctgagagacagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtctgcttggtgcagagctgagttcaattcctggatatccttgttaactttctgtctcgttgatctgtctaatgttgacagtggggtgttaaagtctcccattattattgtgtgggagtctaagtctctttgtaggtcactcaggatttgctttatgaatctgggtgcttctgtattgggtgcatatatatttaggatagttagctcttgttgttgaattgatccctttatcattatgtaatggccttctttgtctcttttgatctttgttggtttaaagtctgttttatcagagactaggattgcaacccctgcctttttttgttttccgtttgcttggtagatcttcctccatccttttattttgagcctatgtgtgtctctgcacgtgagatgggtttcctgaatacagcacactgatgggtcttgactctttatccaatttgccagtctgtgtcttttaattggagcatttagtccatttacatttaaagttaatattgttatgtgtgaatttgatcctgtcattatgatgttagctggtgattttgctcgttagttgatgcagtttcttcctagtctcgatggtctttacaatttggcatgattttgcagtggctggtaccggttgttcctttccatatttagtgtttccttcaggagctcttttagggcaggcctggtagcaacaaaatctctcagcatttgcttgtctgtaaagtatcttatttctccttcacttatgaagcttagtttggctggatatgaaattctgggttgaaaattcttttctttaagaatgttgaatattggcccccactctcttctggcttgtagagtttctgccgagagatccgctgttagtctgatgggcttcccttcgtgggtaacccgacctttctctctggctgcccttagcattttttccttcatttcaactttggtgaatctgataattatgtgtcttggagttgctcttctcgaggagtatctttgtggtgttctctgtatttcctgaatctgaatgttggcctgccttgttagattggggaagttctcctggataataacctgcagagtgtttccaacttggttccattctccccgtcactttcaggtacacccatcagacgtagatttggtcttttcacatagtcccatatttcttggaggctttgttcatttctttttattcttttttctctaaacttcccttctcgcttcatttcattcatttcatcttccatcactgataccctttcttccagttgattgcatcgactcctgaggcttttgtattcttcacgtagttctcgagccttggctttcagctccatcagctcctttatgcacttctctgtattggttattctagttatacattcgtctaaatttttttcaaagtttttaacttctttgcctttggtttgaatttcctcctgtagctcggagtagttcaatcgtctgaagccttcttctctcaactcgtcaaagtcattctccatccagctttgttccattgctggtgaggaactgcgttcctttggaggaggagaggcgctctgctttttaagagtttccagtttttctgctctgttttttccccatctttggggttttatctacttttggtgtttgatgatggtgatgtacagatgggtttttggtgtggacgtcctttctgtttgttagttttccttctaacagacaggaccctcagctgcaggtctgttggagtttgctagaggtccactccagaccctgtttgcctgggtgtcagcggcggtggctgcagaacagcagatttttgtgaaccgcgaatgctgctgtctgattgttcctctggaagttttgtctcagaggagtacccggccgtgtgaggtgtcagtctgcccctactgggggggtgcctcacagttaggctgctcgggggtcaggggtcagggacccacttgaggaggcagtctgcccattctcagatctccagctgcgtgctgggagaaccactgctctcttcaaagctgtcagacagggacatttaagtctgcagaggttactgctatctttttgtttgtctgtgccctgcccccagaggtggagcctacagaggcagccaggcctccttgagctgtggtgggctccacccatttcgagcttcccagctgcttaggttatactgcccaaggtaatttatagattcaatgccatccccatcaagctaccaatgactttcttcacagaattggaaaaaactactttaaagttcatatggaactaaaaaagagcccgcatcaccaagtcaatcctaagccaaaagaacaaagctggaggcatcacactacctgacttcaaactatactacaaggctacagtaaccaaaacaacatggtactggtaccaaaacagagatatagatcaatggaacagaacagagccctcagaaataacgccgcatgtctacaactgtctgatctttgacaaacctgacaaaaacaagcaatggggaaaggattccctatttaataaatggtgctgggaaacctggctagccatatgtagaaagctgaaactggatcccttccttacaccttatacaaaaattaattcaagatggattaaagacttaaacgttagacctaaagccataaaaactctagaagaaaacctaggcattaccattcaggacataggcatgggcaaggacttcatgtctaaaacaccaaaagtaatggcaacaaaagccaaaattgacaaatgggatctaattaaactaaagagcttctgcacagcaaaagaaactaccatcagagtgaacaggcaacctacaaaatgggagaaaattttcgcaacctactcatctgacaaagggctaatatttagaatctacaatgaagtctaacaaatttacaagaaaaaaacaaacaaccccatgaaaaagtgggcgaaggacatgaacagacacttctcagaagaagacatttgtgcagccaaaagacacatgaaaaaatgctcaccatcactggccatcagagaaatgcaaatcaaaaccacaatgagatatcatctcacaccagttagaatggcaatcattaaaaagtcaggaaacaacaggtgctggagaggatgtggagaaatagagacacttttgcactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcactactcacaatagcaaagacttggaaccaacccaaatgtccaaccatgacagactggattaagaaaatgtggcacatatacaccatggaagagtatcacgactcatgtcttctttcccactgcccaatacacaagccctgcatgcacttgtacacttgcataaacataagagagcctaacgcacatatccctgactacctagcaggtattcagtgattaaccacagattacttcaaaagcctccacatgccaaaaataaccacgcttgaaactcttgtgccctaggattgttctccgatccaaaaaaacggagaataaaaataaactagtcatcctgtgtgccatgagcataaactctgagttggcccagtacagctcaagtccctgcaaactggttaaagaagtttcacaaagcaacatgtggaataactttagaatctgtgcagaagcgataatttggactcagggggaagataagttggcatgcaaaaggtttttttttttttttaaattattctcttttctctcagaaaagtaaaatgcttcttgtctttgtgaaaagtatctcaagttgacacagaaattctttagagcacttctactgtaaaaataaagacagtgctttgtcttctatagatagtgaaatgatagcaaccaattttctcattttccttgtggtcagtgaataatataacattagcaattctcaggtagacaaaaggaagatgaatttaaagtgtgcttgaaataattgataaattgatggcatctcctactatgtgtgatctgcatgcaatggaagctctcaaatgactagaggtgaccatgcaggaagacatagcaaaagcctcattccatgcagggcctactcgtcgggctgctgtgaaacaacagtgctttggtatttctagaatcaagttcctgtggataatccagggccccatgcagccaagcatgtgtagcaaactccacactgcaacaaagatcaggttcagggggagctacacagatgacatgtcattcttgtcccataaacgtacacgcttttttagaaggcaaaaattgatgtggatgagatttccatgatcatggcagtggtcctcggacctcagcatacataagaatggccaatacaggttgcttaaatccatgttcctaggccatacatccagaaactctgattcaggaagtctagtatggggcccaagaacctacttctaacaagcttctaggtgctgctgatgctacaggcccatgggccacactttgagtaacactagtttataggatttagaggggaagttgagaggatagcaaggccagagcctgatcatatcagggcatggtttaattattcactgaatatatgagagcttacaatatgccagatgctattttaggtatgacggatacaatcagaacaagacaaacaagatagctgttatcagggagctgacattcaaaagggaattgtcagacaataaataaaccgatacattcaagatggtttccaggagcagtcacctctgcaggaaggaaaatagggaaagaggactgagagtgactgggtggctactttcgatagggtggtggtctggaaaggcctctctgagaagatcacatgtgggctgagttgcccaaagatctggagcatgagaattccaggcaagagtaatgactggcacaaaggtggttaatgatgtctttggggtaactggcttcctcactaaaacaacaaaggtattagccagcttctaagcaggtcttagaaaccttgtgttcaactgcaggaagatggtaatagccctgccagcatctgaatgtggatatacatttgctacataaatgggaaagttaagaaatctctctggtgatagggcataggacttaggtttttgttgaatggcatatttctacctgtcacttatctcttaaattatatcagaaactattttaaaataagatgatattcatatgccacaaaacctagcatataaccactcaaatgaactgttgggatctgcccaaagcactgggttgaggattctacagctgcgacacaggatagtgaaaagacatatacaagagattattcccagggccatatctgaagaccccggtatatacagaataattccattcttgaaagacaaaaattaagtacacaaaaagtttgctggaatactatcaattgttttctttagaaagcatgatgatcttattttcattttgatctttactatgtattttctaaattttatgctatgaaaatgttttctttgaataatgaaaagtttaaaatcagtgcctctcccttccccaccaccaaaatttagttctttattagatcacagcaatccctgagactgtccattaaccaaaatgacaataaagaattaaaccctaaaaagcaagactcactacaaaagttagtgttgcgaggtcagggccatcacttgagaaaacagtcaattcacacatcattccatttcaaatgcactcattcactcagcaaacatttattaataagtcgtttattttaaattccaactaataaagcacataattaaagaggtaaatggcctcattataaatgtcctcattgctctttcttttttaccaactttatttttagcagcaaaagtggttcttaaggatgtgaggtctttaggtggctgaaaaatgggtcattctattaattaagaacagggaaagtgggaaggacctgttttagtcctatttcattaagatggctaattactgtgtgaaattgatctccatgtctgtgctaagaatgagatcctggacttgggaacaatccatttaagataatgacttaccagccttggggcttcaaagtaaaggggagcagcaatatggtttttatgagagggagactttttggtacaaagggcattttaaagataattgtaactcatgttaaacgaaatcattatagagaatgccacaacagaacagaggtctcaatttcccgtccgttgctcttgccactaacactagaccaactccttttgctcttcatcttggtaggatggtgaggatttccttaatgttgtaggctgagctaaagacccagagggattaatctaacaacatcaacaacaatgagtatttcttgagtacttactatgtgaactgtattactacgtattaattcacttaatcctctcagcaatcctatgagataggcatcattagtatctgcactgtatacatgaggaaaaattgaggcacacagatgttaatagtgtgcctaaggtcacatggtttataaatggtggatccaaggttctagcctattcaatctgattccaaagtctgcacccttaaccagatgacatgttgcctcatagtttttctttctgtgcccccatctccttattgaagctatactttggatagattttcaaaaaattatgaatgatcatcagaatttactttagccaggcaggccgggcatggtggctcatgtctgttatctcagcactttgggaggccaaggcgggaggatcacttaaggtcaggagttcgagaccagcctggccaatttggtgaaaccccatctctacacaaaaattagctgggcgtggtggcacaagcctgtaatcccggctactcaggaagctgaggcaggagaaatgcttgaacctgggaggcggacattgcagtgagcctagatcatgtcactgcactccagcctgggtcacagagtaagattctgtctcaaaaaaaagaatttactttagccaggcaaactggtgttggcccatgatcaaaaataagtcatcatctaaaaaagaaaattttttaaaaaatgaattataacattattctttctttttattgatttttttccttttattgattttcacctatgccatgaacattgcttttgcctgtctagttgggagtttattagttggttccttcttcaaaagagaagaggggaaataatctaattataataaagatgatgctgataggagcaactaacttttactgagcctttaccataagctaagcactgtaccaagaacttatatatgttggttcatttactcctcatcagaaccttataatgggtacaattatattatgttacaaatgtaaaaactgaggcttagaaagattaagtaatttgcccaaggtcacatacctggcaagaaacagatatagaactccaatccagatgtaattccctaatccacatctcaataatttagtaaaagctgttactcttcatctactggaaaggctaagcactctgaaaataattcacaaccgacactatgctattttcctaaccttacagatataaccagactgatgataaagaccaacctaataaacaattcatttgaccaagatcctggaagtgccatttttctatggaaaatcctgtggatcccactcagttctgtcaatctgctattctcctcttctaaaatgttatccccatcacatggaacctgactaaattaaaacaaatccttcaagtaagctaagaaaagataaaaatgcataatatagactttaaatcaaccactaagattataaaacatagagttacaactaataagcataaggagagaaaatggggtgataaaaagtatgtaatcgaaaagaagacaaacagagaacaacaacaggtgagacaaagagaaaaaaaatcaagatggcacatttcaacccaaccatattaaaaaccacattaaaaataaatggtctaaacacccaatgaaaggcagagattatgccaataaatacaataactcaaatgaaatggacaaattccttaaaagatacaaactactagaatgtactcaagaagaagcagataagctgtatagtcctacatctatttaaaaaattaggcctacagtaaaagaaaaaaaaaatgggcatactggctcacacctgtagtcccagccactcaggaggctgaggcaggacaattgcttgagttcagaaattcgaccctgtctctaaattaattaattaatagttaaaactctcggcccaaatgcattcaccaaggaatcctatcaaacatttcaataataacactaattctacataaactcttgcaaaaaaatttaaaataagttaatatttaacaactcaatctatgaagtcagcaataccctgaaaccaaaatcagataaagacattacaagaaaacacagaataaactagattcaaaaatactcataatttttgcaaatcaaatccaaaaatgtataaaaaagataatacatcatgactaagtggaatgatacatatcccaggaatgcaaggatagcttaatatttgaaaatcaatgtaattcaccatatgaacagatagaaaaagcaaaatcatattatcatctcaatagatgcagaaaaagctcccagcaaaatctacatccattgctgataaaaaactctaaaaaattagcaatggaaaaaaactttctcaagctgtaaagggcatgcatctatgaaaaagctattgctaatacatatccaattttgaaaaactgaatgtttattccctaagatcaagaatgaggtatgaaggtctactcttaccattcctattcaaccctatactgaaggttctagccaatgacatacagcaagaaaaagttataaaagggatctagattaaaaaggaagaactgtcgatattcacagatcatatgatcagctatgtagaaaatatgatacaatttacaaaaacattactagaactaataaatgagttttgcaaggttgcaagactcaagatgaacataaaaaatcagtaccatgtaagtgtacttaataaagtatgtaggagtttaaaagatatttttaaagaatctactgggaagcttataaaaatgtagattacaaataagctaaaagttataaaacatgaaagtagatacattcatacgcatggaattaggacagttaatgtcctttacttgcttaaaatgttttttacaagcttctgttaccccatttattcttgatgaaaaatcttctggtcctcaattacttagaaagtaaatggattctgaatttagaaaagtgccatatgccagagacataactggtgacaattaggattttgagatactactgtacaaagagagattcacctgttttccatggaagtctggtttcctggcaagaagatccaggtacatttgtagcaataacttcaaatagagaagcaatctgggattaaagactctgatgtatacgtgaacatgtaaatatattgggaagacctgggacaatgcttttaatttaaaattaaaactaggattttaggccgggcacagtggctgatgcctgtaatcccaacactttgggaagcaaaggcaggaagaatttcctgagcccaaatgttcaagaccagcctaggcaacatggcaagaccccatctctaaaaaaaatttaaaaattagccaagttacttaggaggctgagatgggaggatcgcttgagcccaggaggtcggggctgtagtgagctgtgattgtgccactgcacctcagtctgggtgaagagtgagactctgtctcaaaaaaaaaaaaaaaaaaaaaaaaagatttcatgaaaataaattggtctacatcttattaccaatgtaggtctaaagcatcaattgagctctgctctatgaacttcaacctgaatcactggattaaaaattctaagaaatacagaagatacacatacatacaaactcacatatatacataaaatctagagagatttgctttaggctagtgattcccgaacttggctgtatgttttcatcacctggagagctttaaaaaatgcaatgcccagctcacactgaagaaaaatcaaatcagaatgggggtgagtgaggagccagacatcagtattttatatagatcccagatgattacaatgtggaataaagtttgagaaccactgtttaagacaaaatttgataatgccatcattatcaaattagtaacttaatttggagccattataggtggttttaagtctctaaccacctggactgaataaattcctaggggaagctttgaggcaataacaatctgcaaaatgccatctctgcacagggatagaaagctggagttcaggagacgtgaaaaatatatgactcaaagaaaaaagggaagggatggtattctatttccaaattccttataaaggttatttaggaaacaccaagtcactctaactgatgaagaaagccagctcagacactaaaatcatagcccaaagagaagaaacactctctgggaatgatgcttatttcacaaggcacactttgtacctagaacacgggatgcttccatttcagtatatcacaatctgccctccatacataactctcacctgaatctcaacagaaaatccagaaatgtacaggattctcaaataaattaagggtgtgctttcagacttacatgctggaaaagttatatacacccacccctgtgcagttcgtgggacaacaaaggtctctcaaaggggcaagattcaatagatgaaatttggttgacaataggtcattcacaacctttgttacttgtgttacttttctccatgcttgtaaccaaatttgagatgactgtcctcctttttttctggtttcagtggggttaggtaggcatttgcagaagtgaatgagacatttggggctatcatttacaatggatccataaaactgctatcagaacaagaacggcaaaacagtttagtgacatgacttaccctatggcacatgtaggatccacctttcttcactcggtctttcccagaagggggacctttctacagatgaagaaaaaaggctatgttagaccagaaggcaaagctgccccttacacagtgggagagaatccactttgatccaaccagctctctcatggttgcctaaactctccacatgcatttccacccctaggctttgtatctgtattcgtgggctctcccaaatgctcacctccccaaatcctacccatcttctaaggcccacctcaagtttccactctttggtgaagtcttcgtaactacaggaagcaatcctgtctctaagtccctacagcatttcttgcctagatgactaataagctgcttggctgcacctcttaccatgtcatgatgcaaatttatcctgtgttataactggtttactcatctacactggcaagcctctttgaattgcatggtattttttgaaacaaaaatttttcttgagacagggtctccttctgtcacccaggctggagtgcagtgctgtgatcatagctcactacagccttgaccacctgggctcaagcaatcctccctcctcagcctcccaagtagctagaaccacaggcatgaaccaccatgcccagctaatttttaaaaattattatttgtagagacagggtctcgctatattgcccaggctggtcttgaactactgagctcaagtgaccctcctacctcagcctcccaaagtgctgggattacaggcatgcaacaccatgccaagccagaattatatgtttttataatcccgctgtgtaatacttaataaatagtttgctgattgaatgaaagagtttgcttgttagccttaaaaaaatttaggtgtgctttattaagatataattaatatacagtaaaattcatcctttttaagtgcacagttccagtgagttttgacaaacatatatagtcatgtaaccgctaccacaatcaagacatacaacatggtttatcttgaagaaaaaaaaaaagacacatatacgtactatgaaccaggcacagtttgagcactttacaaatattaactcaggtattctccatccaaccttggaggtaggttaagttactggtaaaataagtggcacagtcaggcagccttgctccagagtccatgctctgaggcactccactgcgctcccacttagagacaagaagtgtaggaaattaggcaatgcttaaaaggaggcaaggaagagcagcgtctaccactgtaataagaattaacatctacacagagccagtataatggcaagacttttttctaggaagggcttcagataaaagttcaaaggaaatgaaaatcctaaagcatcagttgccaagataaaagcctcaacatcaggtaaggcatacacagcatctgagaggtaccaataaataggctctaataagccagaaccgtatcaggggagtctatggggaaagggatttatctcctttttttgttcaaaaagacaattaatcacacacctgtctactatttgctccaaaaacgcaagaggccgggacaaccccactcctatcttagtttttccttctcctgtgacccaaaagcacccttacttaagtggcagaaattaaaagaatcacgttttctccaagcatggctaatgtactttcttgcaaatgtaaaccatgtgggcagaagtgcacattaccttctaagcatttccaggtacagatgctccttagcatgggattaggtcctgtcctgataaatccatcataagttgaaaatattattaagtcaaaaatgcatttaatactcctaacctacccaacatcacagcttagcctagcctaccttaaacatgttcagaacactcatgttagtctgtagttgggcaaatcatctaagaacacaaagcctattttataataaattgtggaatatatcatgtaaattgctgaatactgaactgaaagtggaaaacagaatggttgtatggatacttaaaccacagtttctaccaaaggcatatcacttttgcacaattgtaaactcaaaaaaaatcttaagtcaaaccattgtaagtaggggactgtctgtgcttagaaactatcacagacaaagccattggctattcctccttcaactgcagggctacaatatttccaaggccttaaatgcttaatgtcacattaataaacttttgttaattacaaacaggcacactgcaaacgtgaaaagctacgtgtcaaaataatggctggcagcagttttcttcccaggaatatctagaatctgacaaacactctgagtcagtttattactctataagacaattaccaagaattcactgtagcagcaatgaaagcatttataattgtggaactctcccatgtaatggccacactctcctacactgtttctcgcttaacaattcttgcattacactgctttaggtggttctctgcatgctctgttacaatgtatcaaattgtgattcaagtctctcccagtatctgctagcgtgcaatttagactcctcaagtagatctaggaacaagaaggagttgatttgccaatgggaaggcatgggaacaaaatagttgcctttcatcatcaacttcaatgaactaagtctgcaatcaataactacgacacttatcacagtgacgcaagtagtaatgacagtcatcccaggctgacacaactgtggcacctaacacagtcctcaatttaggtgactgctcagctgcttcttataaataaaactatttttgctagcaaacaacatgataattaactaaaactgtttgaaatgcttgccactttgccaaaaaacagaaaaattactaggagggtgtagtgggttgaagagtgttcccaaaattaatgctcattcacagccctagtgtctgacctgattcggaaataggaactttgcagacttgtaatttttgtaattaatataagatcatattggattagggcgggccctaaatccaatgactggtgtccttataagatgaggagaggatgcacagaggaacacagagaagtctatgtggtgatggaggcagggactggagtgaggcggctacaagccaaggaatgagaaggattcctggaagtcaccaggaaggatcttcccttagagactccagatggggtgtggcacagccagcaccttgatttcagactgctagcctccagaactgtgagaggataaatttctgttgtttcaagacactaagagtgggaggctgaggccaagagatggtcaagagatggaggtcaagagatcaaggtcaagagatggagcccaccctggccaatatggtgaaaccccatctcagctaaaaatacaaaaattaactggtcgtggtggcacacacctatagtcccagctacttgggaggctgaggcaggagaatcacttgaatccgcgaggcggaggttgcagtgagccgagatcgtgccaccgcactccagcctggcaacagagcgagcctccatctcaaaaaaaaaaaaaaaaaaaaaaaaagatactaagtgtggtaatttgctatgcagccctagcagattaatccagagagttggggaagaggggtatctccattcccatttgtgaaagaaaacattaataaatcaaaattaacagtgtctctcatgatcaagtttatgactgcaggctaaaacaacttaagtggctattggtggtggtgtttaaacacctcatctgtttgcctgtataccacagcaggaagagcggctgcagggccctaccacctccacctcctgtgctcaagagtcttggggatgcataagaatccacttggaattaacctagatatccatcagcagtggactggataaagaaaacgtggtacatatacaccatggaatactacacagccataaaaaagaatgactcatgtcctttgcagcaacatgaatggtgctgcaggccattattatcctatgtgaattaacgcaggaacagaaaaccaaataccgcatgttctcacttataaatgggagctaaacattggatatacatggagacaaagaagagaacaatagacactgggacctatttgggcaaggtggagggtgagagaaggatgcggactgaaaaactacatactgaatattatgctgattacctgggtgacaaaattatctacaccaaacccccacggcccacaatttacccatgtaacaaacctgcacatccatcctttgcacttaaaatgaaagttggaaagaaaaacaaagtctcagtggaaaaacatatggaacatagggactccgcctacaaccaggcaggaaccatcgtgaatcctgtctccaaaggtactactgcccgtaactgctctagtcccatagacacgaaaatatcaacatgtctccaatgcttgcatggtcgcaagaacagcaaaacacacaggtttctacataacagtcccaataatctcaaaaggccaaggtacagctaaagttctcgggaaaagtgatgaagaagcaacactcagcattagtgcagagaaatctacccctgtttaaaacacctgggagggcatgtaagtctttaaggatgagttgaatccactggagatgccacagaaccacgtatcagtgagactggcttgtttggaggaggaatgagtctgtaaggaagaggggtagccagcctgctcacggctaccaggacatttttcacagcacaacgactgcactctgtgtagtcaagagacatttccctttccctcgtcatgcccaatacattgacaaggaaagcaacagaagggatggagagtgtgacaaatttccatcactcagcaaacagtcaaaaggcaccactagcgacctggatgggactagagactattattctaagtgtagtaactcaggaatggaaaaccaaacatcatatgttctcactcataagtgggagctaagctacgaggatgcaaaggcataagaatgacacaatggactttggggactcggggaaagggtgggaagggggtgacggataaaaggctacaaatcgggtgcagtgtgcactgctcgggtgggggtgcaccaaaatctcacagatcaccactaaagaacttacccatgtaaccaaacaccacctgttccccaataaccaacggaaattaaaaaaattaaaacaaataataaacatgtcatttgacacaatccatagtaatgaaatgctaagcacccactacaaagaatgaggcacttctgtatgtgtacactttactatcactttttactaagaaaataacagcatcaagcatttattctgacttcctcacacaaactatgcctcaggaaaatagaagagttatgagtgaatgttctttatagaggaattccagataattaatgcagaaagagtaatagaatatcactatgtcaaaaatcttggccaggtgcaatggctcatgcctgtaatcccagcactttgggaggccagtatgggaagattgcttgagcccaggagttcaagaccggccttgggcaacatggtgaaacctcatctctacaaaaaatacaaaaattagccgggcgtggtggggcacgcctgtagtctcagctactcaagaggccgaggcaggagaaccatttgagcttgggaggcaaaggttgcagtgagcagtgactgcgccacagcactacagcctagacaacaggaatgagaaactctgtctcaggaaaacaaacaaacaaacaaaaaaaccttcctcaagaactgaatctaggcaatgagtatcaatggctgctaaaatcagtgagtgaaaggctaatgaagatcctcgtaacggatggttcagactgacaatgcctacttaaatactgatcaatcttattaacaaaaataatcttatcggtgtcacgataaaagccatgcatactat

SEQ ID NO: 16 - DNA, 4477 bp, Homo sapiens
taaaagcagaaggaatggaatttgagtctgaatgcagtataagatgatgttacagcccatcagtcagatgaggattgcagtctgtacatcacagtttgtctacagacctgttttgttagcttgcataggttttttttaatcctaaaaaatttacatataaatatggttctgttttgtatcaaatttttcaggatacttggaccatgcatgttcatgtgacaaaagacagggcccatgttttccagttagctgtggcctctgctgtcccggaagctacagtttctcggcttccttcatctacatttctcatgtggccttgtggatatttgatcaagataaggaaagtgaaatccagagagtgaagtaaagtttattaagatcccaactcattacttacaagctggatttgacccaaaaatttcaaactattagtccagttttattttaatagaccacactatcattcatgggatttggttcatactttttggtagaagatatataatttattattcaacatctatagggcctgatgtgtttggaaaggcagtttttttaactttataaagataatactattcctatatgaacttttatgaaagagtctagcagagtctggtgtagcatctgataattaatatttttaacgtgaaatgtatgaatgttcaccccaagtggcagaaatatagactaggcatagccaccaattcagatcagatttttatatcaaatttcctttttttaaaaaaaatttgtaaacttgtaggatttcagaattgcagataaattgtggatagctataaatatcaatattcttgtgtctgttgctcaggatttttatctataaatgcagatagcagttcctacttcattaaatatttaatactatatgtaaaaaacagtgcctagagcatagtaaaatctgtagaagtaatgggtattgttactattttctattattggtatttttgtgtaaaatatgcatttcacaaatcagattattgatatttcttctgcaaccaactcataaatgttaactttcaagcatgcagaggtaccatacacaaaaaaatgagactccatatgatcagttctgaatggctgactccaatccagtgtaggcaaacaatggtctatggggcacatgtggcctgctacctctttgtaggaacagcaagataagaatggttcttatattttgaaatggttgaaaaaaacaaaaagaacactatttcatgacatatgaaaattgcatacaatttaaatatcagtgttcatacataaagcttaattgaaacagtcatgccctttttcacgttgtctctggttgctgtaatggcagcgttgagtagttgcaacagagactacatgttcctcaaagcctaaagtatttataatcttgtgcctttaaaggaaaagattcctgacccctggcctgacttactgctggtcacgatgtctcttgatatctctggctcctcacttggttgcccttctgcttccttgtctggccttcccaatcaaactatttcactctacttggtttcctaagatgaccttagatttgcttctactgccatctgggacatccctccttctctgttgcagaatttgatcttctccattcttttattacttttcccatagactttgtgtctctttgttttcctagttctgggagtggaaagcaggactctgatctatggctgacctagaattaatgtgtggaagtacagggtagtgagcaggggtgcatttcctctgggataatgcagtttgtaatttcagatgttatttcaagcttgtctgagatgccaaacgcccagcctaaaataagccttcatttagaaaaatctgtattttcacaccatggggattttgcttcttagtgtatctatagataaaattggtaataaacccaaatccagggcaactgaattttccatcagaatgcccagcaaaaggcctggtagctgaggctgtcctttgcactcttttgcttcttcaatggagccaatagagcatgaagaggggaaaattgcgcacatcacccaaagagtttggaataccccatgttactatgatatgggtcttgacttgcgtagataacacaagacctttttatcccccgtttctttcaagccactacgttttcttttttcatactttaatgattttaaagggaagttcagtataaggtaggcagagataagatgggaaaggaatttgaattatctgggaactcttaggagaattttgtcctcatttgtcttatgtaatacacacttttgagtcctcataatgatctgaataaaagaacattttactacttgtaggtataattatataactgagtaatgaatttactaaccaaaccttgacgttgccaacaattcaaactgcctttcatccacagcctctttcttcttcttctttttttttaaattatagtttaagtactgaggtacatatgcagaacatgtaggtttgttacgtaggtatacacgtgccatggtggtttgctgcacccattaacgcatcatctacattaggtatgtctcctaacactatccctcccctagccctccaccccccgacaggccctggtatgtgatgttcccctccctgtgtccatgggttctcatagttcaactcccacttataagtgagaacatgtggtgttttgttttctgttcttgtgttagtttgctgagaatggtggtttccagcttcgtccatgtccctgtaaaggacatgaacccatccttttttatgtctgcatagtattctgtggtgtatatgtgccacattttctttatctagtttatcattgatgggcatttgggttggttccaagtctttggtattgtgaacagtgctgcaatacatatacatgtgcatgtgtctttatagttgaatgatttataatcctttggttatatacccagtaatgggattgctgggtccaatggtatttctggttctagatccttgaggaatcgccacactgtcttccacaatggttaaactaatttacactcccatcaacagtgtaaaagtgttaccatttctccacatcctctccagcatctgttgtttcctgacttttgaataatcgccattctaactggcatgagatagcatctcattgtggttttcatttgcgttgctctaataaccagtgatgatgagcattttttcatatgtttattggctgcataaatgtcttcttttgacaagtatctgtccacatcctttgcctactttttgatggggttgtttttttcttgtaaatttgtttaagttctttgtagattctggatattagccctttgtcagatggatagattgccaaaattttctcccattctgtaggttgcctgttaactctgatgatagtttcttttgctgtgcagaagctctttcatttaattagatcccatttgtcaattttagcttttgttgccgttgtttttggtgttttagtcatgaagtctttgcccatgcctatgtccagaatggtattgcctaggttttcttctaggatttttatggctttagttgttacatttaagtcttcaatccatcttgagttaatttttgtataaggtgtaaggaaggagtccggtttcagttttctgcatatggctagccagttttcccaacaccatttattgaaaagagaatctttccccattgcttgtttttgtcaggtttgccaaagatccgatggttgtagttgtgtggtattatttctgaggcctctgttctgttccattggtctatatatctgttttggtaccactaccatgctgttttggttactgtagccttgtagtatagtttgaagtcagttagcatgatgcctctagctttgttctttttgtttaggattttcttggctatgtgggctctttttggttccatatgaaatttaaagtagttttttctaattctgtgaataaagtcagtggtagcttaatggggatagcagtgagcctacagattactttggaaagtatggccattttcacgatattgattctttgtattcattagcatgaaatgtttttacatttgtttgtgtcctcctgtctcatttcattgagcagtggtttgtagttctccttgaagaggtctttcacatcccttgtaagttgtattcctaggtattttattctctttgtagcaattatgaatgggagtcactcatggtttggctgtttgtctattattggtgtacaggaatgcttgtgatttttgcacattgatttcatattgcaagacttggctgaagttgcttatgaccttatggagatttgggggtgagacaatggggttttctatatattcaatcatgtcatctgcaaacagagacaatttgacttcctctcttcctatttgaataccctttatttctttatcttgcctgattgccctggccagaacttccaatactatgttgaatagaaagatc

SEQ ID NO: 17 - DNA, 8478 bp, Homo sapiens
tcagaaagatttttatttgaaaaatttgcttgatagttttttgggaatttttgttttattttaaattttaaatttttgtgagtacatagtaggtatagatattcacaagatacatgacatattttgatacaggcatacaatgcataataatcacatcagggtaaatgggatatccatcaactcaagaatgtatgctttctttgtgttacaaacaattcgatcatactatattagttatttttaaatgtacaataaattattgttgactgtagtaatatgaaatacaagattttatccattctatccattatatttttgtacccattaaccattcccccaaccctcctccacccacccctacccttcccagcctctgataaccatcattctattccctgtctccatgagtacaattgttttgatttttagctcctaccagtaagtgagcgtatgcagtttgtctttctgtgcctggtttatttcacataaaagaatgacctccagttccatctatgttgttgcaaatgacaagatctcatttgtttttatggctgaatagtacttcattgtgtataggtacacattttctttattcatctgatgatggacatttaggttgctcctaagtcttggctattgtgaacagtgctgcaataaacatgagagagcaggtatctcttcagtatactgatttcctttcctttgggtatatacctagcagtgagattgctgggtcatatggtagttctattttcagtttttgaggaacctccaaactgatctccatagtgcttgtgctaatttacaatcccaccatcagtgaacaaggattcccttctctctatatccttgccagcattcattttgcctggtatttggataaaagccattttttactgggttgaggtgatatcacattgtaattttgatttgcatttctctgataaacagtgatgtttgagcacattttcatataccttcttgccatttgtatgtcttcattgagaaatgtctattcagatattttgcccatttttaatcagattattagatttttttctatagagttgtttgggctccctatgtgtattctggttattaatctcttgtcgcatggatagattgcaaatattttctcccattatgtgggttgtctcttcacgttgttgattgtttcctttgctgtgcagaagcttttaaagttgatgtgatcccatttgtccatttttgctttggttgcctgtacttatgggatattactcaagaaatctttgcccagaccaatgtccttgagagtttcccacattttcttctagtagttttatagcttctggtcttagatttaagtctttaatccatttttatttgattttcgtatacggtgagggataggagtctagttttattcttctgtttatggatatctagtttttctagcaccatttattgaagaggactatcatttcccaatgtgttttttggcacatttgttgaaaatgaattcactgttgatatatggatttgtttctgggttctctattctgtttcattggtctgtgtgtctgtttttaggccagtgccatgctattttggttactgtagctctgtagaataattggaagtcagataaggtgattctttaagttttgtgtttttttgttgtttgtatgttttgtttttgtttttgtttttgtttttgctcaggatagctttgcttatcctgagtcttttgcaattccatttaaattttaggattttttattctttttctgtgaagaagggcattagtattttgatagggattgtattaaatctgtagattgctttgggtaggtagtatgggcattttaacaatattagttcctccagtctatgaacatggaatatttttctgttttttggtgttctcttcaatttcttgcatcaatgttttgtagttttcattataaagatctttcacttatttgattaagttaatttgtagggttttattttatttgtaactattgtaaatgaggttactttcttgattttgttttcatattgtttgctgatggcatataaaaatgctactgatttttgtatgttgattttgtatcctgcaactttactaaatttgttgatcaattctaacagttttttggtggaggctttcggtttttccaaatataagatcatatcatgtgcaaacgaagataatttgacttcttcctttccagtttagttgcactttatatcttttgtctgattactccagctaggacttccagtactacgttgaataaccgtggtgacagtgggcatccttgtggtgttactgatcttaaaggaaaggttttcagtttttccccattcagtatgttactagctgtgtgtctgttgtatttttggcacttttaatgtgttaaggtatgttctttctgggaatttgaaggcttttatagtgaaggaatattgaatgtcatcaaatgctttttcgatatcagttgaaatggtcatatggtttttgtcctttattctgttgatgtgatgtatcacactgactgatttgggtatgatgaaccatccttgtgttcctgagataaatcatcttcggttatgatcaatgatcttttcaatatgttgttgaattcggtttgctagtattttgttaaggatatttgcatcaaattagtgttcatcagggatattggcctgtggctttcttactttctttttttgttcatgtgtctttggctttggtatcagggtaatactggtgttatagaatgagtctagaagtattcacttctcctacattatttctcagagtagttagaataagattggtattagttctttttaaaatgttttccaaaatttaacaatgaagtcatcaggtcccaggcttttctatgctcagaggcactttattgcagcttcaatctcactacttgttattggtctgttcaggtcttgaatctcttcctggtttaatttttgtaggttttatgtgtttagtaatttattaatttcttctaggttttccaatttattggcatatagttgctcatagtagcctccaatgatcctttgaatatctgtagtattgtttgcaatatttcccttttcacctctggttttacttgtgtcttctttttttttttttcttatttagcttggctaaaggttgtaagttttgtttatcttttcaatagctttttttcattgatcttttgtattatttgttgaagattagatggttgtagatgtgcagtcttatttctgagttctctgtctttttttttttaactagtaccatgctgttttagttactatagccttgtagtatagttggaagctggttagcatgatgcctccagctttgttcttttcgcttaggatagtcttggctatttgggctcttttttggttccatataaactttaaaatagcttttgctaattctgtgaagaatgtcaaagatagtttaatgaaaatcgaattgaatatataaattactttgggcagtatgcccattttcacaatattcattctttctatccatgagcatggaatgttgttccatttgtttgtgtcctctctgatttccttgagtggtggtttgtagttctccttgaagaggcccttcactccttgttagctgtattcctgggtattttattctcttcgtagcaaatgtgaatgagagttcactcatgaattggttctctgcttgtctgtcattggtgtaaaggaatgcttgtgatttttgcacgctgattttgcatcctgagaatttgctgaagttgcttatcagcttaagaagcttttgggctgacaagatgggttttttagatacaggattatgtcatctgccaacaaaggcagtttgacttcttgtcttcccatttgaatacctttatttctttctcttgcctgattgccctggccagaacttccaatactatgttgaataggagtggtaagagagggcatccttgtcttgtgccagttttcaaagcaaatgcttccagcttttgcccattcagtataattttggctgtgggtttgtcataaatggctcttattattttgaggtatgttccttcaatacctagtttattgagagtttttaacatgaagagatgttgaatttgattgaaggcctttttgcatctgttgagataagcacatggtttttgtttttagttctgtttatttggtaaattacatttattgatttgtgtatgttaaaccaactttgcatttcaggatgaagccaagttgattgtcatgggtaagctttttgtgtgctgctggattcagtgccagcattttattgaggatttttgcatcaacgctcatcagagatattgacctgaagttttcattttttgtcatttctcttctaggttctggtatcaggatgagagtggcctcataaaatgagttagggatgagtccatccttttcaattgcctggagtagtttcagaagaaatggtaccacctcttttctgtacctctggtagaattcagctgtaaatccatctgatcctgggcttttattgatttgtagtgtcacagggtccttggagtgtcaatttgctagctggaaacctctgttgccaccaggaccttctgcttgagtattgcttatgaccacttaccttgttccatccacttgccccagccaactgtgcttggcttacgccactggcccagatcctacaccagccaaggacaagccaggtgcagagtggcaaggggtgtgttggagagcaagcctggggtccagccacggtgtaaaaccaagctgaggctggccgctgaggcagggcaggcagctccaggcaccagcacacatgttggctctgtgagaaggtgcagctggaccagatgtactccatgtggcttgcgctgtaggcacctgtgtctggacagagggatcatggtggtgcctggaagcttggagacatcagaaactgcagaactccttaaagtgtgtcagacccctggctcagggagtccccaggtctgggatcctggagggcagcagctcttctccttctcattacccacagcgtggcaagcagggaagggtagggggcatgtttcagccctgtttatgttacaactcttttagtctcaccattcagtgggtcctgagtccttatactttgtccaggaagaatgaggcacgcaaacagctggagggtgagcagagaagagcttcgtggaatggcagaattgttttcaggagacccaaagtgggtagctcctttcctcaggcagatcgttcttatttctgtttaagtctggctgagttcaggtttttatgggctcagaagggaggaagtgtgtgctgatcggtccatggatggccacgggcgggcctggaaaaagcaccataagttctcactcctggctgtggactccacccagaactggcagcccagtccccaggcttcaagccatccctcgcttgaaggtggggtttcaccacagacccaaccctttccaccatggagcctgcctgctgccatcaacgtaccattcatggcacccaggctgcttgtgccaaggggcacctgccagcccatgctgagccacctgcagcaccccctccctcccttcctgagctctttggtgcctaaatcttcagagggagaccgagggggcaggggggtagtgtgtcaggacttccctgagtgcacacacaccagccaagtcatgacagcattccaggcttggcttcagccttgttccaaaagtggccccagggagtgagatcaggcacttccaaacctgtggggacaagggggcttcccgggcccccaagagctcagggatgcccatgtccagcaccacagcttaggtgagtacagctgtgtccagactaccactggtaatgtgctgggtcagtcttgaagccggtatagtactgggtcttgcccaaggcctgtcaaccactgactggctaccacctatgttcacttaaggccctgacgctccacaataagcaggtggtaaggccagccaggcttgtgtccttcccttcaggatagtgagttcgctctcattgctggtgggtccagagatgccatccaggagctggagtctgaagtcagaaactttaggaatctacctggtgctctattctcctgcagctgagctggtacctcaaccgtgctacaaagtcctactcactttccatctcctttccatataagaagacgtgtctctccccatagtcaccactgccctaggcccatagtgagtactgcctggctacagtcagcgttcattcaaggcccaagacctctttcgtcagcttgtggtgaatactgccaagcctggagttcttttttcaaagcaatgtgctcccatctggcccagggaaggtccagaaatgctgtccaaaagccaaggcatggaatcagggaccccaagaactctgggtgctgtaccccactgtggccaagctggtacctaagctgcaagacaaaatctccttcacccttttctctccgtttctcaagcagaatgggtctctccccattgccatcacagctgggaatgtgcttggttacaccaaagccagcatgtctctgagtctcacccaaggcccatggcgagtactacctggctacggctcctgattattcagggacctagggtattttagtcagcaggtaatgaatcctgccaggactggattcttcccttcaaggcagcaggttcccttctggcctagggtgtgcctagaactgttgtctaagagccatggcctggaatgggagtctcagaactctgattccttattctgctatggctgtgctgggttccaagttgcaagacaaagtcctcttgctcttccctctcccctcctttcctcaagaaaagggaaagtgtctatcccagacctgtgagctgtgctgcctggggttggggaaatgggtggtacaaagtctccctgagccacctagatggtgtatctctagttcatttgcccaagtccactggctctaagcatagcacagcacgaggattttcagtccttgtacctagactgcctttcaagtttatttaggacccaacagcattgtagccttttagtggtgaggcttgtcagaactcaggatccaactgctgggatgggctagtccccacttgctagggctggtgtaaatgctccttctgtgggcactggctgagttctgcctgttgttgctttctgctgtgacaggacagcattgagttccaatgttccaacgcaaagtcctgcaattactgcattctctctccctcaagcactcagattctctttccatgccatgtggtcactgccaagggatcagtgaggggtggcatcagtaattatacggtgtcattccgattctctccagtgcctcttttagtgatatgaagttaaaaccaagtattataattgctcacctgatttttggttcttatgaaggtgttttttggtggatgcttgttcaatttggtgttcctgtggagaagatgattgctagaggcttctattcagccatgttgctccacttccttgaaagctgacagtctttttatttttaatcaccttaccatttgtttattattatttttaaatgattggaataattgtacgtatttatcatgtacagctttatattttgaagttcatttacattgtgaaatggcaaaatctagctgattaacatatgtgttacctcacatagttatatttatggggtgagtacacttaacatccactccattagcatttttccagaatacagtatattgttatgaactatattcaccctatttacaatagatctcttaaactcattcctcctgtgtaactaattttctgtatcttttgaccaatatctccctaacctccccttccctgccatccacctcttgtaactaccactctattccctagttctgagatcaacatttttaggttgcacatgtcatcaagatcatgtggtatttgtgtttctatggatggcttatttcacttaacataatgtccttcaggttcatccattgtcacaaattgtagggtttttttttaagactgactagtattctattgtgtatatatgccacattttctttatccattaatccactgatagacacttaggttgatttcataccctggctatattgtgaataatgtggcaataaatataggagtgaacatattttttcactgttggtaggagtaatgaattatatggtagttctgttttttacttatttgaggaatctacacctcattttccacaatggctgtattaatttacattcccaacaacaatgtgcaaaggtccctttttctccatagcatcaccaacacttgttatcttttattattttcatgataactcttgtatcacttgtgaggtgatatttcattgtggtttaattttgcatttcagtaataattagttgtattgtgtatttttttatatcctgc

SEQ ID NO: 18 - DNA, 15572 bp, Homo sapiens
ctcccattactatatttatttacctcagtgatcaccaagaagaagacatcctgatgctctcatccttcaagatgtattattccctagtctcttcctgcttataatgcctggtgggaatacacactgccatatggagaatctttttttacctccacctctctctgctcgatagtcatgtttgctagtaattgtggtgcatgaatagatttgagagatgctgataggtcaagtcaaatagataatgactgtctacatctgaaacagttatcaggcattagttggggttgaaagttgttttgtttatttttccccaactgctgtgtgtttccaggtggaaacaagtaatggtgactggccaaatccacatgctacctactgcccaagttcttctcttgtttgacaatctaaccaattctgtggattccaaaagacaagctagtttgtcagtggaaagaatccagaactgaaaaataagacctaccactaatattgccccctttattgaaatgtgttcaaaatactaagcctcaacttctttatgtctaaaacaaaaagactggaccaaatgatttccaaggctccctttagccctaaaattcttccatctaaatatgtttcaatcctaaaatatttaaagttaggatacctaaattcccaaggcaattctaaaagataattaaccaacatggtgacttacctcatggatttcttactaacctctcatcaatttctcagcaacacacttcagcaaactgtagccatggagactcacttaatataaagtagtagatataagctttttcaatcaatcagcagtaagtttaaagtccagaaagccatgaaaatagggagtcctaggaaacaaagttaatttaagtatgtctacataattcctgtggagtttgtgacatataccaatgttacagtcagtgatacactgcatttcaacagtggtcccataagattataataacataacaccacacatgtttgtggtaatgatggtgtaaataagcctgctgtactcccagtcataaaaagtatagcaatataattatgtacagttagaaaagactcaagttaaaaattttaaaaaatgatgttgaggattctgaccctgtgtaggcctgggctaatagtttattaacaacaacagcaacaaaagcttttaagtaaaaaaaagtctttaaaatagaaaaaattttacagaataaggttataaagaaagatgatgtttttatacagcttgagctatgtgttactatgaaagagtcaaaaggttaaaaaatagtttacaaagtaaaaggttacagaaagtttactttattattgaagaaaatcttttataatgtagcctaagtgtttagagagtctgcagggggtacaataatgtcttaggccttcatattcactcatcactcacgcattgactcagccagggcaactttcaatcccacaagctccattcatggtaagggcccaatataggtgtcttgtttttatgttttatactatatcttctctatgtttagctatgtttagatacacaaatacaggtgttacaactgcttacactattcagtacagtaacatactgtaaaggtttgtagcctaggaacaataaactataccctaccacttagaagtgtcataggctataccacctaggtttgtgtaagtacacttgatgatgttcgcacaatgaagaaatcacctaacacatttttcagaatttatgcccgtcattaagtgacatgtgactgtagagtttagtgaagtgaaaatgcaaaataaatgtcagaaaatcttaagatagctaggtcctatataaaagtaattttttaatcttttgtttcatatcctgtcttttagtgtagccatattttaaatgccattaaaactaaaccaggtcaaaatttgctttttcctctttgatgtaaaaaagaaaaaagtggaggggcagggaggagggatatggggagaagctgttcaatgagcatcagagcacagtatatactatatcttataagttagagatctgaagtcaaatctcagctttgctctttattgacttaaacaggcaactaacatctgaatcccagtcttaccatctgtaaaatgtaaacaataccttacaagatcttatacctgaagcacttagcacaatgcctggcatacataggtaataaaaaattgtagccattattgttatcactgccatgaattcttccaaatatatattaaataacatggaaataatgagcaaagaccagggaagaaagcactggaatggatgagagagtaaaaaaagcttaagtcattgtccatttattcatcatctaccatcttggatgatgcctaatgacttacagaactgaatgtggaggtaggtcattccaatccagagtcctggacctgaagatggaggagctatggggcagatgagcttgatatttaatggtgatattgccagagtggttgaccttcataaataatctacctccttgttttgtggggcccagcaaaggtgcatggggccagattcaaatttgtcagaaacctaagcaattggttaacttataggggtcatttgagaagctgtaatgtgttttctatatcatgtttcatataggtcattaccaattaaaagcattatatgagtagtcattattaaatgtgtgagactgttcattccctcacatagcatactaaaattatggtaggtgagagattccagtaaggtgcttattaatcccgtgttataacgacagtaagcaggaatttttaatcctcaaaagctgctcttctgaagagaagttcaaataaagcagacaatgagctctttgagcttcctgccctctgtcagtgtatgctcacaagggcactactcattcttgaagtattcatgacccaataatgttagtgacaaagggcatgttgtagacacacagatggtgatttcacatgtaggctaatccctatggatttacaataagcaagactatataacaggcaaagcctctcattaaatttttctgaattgctcactaaaactttgttgaataaagaatatgatgttagattatttccatattcaaatccataggaaatggaaatataggctgcctttttgagcaaataactagtcaattgagatatcctgtgttcaaagtgctttggttcaatttcatttttaccctgggatagacaattgacaaatttcactgtacacatcatattcaaggacatagtaaagcaaatcttccgaatgtgaggtaaaatatgtggcacaatataacacacatgtaactcacatgtgactgaattaagcagcttttagagtttcagtaccaaaagcattaaatgaatcaacggaagtatatgtatagttcttttcacagtaatacaggactatgaaaataacgggagccaaactgtgcaaagtaatctggataacttacggaaaaagttaaaattccactgtgacttttaaagacattttgtcaaaaaacaaaacaaaaaacctcttactgtcaattataaacatacagggaaatttaaaatacagtaaaaatatttgtctaatgagttttaatgtaaaagtctttttaagagtagtttgaacagtgtttgcctctttcttctcatggtatagtaaggggcaagcagcttttctatgccttggaaatggatccaaacttaggactacgacaatccaccagcattgtaatcctttcagctttttatgtcatcacctacctgagagttccttaaatgtgagcctttctccatgtaaattttgctaagatatctgtatctttctcctcacttacgttaataagcccaacttcagtaacctccttggatgcttatctagaatctctccaatggcagcagtgtcaacaatccaagggtcagtaattgcttagattaactcatttgcactctacgcatgtttcactctagcattatcccttatcctttctttgctgcactttgatctttcctggccaagtccatcttttgattatccaggtttgtaaaataatcacatgggtttgtaactgcgaaacaaagtggccacactttgttgtctgtgtgtgaacaggaacacagtgaccattcacctgctttgaaagaagagactggtcactaatgacatgtatctgctatccacacagtgattactggactacagaattagcttgtgaagtttgcccttcatgcaattacacacatttaatataccatggtaactgaaatttgaaatggtcagaggacactaatgttgtttaaactgtggaagcaactactgtcagcctatttaatcaacaaatatttaattgtccacgtaatgcacatcaaagcattgtattgtatgaatgagaagtatggattactaataataaaggcattctgttaaggagaaaaatctgcataattaactgtaatactagctatagcatgagtactagagagtggtataaacatagggccatgaaagcagaatcattcagtttcaaagtgaaaattctaaatagcatgactattaagcaataacagcaatgataatcaatactttctagcccattgtttctaacccacaattgtcagaaaatttatgttcctcattgcactttagggttgtactaccttacacagccagttctcaagactatgtttgacctaattgaagagtaaattttgtcttagaaaaggaaatatgtattttgagagtctagtaaatgtttccacccaggaggtttcagaaaagtgttcaggcactgctgagtacataagcaagatttttaaagcctctgcccctgacgtcaatataaccctcaataactgattgaaaaacacacacacaggtagggtgtataaatggaagaccgccgacaagcaatttgagaaaggaaaaacttacattgtatacgtttagagtcccttcttaaaggttttaggcacatttccttagacgttacttgttttaaaacagcataagtcttccttcataactaaggacatcaaaactcacatattgccctacttagaatgttatggccaggtgcagtactttgggatctcccaatccaggttcatactgtattagttactcgtgctgcgagaaaattactcatttcttaaagtttcattctgctcacattaaagctttggctctattctcggctgggcatggcagctcacacccataattccagcactttgggaggcccaggcatggcggtccatacttctagtcccaggtacttgggaagctgaggtgggagaatcacctgagccctacaagtcgagcctagagtgagctgtgattgcaccactgcactccagcttgagcaacagagcaagaccctgtctcaaaaaaaaaaaaaaaacctctctcccaaaagcaggctataatcatgccttcagtagtacaaagagtaaaagataaaggtatgacctcctctcatgacttctttctcctggtggtagtctccctggtgttggggggaggaaggaaagaaaaaagatgactccatctgtacttcagtggtgaggggtcattgtctatttcgttagtgtgaagggttgttctaaaattcttatgtccaaagtgaccactttctgtcttccagtccttttatcatcaaatggctgtgccaaggagagaggcccttgtggtgaattgcctcatctcagcaggttctcttgaaaggttttggcccaaatcttgatgattctctcaagatagaaactgaaagtctttcagaatcttttgttccgggctttcagcatttgccttcatttttatgaaaataagatctttattaatctaatacattgcaaatgagattgcaaaagttacagtctctgtggtagaaattaaaacgccacataactttgacaaaaatactatgcttttaaaaactatactgtaaacttttgtagcataataattcattatagtttataatagcaaggaattaaacaattgaaatatggttaaattatatattcatataatggattaaatgtcaaacattaatgttttattttccaagcctgtagtcgttgatgtagtgacagctttatctacactgaactggaatgacctccatgatacatttttaggtgaaaagataaaggcctggtaacaaatagctagagcatgtgcttcagtttggggaaaaatgtgtatgttcataaaagatatgttaatgtgaatatagtaagaggttggtgttatcctcatttcacaaataagaaaacagaagcttaagaaaatagaatcatagaatcagtggtgacatactgtgatttgaattcatgtttatctgaaccgaaatcacaggccctttccaacacaataagtttaacccctgactaatcttttccaggagacagttgactttttaaaatgctatcggtacaccttataaataaattgttgtaatatatttgcatgtggggctcccctggccaactatgagtttcatgaaggcagggaccctaacaaagctacctttctgttcccagtgctccggtatggcacattgtggaaaagctcttaaagtaataaaaagcaatggtgcatccttgtgtgcaagaaatgaatataacttcattaagtggctagtaaatcaaccctagttctttaaactatcataatagtaacagaatgtcttaggatttctgcaggcccaatgacattttagttcaatggggtaattattacatccaagcttcaaacttgcatttcatacttaagtgaatatttatcatcacctattacgcactattaatggaaagaactattcatttccaataatacattttatgttttttatgcatagaatgaaattgtccattattaatgagtctgaaagctcaggccagtaagcctctgcttattttcaggtcgttcctccaaagatgccgtgggtcagatatctgttcatgtggacatcactgccaccccaggaacgggagatcataaagtcactgtaaaaggtatacttctggtctagataaatcaaaacagccttctaaacttctgcagcagtactgatatcagcaatgtaacttttcttgcatttaaaaaaactgcacaattattttagggcatgcacaaaatttcctaatgaaacccaaacttttgattaaaaatagaaaaatatcaatggcactaatgtttagcatgcattattcaaaatatataaatacactgattaaatatccaaacttactttatcagatatttattttgtggttggtgccatgatattcattgaacacttgcactttaaatattaagtcagtatgttcttactattcacaaaacctactgctttttctatatgatttccaacaactggcttagagttctttacaatgagtggctcaatttgttggttttacattgtaaaaacagcctgaatgcaggggtaatttcaaagatgaaattaaaggattagcattttgttaacaatacgctcgttctatttttatattagtcacttcaatacccactttgagcaaaactagggctgcccaatatatttcagaattacattacatattgtatctttacatcataaaagtaaaatagctatattttagaatagattatatacagtagtatatactgtcaatttccttaaatatttttgaaaaatgttgccaacgtgtgaaagtttaatgaatattttgcagtagtgattttaattataagacacttcgcttgaggatgagcaaagatatttacacatgagaatcttcatttagtattttttttatgacgactgaaatttaaaaacagctataatatctaacaagtgactggctaaatataggatgaaatagccacagagcaaaatattattagcagttgacaaaatatataatgaattagaaaattagccatgatagacttaaaaaaataaagctatttataagattgcaacacattataatatcattttgtatataaagtaactaaatattgaaagcatacaatccaaaatattgtcattgactggtaaatttatagattttatctatttcctgatgagcatatcttcatgttcaatacgaacaacaccatgtttttaccaagaggaggagagtgctaacttttcattagtaacagatatcattttaattgcagctaactaacttttcaccaaagctacacagcttaaagctgaaagctccatcaggtgtgccttccagaaagaaaattgtattttattgtcttggagtacagtgtcttgtcagtggagttagggcactattattaagttttggcttcataaatcacttttaaaatttcactctaaatttccacacatctgtttgctaaaatgtgatatttccttttttttagtgattgctattaatgacctaaactggcagaccacagcaatgttccgcccctttgtggaagtttgtatactgggacccaaccttggagacaagaagagaaaacaaggcacaaaaacaaaaagcaacacatggtcaccaaagtacaatgaaacatttcagttgtaagtcataaacccaccttacttattctaccaggcaatagttactgtacagctgaccttactgagggatttggagtgtgaagggctaaggaaaatgaagaaggctctgtttttagttcccttccattcattcaatatctgttcagtgcctgccatgtatcagccaatgttatagtcattaggtgtatatatcataggaggtgtctgaatcaatcttttgcagtgcactcatataagttactttctacagatgaggagtgtatgataaagtcacaaatatttgtcatatggcattaaatacaatatgcagaactatgtggtaagtgctatgactagctgctttgcctgggaggtcagggaagcctctctgagcatgtgacttttaaactgaaacctgtccaaataaaaagccaggcatggaagagcagaacatttcagacaaagtgaaataaatagctagtacaaggactctaaggcgagagcaagtctgggatatttaagaagcagcacatcatagataaaggagtgagatccaagtgaggccaaggtacagatagtgtgtcacatagggcttttcaattctaagttcaataggtggtccactgaagggttttcaaatgaacagatgagatttacatctttattttgtttgctgtgtacagaaataattatacggtggcaagaccaaatatgtaaagatcagttagaaggctattgcaatagtccaggcaatagctattagtgactaaccggatcctagtagggagatagatggagaagattctgtatcatgtgtggaaagtagattcttgccataggctggaggtagaacatgaaagagtaattcccgaaaacactcagtttagagtaattcaaaatgagcttacttacaaaggaatttacaaagtggttaagagtagagaaatttgagtaatcatgggaactggggctaatagtaaccaggctattaccatacttatgcctgaaaagaggagagaaagagtcattactaaaattaggaaagtgaaaacttgatgtatgcttgaaatgtattattgaaatacactattaatggaaagaactattcatttcttttcagtttgatgtatacatttcaagtatacatcaagtttgaaatgtatacttgaatgtatacttacttgccttgaaagcagcagtgacattccatgaagggcaacagcctactggaggcagccccacaggcaaagagccagggaaataaagactctgacctcactctcctcactgccaacctcttgatggggttcccttttggccaaaatctaccggaagcaagaagaaaccctactgagatatagtcccaacagatgagttttctattgcaaacagcattctattgcaaacagcaaaaaggagggtggatccacagggggaaactgggcgatacctggcactgaataaaatcaaagatgatccctaagtttttggcatgaggagttgggaagatagcaatttaccaagatggaagaagaaatgataaaaatgttttaaatctattaatttggtgatgcctgtcagactctcaagagatgtcatttaattcaacaaatataaataatctaacctaggaatggatacatggagaggttaagaggcctaggacaaagccctaaggatttacacgccaatacactctcttacaggttttttgttcatgatttcctatagtcgtttcagcactctgctctgaatatttcaccctcttatcacgtattaaaactgaagtatcctactctatcaaaagggtcctaatagatcacattccctgccaataaaccagcttacaacatttcactatctacttcaacttactcaaaaacctggacccaactaaagtttcttgttagatataacacagtgagctacttaaaggcagcatttttaattcatgagatctgattcccatcatattttgctcttctactcttatcccctagacttccattttctttcacattatttcagattctccctaaagtacaaagtttagttaccagtgtttcctggaaatcaaaatgtttcatcagaaaaaaatcacctgtaaaaggaaggaatttggaagctggtactgctgagggctagatgtacattcattagaaaatcaagaatatgagaatgaacaaaaataaggggtggaggaagacagactgtatctaccatatcaccacttggccttctttattatgttgacactaacaagctgtcttaggtggttgttaggagaggccacacacttgacaggtctaactgttaccataggaaagaatcggcattgaatcaccaggctctgctggaattgatttactctggatggagatttgtatccaatttagcatattgtgaatagtgcttgatgggctgtgcagtgtattcccctgagaaaagactcctagatataatagcttattcaagatttggaggtaaagtgcgaggagtagtaactgatattgaaatggggaggtaaagtgcgagtagtaactgatattgaaatggcatataaattctaccaagaggtacccattaccctggcctagcccccatgacccctttccaactccaccgcacccgcaatcaggagattctgcctcgactgattaagtgtaacatagtatcttaattcccatttttttctgtcttttctatctagggaaaaagtcattttaacattcgctttctaagccaaatttaaagggttaaaatacactgatatcctatttgccaacataataatcagatccaatgtatacagttttcagcagtatttgagaaccataatgatgcctagtggaagtaaagtttttgctcaaaatttgtatttttaatccacacagcattctcggaaaggaaaatcgaccaggggcttatgaacttcatctctcagttaaggattactgctttgccagagaagatcgaattatcggaatgacagtcattcagctacagaacatagcagaaaagggaagctatggggcatggtatcctcttctgaaaaatatctctatggatgaaactggtttgactatccttagaatactctctcagaggaccagtgatgatgtggctaaagaatttgtaagacttaaatctgaaacaagatctactgaagagagtgcttgaaacaaacactgcaagctaaatacataactataattgtttgactactgcatgcatgtgcaaatacatgggaatgtttagttcactacatttcaatgtttgccagtactcatgtacgatgtctacaaggtatgtaaaaaacctgctgaacttttataccaattctggtctttgggaaatcagtgttccatgaagtgccaaaattatgatgtaaagtgaaatatcaagaacaccttttaacatgtttattttgtttctttacccatttcacattcattaaacataatttttaaaaactagtcttttgagtttgcccatcagttgtctttgttaaatgagattatattgcccatagatcagaaaacatttattactcaatttccattttatttacttacctcattatagatgtcttacaaatacccttttctaccataactagaaatgcagtcacttctagaaagcatttgtaattttatagtcgcagatattgtgatttttgcatacacattaaaatagaaaaggtgggaaatattttctgctgaccagtttccaacctttctgaaatatcactgtgaagaaatgctgttaaagcaaacttacataaagcaatgctagagtttgttaacaatgtttgatatatattgacaaaactttgttctctaaaactgccaagatcacatcacatttgtaaaaatggtaagttaatgcatttgtcatatagtgttatgtcttggctttaccatatttcattctttaaaaagtcattaatggtttagaaatgggatggaaagtttactgaaaatacctgtaagtaactatattgttaatatcttccctctgacagttatgactctataatcagttcaatgctttatttttaaaaatattcaatgattagtattgaatgcagcattactatatattgtactgatgccaaaagtcatgttttcatccacttagtgaaaaaatagtaaaattaagtcggaagaaattgcttaaaattttgtaatttgtatttataagccccaaatgcatcaaatgcagtaggagaacaatgtaatacagcttggtacctaaaaatatagctaagttggtttttgaatataaaacagtttatgaatatgtgcattttctgtattgttatgatttgactttttagagtctatgccaaaatatatggctgtaaaacagtactttgtaattataacttatggtcataactgttagtggactacttacagaagcagaaacaagagcctgttatgattgtgctttgtgaacaagctgatctaatacgttaagtacagaagtgcttagtatcatgactgtcagaaccattctgcaactgagtatgaaatcacagaccagtgaggtgagctaattcatgttaaactgttaggccactgctttgttaatgactcctctaaatgcatagtgtgatgcgatcctctggcatatgctttaataaatggatgtatattgagcacatgcagcattgtattgtatcttctgcctttttatttcatttatgcaatatcatctcatttaggaataaaaactccaggctcttttgaccatatgtaatagtcttcatattatttggttctaacatctcattaaaagtttagatgtcagaatggttattattaaaaagtcaaaaaataacagatgctggcgaggttgtgaagaaaaatgtttgtttgtttatacactgctggtgggagtgtaaattacttcaattattgtagaaagcagtgtggtgattcctcaaagacctacaaacagaattaccattcgactaagcaatcccattactgagtacacagccaaaggaatatcaaacaaacattctaccataaacacatatgcacgtatatgtccactgcagcactattcacaatagcaaacacatggaaccatcctaaatgcccatcaacagtagaccagataaagaaaatgtggtacatatacaccgtggaatactatgcaggcataaaaagaatgagaccatgtccttcacagtgacatggatggagctggaggccattacctgaagcaaactaacacaggaatagaaaacgaaatactacatgtttgttatcacaagtggaagctaaacgatgaggacacatggacactaagggggcaacaacagacactgtggcctacttgagggtaggaggagggaaaagataagaaaaagtatctgtcacgctacgaagcttactacctgggtgacaaaataatctacaccaaaacccccgtgacacacaatttacctacgtaataaacctggacatgaacccctgaatctaaaataaaagtttttaaaaaaaagttcagatgttaaaattcattccacaggtggtgtgttcatggaaaccactgtatattgtaatgacgaggaaaataaggatgaactaatgtatctacctatatattgctaaataccgtttagtcccatgaacaaaattcaacatgcaacatggttaaaaatctcacatgataaaagttttcatcaattacttgaaaaattcattctagatttatgttataaatattttacagaacattgacttaagctctttaggagcacatattaatgtcataatacatgatacatttgagtaaaaggcagttaggatttgcattgatcactttaaattgagcaaggtattttttccctgacatgtttaattgcatccaattattctgtcttttacaatgtatacaatatatatcaaagcctaatagtggcagggtgaattaagtctatttatgactatcataaagtacaggtactaattttgaaatgattataaattctgtagactctgttttcctctcaaagcacaagtattcccgttgtcttcagaacaaagcctgttatatttacttacccaaattagtagtcactctaaggttcccagtgatctctgtcaattgagtgttgcactaatgtgtgtagcaatttattcatcttattctagataaaacacacaaaggcaaagctctgttgcttgtctatggataaacctcacattacaggtctttaaagatacacgtgtaaatcaaatttagcaaacacaaagtatttaaacccagagtggagtatttgctattcgaaggaatttgaatgcattaagtaatcagatgtccccactacaacctgcgctaatttatctacttctaggataatttataacttgaatttatcttaaatgaggcacatttataaatgacaattctaacttaatgtcttttatttggtcttttttaaaaacaatgcgtgaaacaagattttctccttttaatttctctacattacataaagatatgactatactagctagcccctttatggactactatagcagctttaatctttatgctcaaataataaatgatcatacttatacatgactcagggaatatccttgaataaatgtctaattccacctacttagaaaaattcttgggcacacaggcaagagactgccctcccctgtggaatgaattttaactcccctgatgttacctgtgtttatactcaagtcctttgtttgaaatagttgcccctttgctcttttgactccccaggcctccactgatcactcttctctgtggttcaggcttctgcagtgtgatttttagaataaaaaactaggatatgtgatatgaaggagaatcaattccaatttgcgaatgttaaataatatatatttaaaagtgctcatgttttttcacatcatgacaactttgaaatcaggatacatatataatcctttggcatgttatggtttaattggtgatttttttctcccttattagtacatgtttcttcttataatgaatgacttccag

SEQ ID NO: 19 - DNA, 131041 bp, Homo sapiens
aaattatggtaggtgagagattccagtaaggtgcttattaatcccgtgttataacgacagtaagcaggaatttttaatcctcaaaagctgctcttctgaagagaagttcaaataaagcagacaatgagctctttgagcttcctgccctctgtcagtgtatgctcacaagggcactactcattcttgaagtattcatgacccaataatgttagtgacaaagggcatgttgtagacacacagatggtgatttcacatgtaggctaatccctatggatttacaataagcaagactatataacaggcaaagcctctcattaaatttttctgaattgctcactaaaactttgttgaataaagaatatgatgttagattatttccatattcaaatccataggaaatggaaatataggctgcctttttgagcaaataactagtcaattgagatatcctgtgttcaaagtgctttggttcaatttcatttttaccctgggatagacaattgacaaatttcactgtacacatcatattcaaggacatagtaaagcaaatcttccgaatgtgaggtaaaatatgtggcacaatataacacacatgtaactcacatgtgactgaattaagcagcttttagagtttcagtaccaaaagcattaaatgaatcaacggaagtatatgtatagttcttttcacagtaatacaggactatgaaaataacgggagccaaactgtgcaaagtaatctggataacttacggaaaaagttaaaattccactgtgacttttaaagacattttgtcaaaaaacaaaacaaaaaacctcttactgtcaattataaacatacagggaaatttaaaatacagtaaaaatatttgtctaatgagttttaatgtaaaagtctttttaagagtagtttgaacagtgtttgcctctttcttctcatggtatagtaaggggcaagcagcttttctatgccttggaaatggatccaaacttaggactacgacaatccaccagcattgtaatcctttcagctttttatgtcatcacctacctgagagttccttaaatgtgagcctttctccatgtaaattttgctaagatatctgtatctttctcctcacttacgttaataagcccaacttcagtaacctccttggatgcttatctagaatctctccaatggcagcagtgtcaacaatccaagggtcagtaattgcttagattaactcatttgcactctacgcatgtttcactctagcattatcccttatcctttctttgctgcactttgatctttcctggccaagtccatcttttgattatccaggtttgtaaaataatcacatgggtttgtaactgcgaaacaaagtggccacactttgttgtctgtgtgtgaacaggaacacagtgaccattcacctgctttgaaagaagagactggtcactaatgacatgtatctgctatccacacagtgattactggactacagaattagcttgtgaagtttgcccttcatgcaattacacacatttaatataccatggtaactgaaatttgaaatggtcagaggacactaatgttgtttaaactgtggaagcaactactgtcagcctatttaatcaacaaatatttaattgtccacgtaatgcacatcaaagcattgtattgtatgaatgagaagtatggattactaataataaaggcattctgttaaggagaaaaatctgcataattaactgtaatactagctatagcatgagtactagagagtggtataaacatagggccatgaaagcagaatcattcagtttcaaagtgaaaattctaaatagcatgactattaagcaataacagcaatgataatcaatactttctagcccattgtttctaacccacaattgtcagaaaatttatgttcctcattgcactttagggttgtactaccttacacagccagttctcaagactatgtttgacctaattgaagagtaaattttgtcttagaaaaggaaatatgtattttgagagtctagtaaatgtttccacccaggaggtttcagaaaagtgttcaggcactgctgagtacataagcaagatttttaaagcctctgcccctgacgtcaatataaccctcaataactgattgaaaaacacacacacaggtagggtgtataaatggaagaccgccgacaagcaatttgagaaaggaaaaacttacattgtatacgtttagagtcccttcttaaaggttttaggcacatttccttagacgttacttgttttaaaacagcataagtcttccttcataactaaggacatcaaaactcacatattgccctacttagaatgttatggccaggtgcagtactttgggatctcccaatccaggttcatactgtattagttactcgtgctgcgagaaaattactcatttcttaaagtttcattctgctcacattaaagctttggctctattctcggctgggcatggcagctcacacccataattccagcactttgggaggcccaggcatggcggtccatacttctagtcccaggtacttgggaagctgaggtgggagaatcacctgagccctacaagtcgagcctagagtgagctgtgattgcaccactgcactccagcttgagcaacagagcaagaccctgtctcaaaaaaaaaaaaaaaacctctctcccaaaagcaggctataatcatgccttcagtagtacaaagagtaaaagataaaggtatgacctcctctcatgacttctttctcctggtggtagtctccctggtgttggggggaggaaggaaagaaaaaagatgactccatctgtacttcagtggtgaggggtcattgtctatttcgttagtgtgaagggttgttctaaaattcttatgtccaaagtgaccactttctgtcttccagtccttttatcatcaaatggctgtgccaaggagagaggcccttgtggtgaattgcctcatctcagcaggttctcttgaaaggttttggcccaaatcttgatgattctctcaagatagaaactgaaagtctttcagaatcttttgttccgggctttcagcatttgccttcatttttatgaaaataagatctttattaatctaatacattgcaaatgagattgcaaaagttacagtctctgtggtagaaattaaaacgccacataactttgacaaaaatactatgcttttaaaaactatactgtaaacttttgtagcataataattcattatagtttataatagcaaggaattaaacaattgaaatatggttaaattatatattcatataatggattaaatgtcaaacattaatgttttattttccaagcctgtagtcgttgatgtagtgacagctttatctacactgaactggaatgacctccatgatacatttttaggtgaaaagataaaggcctggtaacaaatagctagagcatgtgcttcagtttggggaaaaatgtgtatgttcataaaagatatgttaatgtgaatatagtaagaggttggtgttatcctcatttcacaaataagaaaacagaagcttaagaaaatagaatcatagaatcagtggtgacatactgtgatttgaattcatgtttatctgaaccgaaatcacaggccctttccaacacaataagtttaacccctgactaatcttttccaggagacagttgactttttaaaatgctatcggtacaccttataaataaattgttgtaatatatttgcatgtggggctcccctggccaactatgagtttcatgaaggcagggaccctaacaaagctacctttctgttcccagtgctccggtatggcacattgtggaaaagctcttaaagtaataaaaagcaatggtgcatccttgtgtgcaagaaatgaatataacttcattaagtggctagtaaatcaaccctagttctttaaactatcataatagtaacagaatgtcttaggatttctgcaggcccaatgacattttagttcaatggggtaattattacatccaagcttcaaacttgcatttcatacttaagtgaatatttatcatcacctattacgcactattaatggaaagaactattcatttccaataatacattttatgttttttatgcatagaatgaaattgtccattattaatgagtctgaaagctcaggccagtaagcctctgcttattttcaggtcgttcctccaaagatgccgtgggtcagatatctgttcatgtggacatcactgccaccccaggaacgggagatcataaagtcactgtaaaaggtatacttctggtctagataaatcaaaacagccttctaaacttctgcagcagtactgatatcagcaatgtaacttttcttgcatttaaaaaaactgcacaattattttagggcatgcacaaaatttcctaatgaaacccaaacttttgattaaaaatagaaaaatatcaatggcactaatgtttagcatgcattattcaaaatatataaatacactgattaaatatccaaacttactttatcagatatttattttgtggttggtgccatgatattcattgaacacttgcactttaaatattaagtcagtatgttcttactattcacaaaacctactgctttttctatatgatttccaacaactggcttagagttctttacaatgagtggctcaatttgttggttttacattgtaaaaacagcctgaatgcaggggtaatttcaaagatgaaattaaaggattagcattttgttaacaatacgctcgttctatttttatattagtcacttcaatacccactttgagcaaaactagggctgcccaatatatttcagaattacattacatattgtatctttacatcataaaagtaaaatagctatattttagaatagattatatacagtagtatatactgtcaatttccttaaatatttttgaaaaatgttgccaacgtgtgaaagtttaatgaatattttgcagtagtgattttaattataagacacttcgcttgaggatgagcaaagatatttacacatgagaatcttcatttagtattttttttatgacgactgaaatttaaaaacagctataatatctaacaagtgactggctaaatataggatgaaatagccacagagcaaaatattattagcagttgacaaaatatataatgaattagaaaattagccatgatagacttaaaaaaataaagctatttataagattgcaacacattataatatcattttgtatataaagtaactaaatattgaaagcatacaatccaaaatattgtcattgactggtaaatttatagattttatctatttcctgatgagcatatcttcatgttcaatacgaacaacaccatgtttttaccaagaggaggagagtgctaacttttcattagtaacagatatcattttaattgcagctaactaacttttcaccaaagctacacagcttaaagctgaaagctccatcaggtgtgccttccagaaagaaaattgtattttattgtcttggagtacagtgtcttgtcagtggagttagggcactattattaagttttggcttcataaatcacttttaaaatttcactctaaatttccacacatctgtttgctaaaatgtgatatttccttttttttagtgattgctattaatgacctaaactggcagaccacagcaatgttccgcccctttgtggaagtttgtatactgggacccaaccttggagacaagaagagaaaacaaggcacaaaaacaaaaagcaacacatggtcaccaaagtacaatgaaacatttcagttgtaagtcataaacccaccttacttattctaccaggcaatagttactgtacagctgaccttactgagggatttggagtgtgaagggctaaggaaaatgaagaaggctctgtttttagttcccttccattcattcaatatctgttcagtgcctgccatgtatcagccaatgttatagtcattaggtgtatatatcataggaggtgtctgaatcaatcttttgcagtgcactcatataagttactttctacagatgaggagtgtatgataaagtcacaaatatttgtcatatggcattaaatacaatatgcagaactatgtggtaagtgctatgactagctgctttgcctgggaggtcagggaagcctctctgagcatgtgacttttaaactgaaacctgtccaaataaaaagccaggcatggaagagcagaacatttcagacaaagtgaaataaatagctagtacaaggactctaaggcgagagcaagtctgggatatttaagaagcagcacatcatagataaaggagtgagatccaagtgaggccaaggtacagatagtgtgtcacatagggcttttcaattctaagttcaataggtggtccactgaagggttttcaaatgaacagatgagatttacatctttattttgtttgctgtgtacagaaataattatacggtggcaagaccaaatatgtaaagatcagttagaaggctattgcaatagtccaggcaatagctattagtgactaaccggatcctagtagggagatagatggagaagattctgtatcatgtgtggaaagtagattcttgccataggctggaggtagaacatgaaagagtaattcccgaaaacactcagtttagagtaattcaaaatgagcttacttacaaaggaatttacaaagtggttaagagtagagaaatttgagtaatcatgggaactggggctaatagtaaccaggctattaccatacttatgcctgaaaagaggagagaaagagtcattactaaaattaggaaagtgaaaacttgatgtatgcttgaaatgtattattgaaatacactattaatggaaagaactattcatttcttttcagtttgatgtatacatttcaagtatacatcaagtttgaaatgtatacttgaatgtatacttacttgccttgaaagcagcagtgacattccatgaagggcaacagcctactggaggcagccccacaggcaaagagccagggaaataaagactctgacctcactctcctcactgccaacctcttgatggggttcccttttggccaaaatctaccggaagcaagaagaaaccctactgagatatagtcccaacagatgagttttctattgcaaacagcattctattgcaaacagcaaaaaggagggtggatccacagggggaaactgggcgatacctggcactgaataaaatcaaagatgatccctaagtttttggcatgaggagttgggaagatagcaatttaccaagatggaagaagaaatgataaaaatgttttaaatctattaatttggtgatgcctgtcagactctcaagagatgtcatttaattcaacaaatataaataatctaacctaggaatggatacatggagaggttaagaggcctaggacaaagccctaaggatttacacgccaatacactctcttacaggttttttgttcatgatttcctatagtcgtttcagcactctgctctgaatatttcaccctcttatcacgtattaaaactgaagtatcctactctatcaaaagggtcctaatagatcacattccctgccaataaaccagcttacaacatttcactatctacttcaacttactcaaaaacctggacccaactaaagtttcttgttagatataacacagtgagctacttaaaggcagcatttttaattcatgagatctgattcccatcatattttgctcttctactcttatcccctagacttccattttctttcacattatttcagattctccctaaagtacaaagtttagttaccagtgtttcctggaaatcaaaatgtttcatcagaaaaaaatcacctgtaaaaggaaggaatttggaagctggtactgctgagggctagatgtacattcattagaaaatcaagaatatgagaatgaacaaaaataaggggtggaggaagacagactgtatctaccatatcaccacttggccttctttattatgttgacactaacaagctgtcttaggtggttgttaggagaggccacacacttgacaggtctaactgttaccataggaaagaatcggcattgaatcaccaggctctgctggaattgatttactctggatggagatttgtatccaatttagcatattgtgaatagtgcttgatgggctgtgcagtgtattcccctgagaaaagactcctagatataatagcttattcaagatttggaggtaaagtgcgaggagtagtaactgatattgaaatggggaggtaaagtgcgagtagtaactgatattgaaatggcatataaattctaccaagaggtacccattaccctggcctagcccccatgacccctttccaactccaccgcacccgcaatcaggagattctgcctcgactgattaagtgtaacatagtatcttaattcccatttttttctgtcttttctatctagggaaaaagtcattttaacattcgctttctaagccaaatttaaagggttaaaatacactgatatcctatttgccaacataataatcagatccaatgtatacagttttcagcagtatttgagaaccataatgatgcctagtggaagtaaagtttttgctcaaaatttgtatttttaatccacacagcattctcggaaaggaaaatcgaccaggggcttatgaacttcatctctcagttaaggattactgctttgccagagaagatcgaattatcggaatgacagtcattcagctacagaacatagcagaaaagggaagctatggggcatggtatcctcttctgaaaaatatctctatggatgaaactggtttgactatccttagaatactctctcagaggaccagtgatgatgtggctaaagaatttgtaagacttaaatctgaaacaagatctactgaagagagtgcttgaaacaaacactgcaagctaaatacataactataattgtttgactactgcatgcatgtgcaaatacatgggaatgtttagttcactacatttcaatgtttgccagtactcatgtacgatgtctacaaggtatgtaaaaaacctgctgaacttttataccaattctggtctttgggaaatcagtgttccatgaagtgccaaaattatgatgtaaagtgaaatatcaagaacaccttttaacatgtttattttgtttctttacccatttcacattcattaaacataatttttaaaaactagtcttttgagtttgcccatcagttgtctttgttaaatgagattatattgcccatagatcagaaaacatttattactcaatttccattttatttacttacctcattatagatgtcttacaaatacccttttctaccataactagaaatgcagtcacttctagaaagcatttgtaattttatagtcgcagatattgtgatttttgcatacacattaaaatagaaaaggtgggaaatattttctgctgaccagtttccaacctttctgaaatatcactgtgaagaaatgctgttaaagcaaacttacataaagcaatgctagagtttgttaacaatgtttgatatatattgacaaaactttgttctctaaaactgccaagatcacatcacatttgtaaaaatggtaagttaatgcatttgtcatatagtgttatgtcttggctttaccatatttcattctttaaaaagtcattaatggtttagaaatgggatggaaagtttactgaaaatacctgtaagtaactatattgttaatatcttccctctgacagttatgactctataatcagttcaatgctttatttttaaaaatattcaatgattagtattgaatgcagcattactatatattgtactgatgccaaaagtcatgttttcatccacttagtgaaaaaatagtaaaattaagtcggaagaaattgcttaaaattttgtaatttgtatttataagccccaaatgcatcaaatgcagtaggagaacaatgtaatacagcttggtacctaaaaatatagctaagttggtttttgaatataaaacagtttatgaatatgtgcattttctgtattgttatgatttgactttttagagtctatgccaaaatatatggctgtaaaacagtactttgtaattataacttatggtcataactgttagtggactacttacagaagcagaaacaagagcctgttatgattgtgctttgtgaacaagctgatctaatacgttaagtacagaagtgcttagtatcatgactgtcagaaccattctgcaactgagtatgaaatcacagaccagtgaggtgagctaattcatgttaaactgttaggccactgctttgttaatgactcctctaaatgcatagtgtgatgcgatcctctggcatatgctttaataaatggatgtatattgagcacatgcagcattgtattgtatcttctgcctttttatttcatttatgcaatatcatctcatttaggaataaaaactccaggctcttttgaccatatgtaatagtcttcatattatttggttctaacatctcattaaaagtttagatgtcagaatggttattattaaaaagtcaaaaaataacagatgctggcgaggttgtgaagaaaaatgtttgtttgtttatacactgctggtgggagtgtaaattacttcaattattgtagaaagcagtgtggtgattcctcaaagacctacaaacagaattaccattcgactaagcaatcccattactgagtacacagccaaaggaatatcaaacaaacattctaccataaacacatatgcacgtatatgtccactgcagcactattcacaatagcaaacacatggaaccatcctaaatgcccatcaacagtagaccagataaagaaaatgtggtacatatacaccgtggaatactatgcaggcataaaaagaatgagaccatgtccttcacagtgacatggatggagctggaggccattacctgaagcaaactaacacaggaatagaaaacgaaatactacatgtttgttatcacaagtggaagctaaacgatgaggacacatggacactaagggggcaacaacagacactgtggcctacttgagggtaggaggagggaaaagataagaaaaagtatctgtcacgctacgaagcttactacctgggtgacaaaataatctacaccaaaacccccgtgacacacaatttacctacgtaataaacctggacatgaacccctgaatctaaaataaaagtttttaaaaaaaagttcagatgttaaaattcattccacaggtggtgtgttcatggaaaccactgtatattgtaatgacgaggaaaataaggatgaactaatgtatctacctatatattgctaaataccgtttagtcccatgaacaaaattcaacatgcaacatggttaaaaatctcacatgataaaagttttcatcaattacttgaaaaattcattctagatttatgttataaatattttacagaacattgacttaagctctttaggagcacatattaatgtcataatacatgatacatttgagtaaaaggcagttaggatttgcattgatcactttaaattgagcaaggtattttttccctgacatgtttaattgcatccaattattctgtcttttacaatgtatacaatatatatcaaagcctaatagtggcagggtgaattaagtctatttatgactatcataaagtacaggtactaattttgaaatgattataaattctgtagactctgttttcctctcaaagcacaagtattcccgttgtcttcagaacaaagcctgttatatttacttacccaaattagtagtcactctaaggttcccagtgatctctgtcaattgagtgttgcactaatgtgtgtagcaatttattcatcttattctagataaaacacacaaaggcaaagctctgttgcttgtctatggataaacctcacattacaggtctttaaagatacacgtgtaaatcaaatttagcaaacacaaagtatttaaacccagagtggagtatttgctattcgaaggaatttgaatgcattaagtaatcagatgtccccactacaacctgcgctaatttatctacttctaggataatttataacttgaatttatcttaaatgaggcacatttataaatgacaattctaacttaatgtcttttatttggtcttttttaaaaacaatgcgtgaaacaagattttctccttttaatttctctacattacataaagatatgactatactagctagcccctttatggactactatagcagctttaatctttatgctcaaataataaatgatcatacttatacatgactcagggaatatccttgaataaatgtctaattccacctacttagaaaaattcttgggcacacaggcaagagactgccctcccctgtggaatgaattttaactcccctgatgttacctgtgtttatactcaagtcctttgtttgaaatagttgcccctttgctcttttgactccccaggcctccactgatcactcttctctgtggttcaggcttctgcagtgtgatttttagaataaaaaactaggatatgtgatatgaaggagaatcaattccaatttgcgaatgttaaataatatatatttaaaagtgctcatgttttttcacatcatgacaactttgaaatcaggatacatatataatcctttggcatgttatggtttaattggtgatttttttctcccttattagtacatgtttcttcttataatgaatgacttccaggcatcaataagcatatttattaaaaagtatatataaatcgatgaaaataaagtaatgcttagttgtctattttaaaacatagtttggctaggcacagtggctcacaactgtaatcccagcacactgagaggccgagacaggcaggttgctttgagcttagaagttcgagaccagcctagtcaacgtggcaaagccccatctctacaaaaaaatacaaaaatgagtcaggcctggtggcatgtgactgtagtcccagctacttgagaggctgaggcaggagaatcacttgagcctgggaagcagaggttccagtgagccaagatgcatcactgcactccagcctgggcaacagaatgagaccctgtctcaaaaaatatgcatattttttaatttgcatatactaaaattctctcttttggcatacatttctgtgttatgacaaatgcgtagtcatgtattaatcacaacagtcaagatatgggacaattccctcatacctcaaaattccacgttaccactttatagacaaacacttttcctactatcaaccctctgcagcactggttcattttagtccctcacgttttgtgtattccagaatgtcatataaacggaactatacagtatatattcttttgagcctgtataatttcacttagcacaatgcaccagagattcatctacattgtggcatgtataaattattacctagttttttttgttgaatagtactgcactgtatgaacattaaaaagatttcattcaccacttactacacttaccttgtttggcaatattatgaacaaagcttttataaacattcacatacaggattttgtgtatacttgtttttatttttcttgggtgattatctattagagtgtgatttctaggtcttatgataagtatatctttaacttcataaggaactttcaaacttttttgaaagtagttgtaaaattttacatttccagaagcaatgtatgagagtttcagttgctctgcatctttgcaagcactgggtatcgtcagttctttattttagttcttcttctgatatacacaaaatagcatctcaacatgcctttaatttgtattcatctgaggactaataacattgagtatctctgtgtgtgcttatttgacatccatatattttgtttagtgaagtatctgcaaatcttttgcccatttatttaatgagttgtttattgttgagtttggggacatattttcatattccatatacaaaccctttgtcagatatgaaatgtgcaactatttcatcccagtccgtggctagtcttttcatttttataacaacctctttaagagaacaaaaggttttcacttccatcaagtcgaatttgatgaaatcattttttctcttttatagatcatagctttgctaccataagaattacttgcctcactcaaggccaaaaagatttttttctcctatgttttcatatggaaattttatactttggggtattacaatttggcctatgaaccgttttgaggttaatagagggtgtaaagtttgagttaaggttcatctataattattaaattacaattgagtaattaattagaaactaattttcataggcatgtccaattgttccagcaccacacaattcattgaaaatactacagttatcacttggaattacctttgtaccttcatcataaatcaattgaccaaatgtgtgtgagtccatttctgacatctctagtctgttccattgatctgactctataccttatcaccaatgtgacactgtagcaattactgtagctttatactgtcttgaactcaggtagtaagagttctccatgttcttctcttcaaaacagtggagtattctactacttctcactctctataaaaattttaacagccagccaggcacggtggctcacgcctgtagtcccagcactttgggaggtcaaggcaggcagatcacctgaggtcaggagttcaagaccagcctaaccaacatggagaaaccccgactctactaaaaatacaaaattagccagacatggtggcgcatgcctgtaatcccagctactctggaggctgaggcaggggaatcacttgaacccaggagacggaggctgcagtgagacgagatcacgccattgcactccaacctgggcaacaagagcaaaactctgtctcaaaaaaaaaaataacagcctactgggattttgactgagaacttattaaatccatacaccaatttacaaacaaccgatgtcttaacaatattgaatcttcaattcgtgggcacagtatatgtctccacttatttacatcttcattgatttattactgtcttatggttttcagcatacaaatcctaccaaggatttcttctgtatgtgtacaagagtataaatgttactttgagaataaaattcaaaatccaattgtttatttcctgtacaaagaaagatttttgtatattgacttggtatcctggaacctcactaacctcattttattagttttagctttttttttttttgattccttgggattttgtacattgacaattattaaagagaggcaattatttttcttcctttccactctgtacacatatttctttttctttcctcagtacacttgctaaggctaccagtctgattttgtataggagtggtgagcacagatatgcttgctttgttctcaatcttagggagaatctattgagtctgtcaccattaaatatgttagctggaggtttcattcatgacttttataagcttaaggaagttgcctcctactcctactcttcaaaagtttctatcataaatgacttttgaattttgtctaatgctttttctcatcaattaggacgaaatttttctgctgtagtctatgtggtaaattactttggttcatttttgattgttgaaataactttacatttcaatagtaaatcctattttgtcaaaatatatgctcttcatatatatatatatattcaggtgtgtaacattttgttgaagatatactatatagactgtatatacatatatacacatatatacatatattttatgtatgtgtatatatatatatatatatatatatatatagtgcctcttatggtctataaatcatgtagaatatggactatatatggcctccaaaagtgtatggggaattctcttctttactctctcaaagagattgtgatgaaatggtattaattcattcttaaatatttggtagaatttaacagtgaagatgcgtgggcctacatttcttctttattgggaggtgttaaaacaccaattcaactaatctaataggtattaaatgaagagccaatgtcaaaacaacatatgctttagatgaaataaatagtacatattgtaatgatgaagacagcaaaaagaaacaaataataagaaaaaatattacacgtgggacaagatgaccctttattgtggaagcctgccctgtgcattgtaagatgttcagttagcatctctggactctacccaccttatgccaggagcacatcccaagtccctcaattatcataaccaaagtgtctccagacattgccaagtgtcacttagggtggtaggcaaaagtaatccagttcagagccattactgtagaggctttagattcagactgatcggagtttaagttttgatttcatgaatagcttcaagacattgtacaagttatttaacccttctaagccacaatttttctcatctgttcaatgatgattactattcttataaaagtattgtaaagattaaataagttaatggatataatatttagaatagtaattgataagcactcaaataatggtagcaattaactattaagcaatgagacaaaacacaaaggacaactgaataaaagaactgactgctcatggaagaaaggctgataagggaaacacaagtaataattaaaacatgtttggaaaatagttttaccttgaaaaattgcatttctaaatgaaagaattcattgctccagaataaactgataaagtatagggaaagttagggaaccagatcaaaaaataagaaataaatgtgctctatttcttaactcataatttgaaacaaaagtcatgctatgggtgttttatcaatgaccatatataaacatttttggaaaactttaattcaccacttatggagttaaaaataagatttctttcttctaaatcaatgtagaagaataataaagaccaacaaaatcatccaaataacaacagaatattgaatagaaatgcaggagacaagaaaaatcagaaagcataaaataagagagaacactttccaagtgtgacaaatgtgacaataaattacagatgatacaggattaaagtaaaagtatcaatgaccatatataaacatttttggaaaactttaattcaccacttatggagttaaaaataagatttctttcttctaaatcaatgtagaagaataataaagaccaacaaaatcatccaaataacaacagaaaattgaatagaaatgcaggagacaagaaaaatcagaaagcataaaataagagagaacactttccaagtgtgacaaatgtgacaataaattacagatgatacaggattaaagtaacagggttaaattaaagctttttacaataaccatacaagtacaaactagaaaactgaggtagaggggcacattagctaaatagatggctagatagagaagtgacatcaccacgatactggagtaggaaataccagccttcatcttccctgccaaaaataaaatataggcagcaatttacaaatcaaaatagccctagcagggctcaagggcctattaaagaatctgcagcaacacaatgaagtaaaaaaaaagataatatctaaatagaaaggatcactggtgagattaacatacctgacacaccaggagatggctaggaacaaagaaaaaaagcagaggttgccggtatcagccatgcagcagaaactatcatggtccccagtggcctgctccacagaggacactagaatgttgtgccactgaggtaaccaaccagttattgccagggaatcacagaaagagagatgcagctgcattccccataacctcactattaagccactatgataaaggagctgccatttctcccaaacctacatgtgtcttgaagtgtgagcagcggctttccagtgagtgtccacaatccagacccaggctatgtaactacacccacccatgtctcagacaccacagccatccttgtagtgagttagttcacactctgggcctagacccaggctctcactgtgcatgtctgtgttccaggattcagctaagctaccatagagaagtaggccccgccttgaccccagaaccggtgtaaccgcaaacacctattctctcattcttggttctctggctgcttcaaaaaaccctgtttgtcacatactattgccaacatggtaggggaattgactgtgccccacacagctgtgccatttccaacctggatctctgagctgaagtccttcaatgcatgcctgtactttagacctcactcagctccatggctgcttcatgggtgccactcattggacataggtaccactgcaaccatgagcaggcccacaaaccagacccactgccaacaagaatccgcttagctacaacttccccagagagagaaaaagagatcaggagaatcttagcagtcattgccactgaagattccaacaacccttgcagccaatgcagacattcaggccactgaggatcttgtaaatatttagggatatcaacttcagttgtcaaagccacacagcaactataaagatgcacccttgctactgccagaactgttgcacctcacccagcaagcacccatgcactctaccataggaaaaagtttttccaccaggaaaccagcctataaagtctgaaagaggtgactcctccaccaaatattcaaatatcagcatgaggcaacaagaaacataaaaaaaaaaaaaacaaggagaaatatctccaaaagaacgcaagaattttccaacagctgaccttaataagatggagacacacaaagtgcctgacatatagttcaaaataactattttagagaagatcactgagcttcaggaatacagagaaacaattcattaagatcaaatacgcaacaaaaatgaaaaatttaacaggaaaattgaaattattgtttctttaaagacagagtcttactatgctgctcaggctggatttgaccttctgttctcaagttatcatcccacctcagcctcttaagcagctggcactataggcacgtgccaccacacttggattgattttttaaaatctccacagctaaaaaataaaagatacaatgagaaatgcaatacagaacatcaacagaagagtggatgaagcagaagaaagaatctgtgaaattaaaaacaggttatttgaaaatacacagtcagaggacaacaaaacaatataaaataaagaaacctaacaggattcatgagacagcatcaaaagagcatatttttgaacatgagaatttaggaaggagaaggtcaaaaaacttaatgaaataatacaagaaaattttccaaatcttgagaaatatataaatatgcaggtatgggaaggtcaaagacctccaatcagattctattcaaataagactacaccaagacaaattgtaatgaaattgtcaagaatcaaaaggaaaaagaggatcctgaaaacagagaaaagcagcatatcatttaagggagttccaataaagctagcagtggacttgttagtagacaccttacaaactgggagaaagtggtataatatattcaaagtgcttaaggaaaaataatatgccaaccaaggatacttgatccagaaaactgcatcttagaaatgaagaagaggtaaagactttccaagacaaacaaaagttgggagagttcctcaccaccagatatatcttatataaaatgctaaagggaattcttcatgatgaaataaaatgatactaataagtaacaaactcataagatgtcataaagctcaccagaaaagtaagtacacaaattcagattactataatgctataatggtgatgtgggagaacttacatttgtagtgtgaaggttaacaggaaaaaccattaaacatattaatagctacaataatttgttaagggaaaacaatacaagatgtaaattgtgacaccaaaaaaaaaaaatgtgggagaagggggatatggagtaatagtatagttttttatttaataaaaattactagcttaaaattgcattttgtaactataagatgttctatgtaagactcatggtaactacaaaacaaaaacctatggtagacacacaaaatatataaaataaggaatcaaagcataccactagaaaaaatcaccaaatcataaagacaaccataaaagaagaaaggaaaaaaggatcttcaaaaccaccagaaaacaatgtttaaagtggcagtggtaagttcttaccaatcaataattaccatgaatacaagcagattaatttctctaatcaaaacacagagtccctgcatggatagaaagacccgcctatactgtatagttgcatagctgcctttaaaatacccaatttacctttaagaaaacaaagattgaaagtaaaagggtgggaaaagatatttcatgcaaacagaaatcacaggaaagctagggtagctatatttacatctgataaaatagattcttgatatggtttggttatgtccccacccacatctcatcttgaattgtagttcctgtaatccccacatgttgtgggagggacctagtgggaggtaactgaatcatgggggcagatttttcctgtgctattctcatgacagtgagtaagtctcatgagatctgtgaggcctccccagccatgtggaactgtgagtccattaaacctctttttctttataaattaccctatcttgggtatgtcttcattagcagtgtaagaacagactaatacaataccttaagtaaaagactataagatgagacaaagaaggttattcattcgtgataaagtggtcaactgatcaagaagatataacaattataaacatatatgcacccaacattggaacggttaatatataaaacaaatattaagatatctgatggagagactgactgaaataaaaaaataaggagggaaattcaaaaccccactttgaactatggacagatcatccagacagaaagtcaacaaggaaacactggacttgaattacacttcagacaaaatagacctagcagacatatatggatcattccatccaacagaagagagaacagaatagggagcccagaaataaatccatacatttacagtcaactgattttctgtaaagatgccaaaaacacacaatggagaaagtaagatctgtttaatgaatggtgatgggaaaactggaaatcaacatggaaaacaaaatagaacctcacctcacactacatacaaaaatcaagtcaacatgggtcgaatatttatctgtaagacctgaaactataaaacatagtgaaaaatcttcatgacacttgtctaggcaaagaatttttggataggaccccaaaagcaccagaaacaagagcaaaattagacaagtgagatgacatcaaaccaaaagtttctacacatcaaaggaaacaatcaacagagtaaagtgactgcacagaagaaaatattttaaaaccatatatctgattagaaattaatatccaaaatatatgaggaactcaacaccaaaaacaaacaataaaaaaaccacctaatttaaaaattgggaaaaaactagaattgactttttgcctaagacatatacgtggccaacaaggatatttctaaatgctcaacatcactaatcatttgagaaatgtgaatcaaaaccataatgagatatcacctcacacctgttagaatggcaattaccaaaaaaacaaaaaaacaaacaaaaaagacagaaaggattgggaaggatgtggagatagggaaaccttggacactgttagtgagaatgtaaattactacagaccttatggaaaacagcatggaaagtcctaaaaataaaaataaagctgccatctaatctgtattcccactactaagtatatattcaaagaacataaagtcagtatactgaagatatatttgccctcccatgttctctgcagcattagtcacaatagccaagatatggaattcactgaagtgtccatcaaatgggtgaaaaaataaaacttggcatatatatacaatagaatactactaagccttaaaaaaatgctgtcatatgtgacaacataagtaaacctggagataattatatattaagtgaaataacccaggaaaaaaaagataaatactgcatgatcccaattacgtgaaatctgaaaaagctgaactcacagaaacagagaataaaatggtgattaccagaggctggggtatagagggattcaggagacagtggccaaaggaaataacattccatttaaacaggaggaataagttcaagagatctattatacatcctggtgactacagttaataataatatattgtataactaaaaattgctttaaacattatatttagtgttttcattacaaaaaaaaaagaatgtgatgtattatgtatgttaaatagcttgattttttcattccatgatatatgtatatataccaaaacgctgatatagaagtgaaaaagaaactatttagcggatagtgagggtaaggaagtccttgataaggtttttcctttactaaaaagcaggcccaaaatcattttctaacagagcagcctgtaaaattgagctgcagacatagacaagcaagctggaagcttgcacaggcaaatgccagcagttgtgccaacagaaaaatactaccttggattaggcatgttaagaatggtggctccatcgtcccttctttgccagccatgtctacagtaaaaagcagacaagaaggggctggccaggtggaaagtctatttgcacaataagattagggtggggcaaccagccttccccatgtgctttgcaaaggtcacacctgatagaagcaatctgtgagccctacataaatcagatacctcctcctcaagcctgcctataaaatctgctgcagtctgccacttttctcatttttggatgcctctgtctctcttgcaaggagctgctctcttctctcctttcttccgcctattaaactttccactccttaacccactcacatgtgtttgtgtccttaattttcttggtgcaagtaaatgaaccctgggtatttaccccagacaatgacgccacttcaacatcatgttgtataccgtaaacacatagaatgtttacttgccaactaaaaaaaaaaaattaaaaaccataatattgtaataggcccaggtaattgcaaacataccaatttgtaatgtggaaatagaatttaattaaattgccttaatcttgatgaaaatacttttttgtagtatgaattgaacaaactaaactttagtaaaatttaagaacttacatttagccttagcatgataaaaaaaagaatttagaagaaatgatatttcagttacttaactttaaagactaaatgtgataaatttaaattcaatgttaaggaggaagaagtcaagatggcactcaggaagaggaatgagagtgataagtgaattcagcaactaaaactgtaatatacaggttcatgcactgggactgactacgcaaacaaatcaacccatagagaatgaggaaaagcagactggggtaatggcccacccagaggcagcacagagccaaatgaacccccaccccagacaagggaaatggtgagcgattgtgcaaccctgcctgggttcttctcccatggacctttgcaacccccggatcaggagatcccctcatgggcccacaccaccagagccttgggtccaatacacaataactttcgtatttcttttctttttctttcttttgagatggagtttcgctcttgttgcccaggctggagtgcaatggcgcgatctcggctcaccgcaacctctgcctcccgggttcaagcgattctcccgcctcaggctcctgagtagctgggattacaggcatgagccaccaggcccggccaattttgtatttttagtagagacagggtttctctatgttggtcaggctggtctcaaactcctgacctcaggcgatccttctgccttggcctcccaaagtgctgggattacaggcatgcaccaccgcgcccagccaactttggtatttcaaagttagtatcttacccataacttttgtctattggaagggctgtgtggagtctcagcagagcagccacttaggcacacacagagaaccaggagttttagatactctggccctgagatcccctgcaaggcaggccgatccatctgtacatagccctaggaaaggggctgaatctggggaaccaaacaaaatcattctgtggaccccacttccacagcacctcacaagtcaagacctactggtttggaattccagccagttagcagcaacaggctgaagtctattcctgggggaggggcagctgccatctcagtggtttgatagactcagccattccagcctgcaagcactggagaatccgaagggtccagatgaggaagggtcccccacaatgcagtacaacttccctgccagatcatggccagacaacatctttaagcagaaccccaatccattctgcttcactgagcaggacctccctgtgggggcttcagccactttagccagggttatacagacagagctctaatctctccctggtacagagctcccatgggaaggagtgagcaccatctctgtggttcggtagaataagccattccagcatgccagcactggacattccaaatggtccagaaaaacaagggtccccgccgcaatgcagcacacttactctacaaaaaagcagccagactgcttctttaagcaagaccctgatcccattccccccaacaggggtctctagccacctcctacaggcacgcttgggccagcaacaagtcagcaccccccgagatggagcattcagaggaaggagcaggctatcatctttgctgtttcacaacattcactgaatatgaattgcttttgagcttaggcagaacatttagaacatttagaaaaagagctaaactcaaggcaaactcaatatattccaaaagatcagtaacacactgtcttttatgaccatatgcaataaagtatgaataaaaaagtgagacttgaaaatcatatatgtttgaaagtcaatgtcttaccaacaacttttgtctattggaagaataataataaatttaaaaatacttgaagctgaattaaagtaaaaacagtacctgtcagaattggtatgtggggaggcagagcaagatggtggaatagaaagcaccaccaatggtcctcctacaaggacaccaagttaaccatctacacagcaaaggaaaaaataataacaccattataagatccaaaaatcaagtaagcactcacagtacttggttttaacttcatagtgatgaaagaggcactaagaagataggaaaaaaaaggcctgaattaccgacaccatcccttctccatccccagcagcagtggagtctctgggtcctgtgggagggagaacatagcaattgtgaggcactaaactaagtactggccaggcatggtggctcatgcctgtaatcccagcactttgggaggccgaggcaggcagattgcttgagctcaggagttcaagactagcctgggaaacatggtgaaaccctatctctaccaaaaatacaaacaaaaaaagtttagctaggcatgatagcgtgtgcctgtgatcccagctatagggaagatgaggtgggaggattgcttgagcctgaaaggccaaggatgcagtgagctgatatcatgccactgcactccaacctgggtgacagagtgagacctgagtcaaaaaattaaatttatttaaaataaaatacagtaagtgctgtcctgttggcacacaaacaaaaacaaaagcaaactcagcctgcccatggtgggagcatttaaaccagccacagccagaagggaatcaccgaccccaacaaattgaactttagtctctgcaaaccttgtcaccaagggctacagcactctgtgtctccaagaaacttgaaaggcagtctagaccacaaagacagcaattcataggtgagtcctagtgttgaaccaagcccacagacaccggactaagggggaatgcgacatactgagacaacagctgaagtgggtaaggaaacgctggtattgcccctcccctaacccagactgcactttcagctccaaaataaatcccttccttccacttgaggagaggagagggaagagtggagaagactttgttcggcatcttggataccagctcagcaacaacaggatagggcaccagtcagcgttctgaggcccccgattcaggccctagctcccagatgacatttctaggcaaaccctgggacagaagggaacccattaccttaaagaaaaagacccagccctggcagcactcatcacctgctaactgaagggcccttaggccctgaataaccagcagtgatacccaggtactacatcaagggccttgggtgagcctctgagatttactggcttcaggtgagactcagcacattactagctgtgataactacagagcaaaatttcttccacttgagaaaagcagaggtaaaagtaaaggagactttatcttgcaccttaggtaccagcacagccacaggagggtggagcaccgagtgggtacttggggtttctgattccaggacttgattcttgaacagcatttctggacctgccctggaacagagggaactgcagtgaagggtaagtaccatggcaagcaacattcattaacagctgacttaagagtccttgggccttaagggaacagtggcagtagtctggcagtattccttgtagcctgaggcggcaggtggtaaggggtgaggcttctatgcctttgaaaggggaaggaacactgggaagaactgcatcttgtggtttgagtgccagcttatctgcaatacaataggataccaggtacacttctaaggttttttactctagtccctgaatctcagatggcacttgcggatccacccagggccaggaggaccttgccatcctgaaaataaggacacaggcctcgctgtctttgccacctgccaattatagagtcccacggccttcagcgaacataggcagtagccagggagtggttacggcaggccttgagaaaggctcagtgatgttctggcttcgggtctgcccagtacagtcatagtagtggtgtccataggggtgcttgtgacacttcaccgccagatttacatggatcagaataaagagagactctctatctttgggagaaaccaagggaagagaataagagtctgtgcttagtaatccagagaattctcccaaatctggtcaaaaactgtcaagacagtacctccatatgtctgcaagaaccacagaattactgggcttggggtgccccctaaagcatatacagcttagaccacaacactcaagttctttcaaatatctggaaagtcttcccaagaaggatgactacaaataagcccagacagtgaagaataaaataagtacccagatactgaagaacatcagatagcatcaacaccatccaggaaatgaagtaaataaggtgccaggaactagtcctagggaaaaagagatatgtgatctttcaaagggagaattcaaaatagctatgttggaggaaactcaaattcaaaataacacacagaaggaattcagaatcctatcagatatatttaacaaaaaattgaagcacttagaaagaatgaagcaaaaattctagagctgaaaaatgcagttgagatactgaagcatgcctcagagtcttttaaagcagaattgaccaagcaggagaaaaaaactactgagcttgaagacaagctatttgaagatacacagagaagaaaaaaaggaaaaataataataaacaaaaaagcatgcctacaggatcaggaaaatagcctcgaaagggcaaatctaagcgttataggccttaaagaaaaggtagaaaaagagatggggagaaaagttattcaatgggatattaccagagaacttcccatacctacagaaagatacaatcaatgtccaagtacaagaaggttatagaacaccaagcatatttaacccaaagaagactacctcagggcatttaataatcaaactcccaaaggtcatggataaagaaaggatcctaaaagcagcaagagaaaagaaacaaataacatacaatgaagccccaatatgtctggcagcagaattttcaggggaaactttacaggccaggagagaatgacataacatatttaaaatgctgaagaaaaaaatctttcatcctagaatagcatgtctagtgaaaaaatccctcaaacatgaaggaaaaataaagactttcccagacaaacaaaagctgagggatttcattaatatcagacttgtcttacaggatatactatagggagtactgcaattagaaagaaaagggcattgataaccaataaatgatcacctgacggtacaaaacccactagtaatagtaaatacacagaataacacagaatattataatactgtaactgtggtgtataaactactgttaagtagaaagactaaatgatgaatcaatcaaaaataataactatgacaatttttaaagaatagtacaataagatataaatggaaacaacaaaaaatttaaagttgggggtaaagttaaggtgtaaagcttttattagtttttcttttgcctgtttgttgctttattcaaatagtgttaagttgttatcaggttaaaaaaataggttacaatatagtatttgcaagcctcatggaaacctaaaacaaacaaaaacattcaatgtatatacaaaatataaacagcaagaaagtaaatcacatcgctagagaaaatcaccttaactaaaggaagacaggaaggaaagaaagaaggaagagaaaaccacaaaataaccagaaaacaaatgacaaaatggcagaagtaagttcctacttatcaataacattatgtataaacagactaatgtcttcaatcaaaagacagattaactgaatggatgaaaaaacaagatcgattgaactgttgcctacaagaaacacactttacctataaagacacatagactgaaaataaagggatggaaaatgttatttcatgctaatgggaaaaaaaaggagttgccacacttacttcagacaaaatagttttcaagacaacagggagggcactgtaggaagagacaaagaaaggcactatataatgataaagaggtgaatacagcaagaggatataacagttttaaatatatatgcacccaatataggagcatccagatatataaaggatatattattagagctaaagagagagacaggccccagtacaatggtaggtggagacttcaacaccccactttcagcattggacagttcttccagatggaaaatcaacaaagaaacattaaatgtaatttgcactacagatcaaataaatcttatagatatttacagaatatttcattcaagagctgcagaatatacattcttttccatagcatatggatcgttctcaagaacagaccataagttaggtcacaaaacaagtattaaaacattcaataaatggaaataatatcaacatcttctctgaccacatgaaataaaactagaaattaataatgagaggaattttagaaactatacaaattcatacaaattaaacaatatgctcctgaatgaccagtggatcaacatagaaattaggaaggaaattgaaaagtttcttaaaacaaatgataatgaaaacacaacatagtaaaacctgagataaaacaaaaacagtttataactctaagtgcctatatcaaaaaagagtaaaaacttcaaatgaacaatctaacaatgcatcttcaagaactaaaaaagagcaaaccaaacccaaaattaatagaaggaaagaaataatatcagaggagaaagaaatgaaatttaaatgaaacaaaaacattacaaaagaaggaaatgaaatttaaatgaaacaaaaacaatacaaaaaaaagaaacaaaaagttgattttctgaaaagtgaaacaaaattaacatgtctttagccagactaagaaaaaaagaaacaagatccaaataaataaaatcggaaatgaaaaaggaaacattacaagtgatactacagaagttcaaaggatcattagtggctattataagcaactaaatgccaataaattggaaaatgcagatgaaatcagcaaatttctagacatatgcaacctaccaagattgaaccaggaagaaattcaaaacctgaacagaccatgcattagtctgttcttgcactgctatacagaaataccagagaatggataatttataaagaaaagaggtttaattggctcatggttccacatgatgtacagggagcatggctggggaggtctcaggaaacatacaattgtggtaaaagacaaacaggaagcaggcacatcttcacatggccagagcaggaagaagagagaaagaagggaggtgctacacacttttaaataaccagatcttgtgagaactcttagcaggagaaccgcaccaaaggaggaaatctgcccccatgatccaatcacctcccaccagatcccaactctaacgttgggaattacaattcaacatgacatttgggtgggaacacaaatccaaaacatatcattttgccactggcccctttcaaatctcatgtccttctcacattgcaaagtactcaatcatcccttcaacagtcccctgaaatcttaactcatttcagcattaactcaaaagtccatagtccaaagttgcatctgagacaaggcaagttcttccacctatgagcctgtaaaatcaaaaacaaggtagttacttccaagatacaatggggcagaggaattgggtaaatgctctcatttcaaaagggagaaatcagccaaaagaaagggtctacaggccccatacaagtctgaaagacagcaaggcagtcattaaagctccaaattaatctcttctgactccatgtctctcacatccagggcaacactggtgcaatgagtggggtcccaaggtcttgggcagctccatccctgagcctttgcagggtacggcacccgcagctgctttcaggggctggtgttgagtacctgtggcttttccagctgcacagtgcctgctgtcagtggatctaccattgtagagtctgggggatggtggccctcttctcatggcaccactaggcagtgccctagtggggactctgtatgggggttccaaccacacatttccccctgcagtgcctgactagaggttcttcaggagggctctgctcctgcagcatacttttgcctggaaatagaggcttttccatacattctctgaaacctaaacagaggctctcaagcctcaactcttacactctgtgtacctgcaggcttaggactatgtggaagcttccaaggattacatttacagtttggaacctctgaagcagcagcccaagctgtactgtgtcccttttagccatggctggaactgtaatggcctcaatgcagtgcactatgtcctgaggttgcacagggcagagggccctgggcatgacccaggaaaccattcttccctcccaggcctctaggcctgttatggacacagctgtctcagagttctctgaaatgcctccaaggcctttttcacattgtttcagctattagcacttgccttccttttagttatgcaaatttcttcagccagcttgaattgcttccctgaaaatagacttttctaccacatagctgggctactaatttttcaaacttgcatgctctgcttcccttttaaatataagttcaagtttcatgtcatttctttgctcatgcatgtaagaataggtttttagaagcagtcaggccacatcttgaatgcttggctgcttagaaatttcttatttcagaaacactaaatcatctctctcaagcccaaagtgtcacaggttcctagagcaggggcacaatgttgctagcctctttgctgaagcatagcaagagtgacatttattcctgttccctataagttcctcatttccatctgagacctcctcagcctggccttcactgtccatgttactaccagcactttagttaaaacaatttaacaagcctctaggaagttccaaattttccctcatcctgtcttcttttgaaccctccacactcttccaacctcagctcatcaccaagttctaaagtcatatccacattttcaggtatctttagagcaatgctgcactcctcagtaccaattttctgtattagtctgttctcacactgctacagagaaatacctgagattgggcaatttttaagtaaaagaagtttaattggcttactgtttcacaaactgtacaggaagcatggctggagaggcctcaggaaaattaccatcatggtggaaaatgaagacgaagtaggcacattttacatggctggagcagaaggaagaaaaagaagggggaggtgctacatattttaaacatccagatctcatgagaactctatcatgagaacagcaagtcggaaatccacccccatgatccaatcatctcccaccaggccacagctccaacaatgggaattacaattcaacatgagatttgacacaaatccaaactatatatcagaccaatacgtaatgagatcaaaggtgtaacaaaaagtctcccactaaaaaaaatcccaggacccgatggcctcactgctgaattctaacatttaaacaataattaatatcaatcatagtcaaactattccaaaatatagaggaggagggaataattccaaactcattctaccaggccaatattaacctaataataaaatcagaaaaagacatcaaaaaaagaattctacagtccaatatctcaaatattggatattgatacaatattgatgcaaaaattctcaacaaaatattagcaaactgaattcaacaatatattagaggctgggtgccatggctcacacctataatcccagcacttagggaggccaaggtaggtggatcacttgagctcaggagttcaagaccagctggggcaacactgcaaaaacccatctctacaaaaagtacaaaaattagccaggtgtggtggcacatgcctgtgatcccagctcagctacttggagggtcaaggtggtaggactgcttgatcccaggaggtggaagttgcagtgagccaagatcatgccactgcactccagcctgtgtgacaaagccagaccctatctcaaaaaacacaaaaaacaatacattagaaagatcattcatcatgtccaaggagatttatccttgagatgcaaggatggttcaacatatacaaatcaataaatgtgatacatcatgttaataagatgaaatacaaaaaccatattatttaaattgacgccgataaaacatttgatgaagttcaacatctcttcataagagttctcaaaaaaactggggccagaagcaaaatacatcaatacagtgaaagccatctatgacagacccacagctattatcataccaaatggagaaaaatggaaagccttttctctaagatctggaacacaacaaagatacacactgtcaccagtgttattcaacatagtaatggaagtcctagctagagcaatccagcaaaagaaagatataaagatcatccaaactggaaaggcagaagtcaaattatccttgtttacagatgatatgattttatacttggaaaaacctaataactccacaaaaaacaactattaggactgatttaaaaattcaggaaaactgcaggatacaaaatcaatatacagaatcagtagcattcttatataccaacagtgaacaatctgcaaaagaaaataagaagtaatttattttataatagccacacataaaattcactacctaggaattaaccaaagaactaatagatctctataatggaaactacataacactgatgaaagaaattgaacaaagacaccaaaaaatggaaaaatattccatgttcattaattggaaaaaccaatattcttaaaatgtccatattacccaaagccatctacagattcaatgaaatccctattaaaataccaattacttttttacagaaaaaaaaagttctaaattgtatatggaaccacaaaagatccacaatagccaaacctacgctaagcaaaaagaacatacttagaggaatcatattacctgacttcaattatactagcccaaacagcataggactgtcataaaaacagacacatagaccaatggaacagactagagaacccagaaacaaattcacacatctacactgaactcatttttcatgaagatgccaagaacatacactagggaaaagacagtctcttcaataagtggtgctgggaaaactggatatccatatgcagaagaatgaaacttgacccctgtctctcaccctatacaaaaatcaaatcaaaacggattaaatacttaaacctaagacctcaaactatgaaactactaaaggaaaactctaggacattcttctgagtaaagatttcttgaacaatatcccacaagcatacgcaacaaagcaaaaatggacaaatgggatcacattatgtaaatacacttctgcacagcaaaggatacaatcaacaaagtcaagagacaacccacagaatgggacaaaatatttgcaaactacccatctgacaagggattaataaccaaaatatataaggagctcaaacaactctataggaaaagatctaataatcaaatcaaaagacaggtaagagatttgaatagacatttcccaaaagaagacatacaaatggcaaacaggcatatgaaaaagtgctcagcattattcactgatcatcagagaaatacacatcaaaactacaaggagatattatctcaccccagttaaaatggcttctattcaaaagccaggcaacaaatgctggtgaggatctgaagaaaagggaacccttgtacactaacagagggaatgtaaattaggacaaccatgaaggacaagagtttggaggttcctcaaaaaactaaaacttgagctaccatatgatccagcaatcccactgctgggtatataacccccaaaaaggaagtcaatatttcaaagaggtatctgtgctcccatgtttgttgcagcactgtttaaaatagctaagatttggaatcaatctaattgtccatcaatagatggacaacaatggataaagaaaaaatatataacaatacaaaagataaaatttcaagaaagtctaaaacaataattttgaaattcaggtaatctttcaatacttataacaattgaactatttttcaagtacccagagagccaatcaccttggaaataatagcaatatatagcattgtataacacttacagaacactatctttagtgtttatttttattatgttatttatttatttatttatttttacagaggggtttgtaaaggtaacaaaccccattaatagcatggccaggaattaaacccagtctccatgtattcagacaagttcagacagagagttctattagcctgcccacattccttcttcccttctttcccattaacaggaaaggagaacagatattatttcaggtagaaaagtgcctgttaaaagataattctcagcttcccttgtagctgtcagtagaaaatgcctttctcctctgctttatatgcgcttccacaaatgcatgtgtgatggctgaaattgtagtgaccatattaatccatgaaactaccttaatatgccaagtcgtgctctaaacctagaaccctgatagctatggaaccaatatactggccccagatagcattatccagactcaattcacaagaagaaaaataattccttgtacactcaagtcactgttatagaaaatggaaccgaatcctaactgacatatgctgttttctttacaccaaaggtaaagtaatcggacttcagtatatgcataggacaaaagcatttaaaaatatatacagcaatcttaattgccctagtcctacagccaggctttagtgtttgaggtttcagccttgttgacaagagagaagatgaccatgaaatatgtcttcaaaacacctatgggaaaaaattaaattgtatatggtcacaggttaattacacattatttgggtaccatcgctttaagtaaggaattgactaaaaaaaatagagaatgaaagatatataacctaaaactacaaaaacactacaagaaaaccaagggagaattctgcacattagtctaggcatagaactcatggctgagtcttcaaaagcacaagtaacaacaacaaaaataaataaattcaacttaactataaagcttctgcacagaaaaaaataataacagagtgaacagacaacctacagaatatgagaatatttataaattattcatctgacaggggattgatatccagaatttacaaggaactcaacaactcgacaacaacaaaaacaaaaacaagtaacttcattaaaaagtgggcaatggacatgaatagatattttttaaaagaagacatacaaatggccagcaagcatataaaaatgctcagcatcactaatcatcagaggaatgcaaattaaaaccactggagatagtatctttcaccagtcagaatggctattactaaaaagacagaaaataacagacactggcaaagacacagaagaaagaaaatcacacacacacacacaatagaatactattcagccattaaaagaaatgaaataacatcttttgcagcaacatggatggaattaggggccattatcttaagtgaaacaacctagaaacagaaagccaataccacaggttctcactgataagtgggtgctaaataatatgtaacacatggacatagcatgtgcaacaatagtcactggagattcagaagaacaggagggtaagaggtggggtcaaggatgagaaattacttaaggggtacaatatacatttttcaggtgatggttacactaaaagcccagactttaccatgaggtaatatatccatgtaataaaactgcacttgtaccccttaaatttacacaattaaaaaaaaagaggaaaagaaagagggaagaaaggaaggaagggtgaaagagaaaggaaaggagaaagggagaaggcaagggaaggaagggagcaacaccccagcagtgcattttcatccatacttatagcttcaattaccgtctgatccccagacccccaaatatattttacgagcatagaccacttctgtggaccctaaatgtccacacccaactgcttactgacatttcatcagaaaagtctgaagtactaaattgagcattgccaatggtgaattcaggagcttcccttcacaccttactaccttaattctttcctaccacactaattatcttctgttgagttaagcaacccaacaacttagaggtcagcttagaatgctttcactcaccttccacacccagtccatcatcaagtattgccaatttaagattctaggtatctagaatcttttcccaccttttaatctctccactacaaccaggggctacacaactgtcatagctcttcagtactaccatcgatacctctaaatctttccacttaaatccattttggcctctcttctaatctcctttacagttttgcaaccaagtgcgactttttcaaaagcaaatctcataatgcaagtaccttgcttaaaacaatataatatcttcctattgtctttaagataaagaccaaaattaataatataacctaaaattaataatataacctggcctctggtatatcttcaatatatcacgttctatactccagcttctctgacattctttatgttcatcaaatgcatcttcctcatgccacacctgagtctttgcatacgttgttctgtctgcctagaagttattttcctacctcttctttactccatgcttctctatttctttattccaactcagcattaaaatctcatcccaaactctccttattgaggaatttgcctttgagtcctagttatctgatatgatatagtgtcctcttatagtatcttattttgtcttatacatacatatatttttgttttgtttttttgaaatggaggcttgctctgtcgcccaggctggagtgcagtggtgtgatctcagctcacttctacctctgcctcccaggttcaagtgattctcctgcctcagcctccctaatagctgggattacaggtgcccaccaccatacctgggtaatttttgtatctttagtgtttcaccatgttggccaggctggactcgaatacctgaccttaggtgatatacctgcctcagcctcacaaagtgctgggattacaggtgtgagccatcacatcatgcccagcctttgtcatatatttttatctatagcactaaatcacaatggcaattatatacctttctgattatttggcttatatctgcctgtgccctaccccagaatacacactagatgctctaagaaatagataactgcctttctcattattgtactcttatacagaacttggcacaaagcagatgctgatataaatatatatgtggagagatagatatatctatatataattgatattataaatgaataaatacataaatattccaaaatattattaaaggctttctttcaataacagtgctctggatttttttcctccttttaactactcttttttttttgcatttactactccagtactattaatttctaaagatgtgtaatttttttaaatactgaaatgaagagaacgattagattctctccatataagtaaggcatcttaattgatccaataacactaactcattcctcgagagcaatggcctttgcaaaggccaaggcattcacagaaaacaagtgaccagaaaaagtccacaaaaatattttttctcagtataataaacatgtgtaaacccagtcctgggctagaaatagaaaattccaattatccttaagcatgacctccagtttctacacatgtcccatgagtgcattttcatccatcatcattaaaaaaaaaagaaagaaaaggaaagaggaaaagggaaagaaaaagagaaaaaaaaagaaaatgaaagaaaaaaaaaaaagacaagaaaaggtattccctccagaattgaaaaacctgtaaacctttgacagagtacttagatcttgagaacctgtccaatgttcagagtttaaatgccattttactttaatccctttgcagggaacttgcttactttatcctgatctttctactgtgtataaagtcaaatagcttgttctcttcccacacggagctcctgctccagagctgagattcttttgctgattttgacctatgcttttcttttttggacctcttccctcttactaattgacatatggtcctgccataaaaagcgtccatctgagatacacaataaatgttttttaagtgctggttagcactatatcagttatcattcattttaggaaaagaaaaagcaagcattccacaaaggtgctggcatagtcttcttacatgtccataatttaaggatttttagcatttgtaactcttattattaaacatggtattagttactaaaagtgttttcaaaatgctaaataattataagcatcctcgtgaagaaaactaattgattcaaacaaatgtctcccttgtttgggtattaggtaggaatattgttttaaccactttatttttttctgaaattagacaaattaaagccctattacttttggttggtattttaaaactacttggataaaacatctcaaatatcctactttgtccaaggaaatgcaggtttatgttaggctgggttttactgtttttctctttttgtggtgatgtttgattttagtcattttaaaatgctaggtattacatcagttgtttcctgaaacatgtatcaacattcctcaggagtccacggcatcataaagttttgggagtccctcttactgacagatagcaggatgtaagaataatgaagaactttggcatcaagcagacctaagcccaatctgtgctcaacattaaataactatgtgaccttgagcactgttttacttgagtttcaaaatctacttttgtaaattgaatctaataatatatacctcatgagtttgttttgagaatttattagaaaaatacatgtgaagcccctgccacaaattctaacaaaactttaacagaacgctagtaatttttcatcagttaattaatgtattcattgaacaaatgaaaacacacctgctcactcatattcaaaacattaagtccgtttttattgtttctttataatgactcttaatgccagtcagtatatgactctgagatattttccatgtacaattaatacttagaagagaagttgcattgaaatctgacatgatgccacagacataatctgaggtcctgagatggatctccttttcatcaaatctatattttttgctggactctgtgattgctcagtggagacacttcatttggaagatagaatcgtgtgtatttcccactggaagaccagctccccgcttcagtcttcatgcctctctgctatacccatcagtcagaaatcccacatatcggcaccaaataaacactgtctcctttgaaaaaaaaaaagtcaggatgatattttaaatcctcagaaggtactgtttaagtcctttcttctcttctaagacgtcttctctcattattagtgaacccagtgacactatagattcaccaattcctctaatttcctggagtgcatagtcccatcacctgtcaaactaagtgtctcaaggaatccttctccctcagtttctgccatggtcagccttctcttggggccacaactcacttatttttcagttagagaaaaagtctggggggagacaaatgcttttcaaacatacttatgttattgtaaacatttctctgagctcacaagacaaaatatccaaatagaaattggcttaaagctctgtttttccctacaatgcccttgtcttcatccattttcctcagctggcacgctcctactggccttccctttatttaaacccagaagtcattttgtaggaaacattagtacatctccccaccctaccctcacacagagatgtccctttcctatctcatgcacctatttacttctggtatttcccatgttaaacctttatttctgcatgctgagggcttggaaaaactctcgaagtttattgaatgtataaacaaacatcacatcacaaacaaaccagaagtcccattggatacagccacacagactactgaactaaaaaagcccccaagatttgcacttttcctcatcttaatacagtatccagcagtgaactcactcatgtcctctctctcagaaacgtcttaagactatttggcattcagttttatagaactctaatatgagtcatacatttcaagaattttatttctttattatgtctgtagttttgtgaccaactgtagctcactcaaatccccacccgccaaggcagtagcattttcattgccagggtgtgacctacaatccttcagaaagactctcaccaggataagaagcctgaaagctaaggaggcttctggcatctgaagctcaacagaggtgaaagagtgagttgggagagaaagaaaaacttgtctttattccatccttttgttccccaaagatcaatgtaggctgttctctctgtggcctgctatacatataatatatccaccatggactggccatgtccccagtaacaggttatttatcatgtttgtttttaatccccaattataactatcttattaatggggaaatctgatccaaggactacaaagagctacatgatacctattgattatgactttggtgatatgttatataaactgctcattcttgctatctatattaataataatggctttgaaattgctttatcaagttaccttctcactgcctctagcctagaagatgatactggtattacattggtctccatagagcctacgtttttgttttactaatctatcttgagagactacctacaactccatattgaaattccttgcctagaatacaatgctggcagaaatatgcactcactctggtcatgagcctactttccttagacctactttttgctttaaccaggccacctcattgtactctgtctctacccatgactcatgatactcagtttcatctctgtggctttgttccaggtgctgtctcagctggtaacagcctctgaagtcctcccagttcgtctaaatcctatttatctagatcaagttcccatctacttggctcaacctggtctagccacgttgaagctaaatgtgcacattccataatggtcgttaccggggtagggttagaatactgtaagaagctgcatcagggtccaggggacactcttcctgtgggaatagtgttgaaagtcttgcctgtcatgggtgcgagaatgcccatcttgtggtggcttctcctacatttactatccagccagccctaatagccaagacattcatgagagaagacacactctttggatagtatgcttctaatttattgcaacatccaaagaaagaaaccaggctttctcacataccatcatctcacagtcacaattcctgccaaagaacaaaatactcaatgtctaaaataaatgcagaagggggttgccaatccagaaaacttgctaaaagtgagtttcagaagaggaaattcagtcaaggcagctggctaccacaaacgtacacagcagacctgatggtgggaaatagcaatcaccttccatagagtcggatggagtctagaggagtccaccattcccatgggaaagtgtctaggaaaccacatccggttgactactgtaacgttcttcacacaagaaatgatataagattatctatctggtagccagtttcatttataaatataagaggggtcagagacctcaaagattttatgtcaatgactttatttgtcatggatgtacttctcagaagctttgtgccttgggaaagatacttaccttctctttacatcagtctgactttcatctctgagatgaaacatatggtaatggggtatagtccccttggggcaaaaatgctgctctctgcttcttatattgttacattaaattactatcagctctatgaaatcatttccaattataagttacgatggaagctccctgagatgtcaccttcctggaagaccccctcaattacttggaatgactaagttaactagtatgcctccagtcaagatgttccatgatattccactttacctcactgaaaagacatgatcttaacattaatgtgcaaaataagtcaattctgtctaatttctcataagaagtagctgacatttttggaaatactatatttattttttatgataaatcatattaaataccctgacctctcctgaaaaaaaaaaaaacacacagccttatgaagtttttactccttccaatacaatactgcttatttagtacactgaaattctgtttgccttgtctctaaagctctcacagctaaattttaactttctattttgggaacttatcatttcagtaattttccagcaaaataattttattcacaacttatggaatgactagactgtttcacagacgcgtccagagtgtgaagttaaatgtctcattgaacagtaagctaatattaatgagaaatggaagttctgtgtcagaatctgataaacctaaaagtttgaaagctttgtccacttcttatatcaatgtattcccacagtaagcaagggtaagagaggtcttgacagcctggacaaaatgtcagttaggatctgtataaataaataatgtaaatgattttatctggaaaaatcagttttgtccttattaaattttgagtaaagatatttctagaaactaaatatatctcctgtcatcctcagaaatatccctctgcttctacacaatatccctctgcttatacacacacacacacacacacacacacacatacacacacacacctgattgatgacagtagcattagtatagttccctgtcacatgtttctcacattttcacacacctattaaaataagctaatgctcccattttgatggattcttcagtaagaaaaagggcacaaggtgaacggatctctaaaacccttctgttaaaaaataaagcatatcatgtttgttccattgaactggcaagctcattttgcttgttttattataattattgtcttagataagacaatccattgaactgtagctagaattttgtgtactacgctgactcaaaattcgaggctaggaagacaatttatgtttactgagtgcctgcagtatactataatattagatgtgtattgtattgaaaccttaactcgatcctaagctccttttacaggtttattcactcattcatttgtgtattcctttattgatcaaacatttattgtatgtttttgatgtaccaagcatgcttctaggctctgtggacacatcagtgaattaaacagacaaaaactacttgcctaggggaggtctcacattctaatgtggacaaatgaggtaatcaaagcttaaaaatgctatgcaacttgcccaggatatttaatatttaagtgtttcctaaaatctggttccaggaacatctattttaaagtcactgaggatgcttatcaaaaggatgattccatctcacaatcatagagtatgggtaagttccaggaatttgttgtttttgtttgtttaaagaaccacagtggtccctttatgcacagagatttctgaaagacctggagcaaaccaactaaaggtgtttggcgtcatgcttacatctgtccagatttctatctcagagaaaagtaaaggtatataaaataaacaaagagatgtttagagaagcattgtttataatagaaaaaaaaaaagagaagacagaaaccaaatgttcatgaattgtgttcaccaattgtggtaaattgtggctcatacatactgaaaaaatactctgcagccatgtgtacacatatacacatacttagaaagattctcacttcccaatgttaaacagaaatcccagttgcagaatactatataaaatatgattacctactcatcactataggtacaatttaaatgtggtagatatgtacgtatttatatgtttctataggcacagaaaagagtatgcagcaaagcgtcagtgtttacatcatcaagaaaaagaggaaggggaaaaatataattttaaaaatgtatatacttttctattttttaattataatagcatcattttataataaaaacatgaagaatggtttcatgaagaaatacatttaaaatataaatacagaaaaaaatattccatagaaaaataatgctttcctatggaaagtaagagggtaacctgtgagtgacataatgagatacaagaaagtcttggattacagatgagaggcatggatgctaaccaaaagatttcaggcttcaggaggatatgagaaataaaatctatattcctagtttctgatatccatagtaatcttatggaagaattccacctacttatttcaagttgtcagtatctctttacttcatgaaaacatgctcttattctttactactcagttcttccccccgatcaaaaacgttacactcaaactaaattttagggtaaactcaattacttagcaacatctatcaggctacaaggaggttttatttttcttagaagggtaaatcatttctcaccttaaaagaaaaatgcgtggttgttctctagagtaatcaattgattgtggtgtttctttttttagtcataggtcacatgggaagcaagtagaggaaatggttattggaaaccaccggaagttcctgaaaatagctatccaacaggagctatagccttgggcaaacacacacagccaatggccaatggagagagaacagagaaacactctaacctctctttctttccatactccaatcttctgatgctcccacccattggccaattccaaccaaaagctgacaaaacagggagcatggtttacacaatccatagaggacaaccttctagaacagagagcaagatataagtggagagtaaatctggagaggaaaattgagagtatccagcaaaaacatgtcatgaatttctacgcatcaagttctaatccttatgttgaaattgccagctgtgaatgagctgaatgagaccacgtccatgaatgtttctttttcactaccatggaacccacaaatcaaaggtattctctttcacctagtattaacaacttctatttttcctgcctgagtctattctcagatactgttaaccctggctgattgacacagggatctcaaatgtaatcctaactgacatttactcttcctttaaaagctgcttaactccagtccatggagctattagctctccctggatttgctacagaaaaatgccagacaatgatggcctaacttttaacgactgttgaataactatattcaattattttgcaagggatcgggaaactgtaattaaaggtgctagggggcacttggccctcagtgtagctttaggtctgctataaatgaagaattctcaggaagctgccagctcacaagatggtctgtgggtctgtcctagcactttcttcatgattatccaaccagtgactggtctagtattatgtccaattcattctgtctactgacaaataaaatgctttctgagaactacttggcaattgtgcaattagaagaggtttatttacagctgatgtaaatacagtttttccagtaataggtcctcatcaactctagctttaagatggaagggtattaattaaccactaggagtcaactccagctatatttggaacattcccatttctaatattttatcactcccattggctttagtaatttttgaaaaaaataaatatttgagacttagaaaatgtttttccatagctatgaccatcacttgttgggtcataagattgtttctgattaatttgcaagctactatacaccagagcctgagaaatgttttacagcagcggttcccaacctctttgccaacatggacgggtttcctggaagataatttttccatggggtgggggtggggtggaggccgggggcgttaggtgggggtggtggggggaacagtaggtatatgttcaggatgaaactgtttcacctcagatcattgggcattagttatattctcataaggaatgcacaacctagatcccttgcctgcgcagttcacaatagggtttgcactcctatgagaatctaatgccacagctcacctgacaggaggcggagctcaggtggtaatgcttgctcatttgccactcacctcctgctgtgcggctcagttcctaacaggccatggaccagtacctgcctgctgcccagaggttgggacacctgttttagacaactgagattttttttttccttaataataatagctcctatgtggggaatacctaccatacaccagaaaccatgctaagcttttagataatttatatgattaattctcatgacataagataaatagcactatcatccttagtctgataagactctatggattagagaggttatacacttgtccaaagtcattcatacagtaagtagtagagcccgtaaaatcagaatgcaggtttgtctgattccaatgcccatattcctaccttccctggtatttgttcagctaataaaacacctgaaagaacaccaatctcattgcctcagaggtccagattagctgtgtacggggaatgtaattgtgtacgtaggtggtaacacatgaactaaacattagatattgttattctttctggaggtcaaagccttatgaactctttatggttcctgagctccattaagagtcatgagcttacaggtgggaattgaatttttcatgtgccttttggggagaactccttgagttttcttttgccagtctgggaactgtacagcctcacaatgggtgtcagcaaccacttggataggaagggacagcaggggtttgctagtggaaagatgatgccaaagaatgtttctctcagtccattttcttttagtaagatatgacttgtactaaagttcaagaaaaatcagcttttgggtgactaacctaacctttggagaacaagtatggtgtgcagaatggggtcaaattgaaataagttaagaggcagaattatttatagtgataacaagaaactctactagattcagacaccattagttggcactgatatcctcagggatctcaggacctaatgtgtgagcaaaataataaaacagttgttgatgacaatgatcatgtaaagctatagtatatacaggtatggtcctacatatccaaaagaatgtagtatcagattaatttctgaacagtatcttttacataataaaaagttattttgtaccctcatgtgatatttgaaagttaaaagaatatcctagaggaacagtactttaaagaaaatccctgagctagaagaaggctgcagatgtcagtggtagtacttactaagtggagttgtagcagggaaaggagaaaggcaaatccatcattccagttaaaatgtacaaaaagtacattcaaagagaaagataaatttccattgcttcataaactcctttaaaagcatccttcaactgtccttgccactgattaacttcttgaatagattagaatctccccaaaagtatgttccatggccagctcttagttgccactagagctgccagtaatgtgaaatgtctccttcaagacacacaatagagtaaaatacaccgcacatgggccataaacccacaaggctctttgtgtgtccaatgatcaagaaacacagaggtcagaagggactccagaacccagggctgacagcaacagtgccaggtcaccaggattggactattctaaggcccagagtaggagtcttcagaaagagtctgtgattaacctttgagatcacatataaagctcagataccatataataaatatgttacctattttttttttaaagtatgaactaagggatagtagaatgcttactttctctcccaggctattaatgacaacttggcatttcagccaagaacttaacctcttttagtctactcccacatacttgatcaagtcttttatcctaaacaaatatgcaggcgaacaaatgacagagctaggattcacgccatgatctgtctgactccaaagtctgagctatcaagcactacactcttttgcttccactaagtaaaaataaatcattattaattttaataaaaatgaatgtgtttgatgtaaatttgaatttgctaccctgattcccataacatctcctccaaaggtaatttatggaaatgaatgaaaatctaatagagtcgatatacatttgaaaaccagttctccaaataaacaggagtatgtagagttatttaaacaataaaaagaataatgcaaatctgtttattaactctgaggtatatgtctatgagtgttgttaattctggactaaaatggtacttattttcagtaaaaagtaaaataggaaaatctgtagaaatctgacaggcagagataatgtttcacataggtctcccaaggtcatttgactattaaattatagacatgaagttcaagtgtaagtttgttattatttcaaagtacattctctttccactactacacagtattaaagatatactgcaatactttcatgtagaacacagttccctgcattaccatataattcttaacaagccattaacttgacttacttctaaatagtttaactgacatgtcagcatatcaacaaggagtattgtttattacctaatttatattttaaagagtttttaaaagtcaattttatcaaaaatattaccattagaagttactgaaacatatcaacaacccaaactttcaaagacctgatactacaaagtccaaatactagttaaaaattcaagcattaaaataaaattggagtggactcagaaaaactttcagttcaggagtaggggaaaatggtagatagtaggcaggactaactcgcaactcccactcagacaggcagagcagcgcatggagacccacaacataaagttttgcctgagaactaccacaagaacataccagaaacgtcaagggaatccacagaccctttgaaggaggcgtactgccactgcaggctccatgggacagccaaggaactccgaagacaaggaacataatctcttgggagctctatggccccacccaccacctgaacctttctataataccacagctaatgtgctcttgaaagtgtcaccttctggatagaggccaaccaacataaaatcagcatacatttatcaaaaatacaaccaaggaccctcacagaatccacttcactttccttctacctccaccagagcaggtgctggtatccatacctgagagtcctgaagatggatcacatcacaggaatctttgcagacactccccagtatcagcctggagcctggtggccccactaggtggctagattaagagagaaataacaagcactgtagttcagctatcaggaatccccatccctaagggaaacgggagagcaccacatcaaggaagcaccccacgagacaaaagtatctaaacagcagcccttgagtcccagattgatcatccctctggcatagtctacccaaatgagaaggaaccagaaaaaccattctggtaatatgacaaaacaaggttcaataacaccccagaagatcacaccagctcatcagcaatggatccaaacctagacgaaatatctgaattgccagcaaaagaattcagaaagtcgactattaagtcaattaaggaggcactagagaaaggtgaagtacaacttaaagaaattttaaaaaaagatacaggatatgaatggaaaaatctccagtgaaatagatagcataaataaaaaacaatcacaacttctggaaatgaagtacacacttagagaatttcaaaacgtactggaaagtctctgcaatagaattgaacaagcagaagaaagaacttcagtgctcaaaggcaagtctttcaaattaacccaatctgacaaagaaaaaaaggaataaaaaaataaacattgggaggccaaggtgggtggatcatgaggtcaggagatcgagaccatcctggacaatatgttgaaacttcatctctactaaaaatacgaaaattagctgggcatggtggtgcatgcctgtaatcccagctactcaggaggctgaggcaggatattgcttgaaccagggagctggaggttgcagtgagccaagatcgtgccactgaactccagcctggtgatacagcaagactccatctcaaaaataaaaaacaaatttttaaaaagcctccaagaagtttgggattatgttaaatcaccaaacctaagaatagtttgtgttcccaggaagaagagaaatctaagagtttgcaaaacacatttgaaggcacaatcaaggaaaacttccctggccttgctagagaactagacatccaaacacaagaagctgaaggaacacctggttaattcatcacaaaagatcatcaccaaggcacatagtcatcaggttatctaaagtcaagatgaaggaaaaaatattaacagatgtcaggaaaaagcatcagataacctataaaggaaaacctatcaggttaacagcacgtttctcaacagaaaccctacaagctagaaagaattggggctctatctttagcctatttaaacaaataataatcagccaagtattttgtatccagtaaaactaaccttcataaatgaaggaaagatactgtctttttcagacaaatgcttagcgaattcaccactacaaagtcagcactacaagaaatgctaaaagaagttctaaatcttgagacaaatcctcaatatacaccaaaacagaaccttcttaaagcatgaatctcacaggacctatataacaataacacaatggaaaaaaaaaacaaaacaaactattcaggcaacaaatagcatgatgaatagaatactacctcacatctcaatactaatagtgaatgtaaattgcctaaatgttccaactaaatgatacagaatggcagaataaataagatttcgccatccaaatatttgctgtcttcaagagacttacttcatacataaggactcacacataacttaaggtaaacaggtggaaaaagatatcccttgcaaatagaatccaaaagtgagcaggagtagctattcttatatcagacaaaacaaactttaaagcaacagcagttaaagacaaaaacagacattatataatgattaaaaggactagtccaacaggaaaatatcacaatcctaaatatatacacacctgactctggagctcccaaatttataaaacaattactactaaacctaggaaatgagatagacagcaacacaataacagtaggagactttaatacttcactgacagcgcttgacagttcatcaagacagaaagtcaaagaaacaatggacctaaactataccctacaacaaatggacttaacagatatttacagaacattctgcccaacaactgaagaatatacattctattcatcagcacatggaacattctccaagatagatcatatgacaggccacaaaacgagtctcaacaaatttaagaaaattgaaattatatcaagtactctctctgaccacagtggaataaaattggaaatcagctacaaaatgaagcctcaaaaccctgccaatacatggaaagtaaacaacctgctcctaaatgatgtttcagtcaacaaataaatcaagatggaaatttaaaaattctttgaactgaacaacaatagtgacacaacctatctctgggatacagcaaaagcagtgctaagaggcagttcatagcattaaatgcatacatcaaaaagtctgaaagagcacaaatagacaatctaaggtcacacctcatggaactggagaaatgagaacagtccaaatccaaacccagcagaagaaaagaaatgatgaagatcagagcagaactaaatgaaattgaaacaaaaaatacacaagttaaatgaaacaagaagctgattctttagaaagagaagcagaattgatagaccattagcaagattaaccaagaaaagagagaagatccaaataagctcaattagaaatgaaatgggatattttacaactgataccacagaaatacaaaatatcattcaaggcttatggacagctttacacgtataaactaggaaacccagaagagatggataaattcctggaaaaatacaaccctcctagattaaaccaggaagatatagaatctctaaacagaccaaataaccagcagcaagattgaaatggtaatttaaaacttgtgaacaaaaaaaaactccaggaccagatagattcacagctgaattctatcagacattcaaagaagatttggtacaaatcctactgacactattccaaaagacagacaaagagggaatcctccctaaatcattctatgaagccaatatcaccctaataccaaaaccaggacaggacataaccaaaaaagaaaactacagaccaatatgcctgatgaacaaaaatgcaaaaatcctcaacaaaatatgacctagctaaatccaacagcgtatcaaaaagataatccaccacgatcaagtgggtttcataccaggaatgcaaggatggtttaacatctgcaagtcaataaaagtgatacaccacataaaaagaattgaaaattaaaatcacagatcatttcaacaggtgtaaaaaaaagcatttgacaaaatccggcatatctttatgattaaaaccctcagcaaaatcagcaaagaagggacatagtttaaggtaataaaagccatctatgataaacccacagccaacaacatactgaacaggaaaaagttgaaagcatttcccctgagaatggaaacaacatgaggatgcctactttcattacttgtattcaacatagtactggaagtcctagccagagcaattagacaagataaagaaagaaatggcatccaaatcagtaaagaggaagtcaaactgttgctgtttgctgatgacatgattgtatacctaaaaagttctaaggactcatctaaaaagctcctagagctggtaaatgaattcagcaaagtttcaatgtacattaattttgtagccctgctacacaccgacagtaaacagggtgagaatcaaatcaagaactcaacctcttctatcatacctgccaaaaaattaaatacttagaagtatacttaaccaaggaggtgaaagacctctacaaggaaaactacaaaatgctgttgaaataaacattagataacacaaacaaatggaaatgcatcccatgttcatgaatgggtagaataaataccgtgaaaatgaccatactaccaaaagcaatctacaaattcaatgcaattcccgtgaaaataccatcatcattattcacagaactagaaaaaaagatactaaaactcatatggaaccaaaaaagagccaacatagtcaaagcaagactaagcagaaacaaaaaatctagaggcattacattacccaaattcaaacttcactataaggccatagtcaccaaaatatcatggtactggtataaaaaaatgcatatagaccaagggaacagaatacagaacccaaaaataaggtcaaatacttacaatcgactgattttcaacaaagcaaacaaaaacataaagtggggaaaggacaccctattcaacaaatagtgctgggataattggcaagccacatgcagaagactaaaactggacattcatctctcatcttatgaaaaaaaattgactcaagatggatcaaagacttaaatctaagacctgaaaccataaaaattctaaaagataacattggaaaaacccttatagactttggcttaggcaaagacttcatgaccaagaacccaaaagcaaatgtaacaaaaaacaaatataaatagatgggacttaattaaaccaaaaagctcctgcacatcaaaagaaatatacagcagagtcaacaggcagcccatggagtgggagaaaatcttcacaatctatacatccgacaaaggactaatgtccagaatctacaaggaatgcaaacaaatcagcaagaaataaaacaaccaattccatcaaaatgtaggctaaggcaatgaatagacaattctcaaaagaagatatacaaatggccaacaaacatatgaaaaaaggctcaacatcactaatgatcagggaaatgcaaataaaaacccacaatgcaataccacctcaattctgcaagaatagccataatcacaaagtcaaaaaatagatggtggcacggaagtggtgaaaagggaacacttttccagtgttggtgggaatgtaaactagtacaaccactatggaaaacagtgtggagattccataaataactataagtagatctaccatttgatccaggaattccactcctgggatctaccctgagttaaagaagccattatacgaaaaagatactcgaacactcatgtttatagcagcacagttcagaattgcaaaattatggaactagcccaaatgcccaccaatcaatgagtggataaagaaaatgtgagatatttatatctatatctatatattatatagatataacatagaatactactcagccataaaaaggaacaaaataatggcattcacactaacctgaatggaactggagaccattattctaagtgaagtaactcagtaatggaaaagcaaacattgcatgttctcactcagaagtgggagctaagctatgaggatacaaaggcccaagaatgatacaatggactttggggactcagaggaaagaatggcaggggggcagggataaaagacaacactttgggtacagtgtacactgcttgggtgatgggtgcactaaaatctcagaaatcaccactaaagaacttattcatgtaacaaaacaccatctattccccaaaaacctgttaaaatgaaaaagaaaaataatgagcagtggatggtggtgatggatgcacaacaaggagaatgtacttagtgcccttgaactgtatatttaaatggttaaaatggaaaattgtatgttaggtacattttaaccacaatttttttaaaattaatgaacagtattaaaaagtgttagagaagagtagaaaataatattagaaataccattatattcatatatcatattttgttatgttgataataaataccaatacaaactattatattcatattatatatttttgtcatgttaataaataccaatacaacgcatactatgtgccaaatactatttaagcatagaaatatagcctatttcactacttctcccagaccagtcataaaattaaacctttttaaacattaaaataaaaacaaaaataacctttgagtttgacccttagcttatttcctgcttggtatttgattttatatcctcaaagcattataaaggtgaaagagcatatatttgctaaaaccttcccagtagtgactgttaattactaaagaataccctggccacccaaacttttctagagccaattacagccttctgtgaacagaggtatggatagaacaataccttatatgatacacaaaatacaagctagttgggatttttgatgcttgtcctatttatttaagtcataaatcatggaagatcaaataagataaagactgtaagaaaaagaatcttcttcttttaccctttgtttatatgggttaacatagaaaagaaacaaagactcaattgaaaagtgagaaatattattggacttataaaatcctcatggaattccctctttctaaaataagtttaaatcaaaacagtatgattcccattgcagtgtaggagtcttatagcaagaaaacaaacaggatgtgatgaaaaagaacaccaaggccagagggagagatctggatgtaatttagacaagacagtcagagaagaaatccctaccgatatgatgtgtaagctgaaatgtgaaaaatacatggttttcttagcatagctgtttgaagtatttttctatttcatagctagaagtggagtactcaagacagcactgggaaaagtgtagtttgtaagggtttgtaggataaacagtatggtttatatgaaaacacaggaggctgatagcataggcctacatggaaaataatagagaaattagcttttacatatgatgggaaatcactaaaagggagtaacatgatcaaatttctttttaaaattctctgtgtgcaggctgtgtgaaacagatagacttgaggggctctagacagaaagaccagtgaggtggctattgaaatagtctggaaaacgtggtggtgatttctgtccagagtgatgaacagaatattattaaaggtctacttggatgtaaaattaatacacttggccgataggttgcatgcagaaatggaaatgaagacactcggccaataggttgcatgcagaaatggaaatgaaggaaggaaaggttaattctcagttgccagctccaggcactgaatggatgggttgaggggagggtgtcactgactggggttgagcccaggaagactgagaagacccactgtgggaggacaaagcaaaggctccatcttagaaacattccatttcagatacttgtgagacattccagggaatacaacaagtaggtaattcattaggtgaatgggatgcagtccaatctggagtttttatactgccagtaactcaggatcttgagttttaatgactacacaggggacaaagaagaagccttaggtctgttcaagatttgaatatatacatttttataaatgcaaaactccaagggcatacgcactcagtagcagcgaggacaggggaaaaaaactgcaacagtggaagatgtcagagaacagttttttaggcaggactctgagtacaagagagaaaaaggctcccagtaaaatttgctacagaaagcaaattctcatgcaagtttagatgaattcgtattacctacaatgtccaaaaaactattatatcttataaatgttcttttgttgataaattaagttttaggattctctttttattgtatatatttaaggtatataacatgatgtttcaatatacacatatggaatgaaattgttactaaggacaagcaaattaatatatccatcatctcatatcgttaccattttatcatggcaagagtacctaaatcctactcttttagtaaaaatcccaaatacagtacaatcctattaactatattccttatgttatacattagatctctagattgttcatcctacatatctgctactttgtgtcaattgtactacatctccctatttcctaccccacctcaccaatgataatcaccgttttattctctatcttgtgtatctgactttggaagttaatttaaagttgtcctgaattcaaagtactccctggtatctggtaggaaataatccaaatacaaatatgtaatcacaataaacataaaatttttctgttaaaaacagtaattatcagactatatttgtaaaaatcatctagccatacacctaaaataaaacacacaaaggaataaaagtattgataaaggcataccagtaaaatactacgggaaaaaaagctgagaaacctatttaatatcaaactgtatatgtgttaaaggaaaaagtattattagcaataaaaagggtaattatatgataatagtttcaacaaatataatttttataaagttgcattcccctaataacataggttaaaaatagtaagaaaatcagacaggacaatagtaactaaatgaaaataccagcacaataagagattttaacatacttctatcagtcaattataggtcaagcacaaggaaaatcagccacaatgtagaaaaatttcagtaacacactctcttcaaaaaatgatgctggaagccgggcgcggtgactcacgcctgtaatcccagcactttgagaggccaaggcgggcggatcatgaggtcaggagatccacaccatcccggttaacacggtgaaaccccgtctctactaaaaatacaaaaattagccaggcgtgttggcgggcgcctgtagtcccagctactcgggaggctgaggcaggagaatggtgtgaacccaggaggcggagcttgcagtgagccgagatggcaccactgcacttccagcctgggcgacagagtgagactctgtctcaaaaaaaaaatgatgctggaaaaactgaatatccatatgcagaagaatgaaactagatccctatctcctaccatatacaaaaatcacataaaaatggattaaaggcttaaatctaagacttcaaactatgaaactattacaacaatgagtaaactagatgtcatggacccaagtagaaccaagcattcaaaaacttgagaatatacagtcttctgaatcatataagaaatatatagaagactgaccatgtgccaatccatagcacaaatttcaacaaattttaagaaactcatatcatagagacttatcctatgatcacaattaaataggttgtgttgtgttaaaaagttatccctaattcccagtgacttcagatatcagaggtatatttccccctcatgctacagctccaatgcaggacagcagaaaacttggctcttcacaatcagccaggaacccaggctgaagtaggcttgccattttagtttctggaatgtacaatattctccactgatcaagagggaaagaaagagatggaggatcccacgtcgactcttaaattattacacttggcccaggcacataacacttccacccatgtgcatttaacagagcaagttaaagagcttgaactaattgcaagggggctgggaaatatggaagacctcatgggtatcttgagagaagtataaagttctctgctcacacccagctttcggatcactttgctgccttcttcctgcacgtagagcacattcaacacctctccaagttgatttaataacacaaatgcagaacctcaatatatgcaatttagcacacagaagaaaacatataatatcatattttaagggaaaatataacttgtaattatttttaacttaattacttataagttaacataataactcaaattttatgcattataaataagacaactataaagtattgtgttgatatgggcaaatagattttaaactttacacagaaaaaaaaagaaacatgcaagaaaatccaagaaaacactaaagaaaaccatgatgggaaataactcaccagacattaaaacatagtataaacactgtaaataaaatggtatggtacaggtacatgcgttgacaaatagactagtggactagaaacagagagactccaaatggtacatatgtgaatttagtatatattaaaagtgtcatctcaaattcacaaagataaatgttttaaataaataatgcttaggaatcttgttagtatttgggaaaatataaaattagattcagttcataccatgcataaaaacaaactttaaatagatcagggacttaaatgtaaaaatgaaaacttacaagtagtaaaaaaaagggggggggtgaatttttctataatccatttatagggaaaggctctgaaactgtgacttaaaaatccagaggcaacaaaagagaaaattttaaaatttgactacatagaaattgttttaaagttgtcatggcaaaaaacatatcagaaactaagtcaaaaggccactgatgaaatgggagaaaatgtttacaacatgtgctgcaaagggctaatatccctaatatgtaaagaaccgctaaaatttgatgaacagagcattaaaaattcaatactaatgaagaaaagacataaacagataattcacaatgaaaagattttaaaacagtctttgaggacacaggagtcaaccttgaaggaacttctcacaggcaaaagcagggacaatttgagtaaaaaaataggtaatgataatagtgaatgatacgcctcagaataaatatctgtccataagtccatctaatataaataacgagaaagaataaaaagaaaaggaaagcaacaagacagttcttccttacattagaattccaatcgattaatgtagaaagaataaagcaaagagaaacggaaaatatccaataggcggataccacagtagtaattgtcataggcaagagtcgtctattaataagaaaattagcaggcaaaagtataagaagaaccagaatactcacagtctcaaatatacttactaattgaactacttaattcatattaaactaatttattaatttaaaaagaaaaacagtaaatttatagtcaaaaaaactaataattttctttaacttcaacacgttaaacaagctaccaaatataacatcaccaataagaacatatatcaataacatacagcttctgatatgatacactgcaaatggtataaaatcattctggaatattcctgccaaatatacgtaacttcaaactaattatgaaaaatcataggctatacccaaattagtgggacattcaagaaaataactgttaagtacccctccaatgtgtcaagatcatgataaagacaaactaaaaaatgtcacagattggggcagattaagaagagatgaaaactaaataaaatgtgttatttagcataagttcctgaatctgaaaaagtatgttagcaaaaaagtttgcaaaattcaattgaagtctttagatgggtaagtaatattgaatcaatgtgaatcttctgatttgggtcattgtgccatgttccttttggaagctgaccttaagggaagctttgtaaagactgttccataactctctgtactcttttgcaactttttataagtctaaaattatttcaaaatatgtttatgatataattgagtgtctaaagcagaaagcagtaaaaacatattgtaaggtttaaaacatacatagaagtaaaactgggacaaaaatagcacaaaagatgggaggaaagaaaaaagtatgcttttgtgaggcttttatactagatgtgaagtagtatattatttgaaagtagactgtgaaaaattagtaatagtgacatgtgtatgtgtatacatatataaaactctagagcaaacactaaaaattaaaatggtataaacaattgaaagaaagatagataaggcagatacatagaaaaggcagaaaatatcactatatttacttacaaaattctatgatgaacaatgaagagacaacaatagaatatataaactattcaaatcactaagtttagcatgtttattaataaaagatgaatatgaaaacacatttctgtatactaggtgagaacacttagaaaaaaggtgctatctttttaagcaaagatactgagcttaaattctggaaatagctgtattattttaggccacacattttgctgaaaacagctagaaatctggaggtacatttcatcaaaataatgtataatgtcattaggaggctaattagaatagcagtgaggaattgtagggccaatatctagatcagtaggtaacacagagaaatgagccccgcatttgcagcattttttttccctcaaggccatcagtgatatgtgaaacaacagactggagtctaaggacagaacatacagaatcattgacttacttcatggaggctaacatccttcaggttcatctatactgtcccaaatgacataaatcccccctgtttaaagctgaatagtattccattgtgtataattaccacatttcctttacccattcgtctactagtacacacttaggttgagtctctatcttcgcggctgtgaataatgctgcaatgaacaagggagtgcaggtatctccttgaaatattgatgtcaatacttttcattatatacccagacatgggattgctggatcataggatagtcatatttttacttctgtatttaaattaggttactggtttttcttgctatttagttaagctatttagttatatattttggatattaaccccttattagatatatggtttgcaaatattttctctcattctgtagattatttcttaactctgttattttctttactgtgtagaaagattgtaacttaatccaaacccgcttgtctattttaacttttgttacctatgctttgaggtctgtatcacacgatctcacatgcagaatctaaaaaagtttaactcatagatggagagagtataatagtggttaccagaggcttagggtagaaagggaaggaatggggaagtggtggttaagaggcactaagtttcagttacacaggaggaaactattgtttttttagatctactgcacagaaggatgactacagataataatttattatatatttcaaaatagctgagagtaaatttcaaatgtctcaccatgaaaaatgataagtgaggtgacagatttgtttattagcttgatttagtcattccaggctgtgtgtgtgtgtgtgtgtgtgtgtgtgtgtgtgtataaacattaaattgcactccaaaatgtatgaaattatgatttattatttcaaataatattaacttttaagaattcactgggctttggggacaaagattttggttcaagatccaacaagaagagtaagacctggtaaatcccccatggctacacattaatggaataagggtaaagtggaactgtatctacactcataatctaggatcatctcattttctgattggatgatggtgttccatgcttagctgactgcaagaaacataagtgactccatgttacaataagatcatccagagcctcaaaatagtttgatagctttttctaaacaatgtttagcacatagcagaaaataagtcagcctatgaaacatatgagttaacctaaaataaagagaaaatatacaaaccaaagtagatcaaggtgttaagattaaaatcttaaaactttaagcattcatattacttgaacatattaatcctgttaggattcaaattttaaaattaatttaatttataatttttttaatttttaaattaaaaattttaaattacaatagaaaattttaaaatgtttaaattttaaccttaacaggattaacatgttcaagtaatatgaatttcgttgcagtagtagaaacttaaaaatcaaatataaattctgtttaaaaagatacaataagtaaaacactgaattcatcggactttggagatgggagatgtattagtccattctcacactgctataaagaactacctgagactgagtaatttatgaagaaaagaggattaattgactcatggatccataggctgtaccggaagcatgggtaggaagcctcaggaagcttacaattatggcagaaggcagaggggaagcatacatatcttactgtggtggatcaggagacagagtgaagggggaagtgctacacacttttcaaacaaccagatgttgtgagaactcacaatcacaagaacagcaagggggaaccacccccatgatccagtcactcccaccaggtctttcccccaacactcaggattacaatgcaacataagacttgggtgaggacacagaacgaaaccaaatcaagagaaatgttaaacagaatataaattgtaagaaaatatttagagtaaatccaaagagagagagagtaaagaaaagcaatacttggagagatattagctacgaattttccaaaactgatgaaaagcacaaagccacagattccagaggcatcacgcacaacaataagaataaacagaaggaaacacacatcaaagtaaaactgcagaaaatcaagaacaaagattactggaaggcagcaagacacacagccagagagaaagagaaagaatttgtcactctgtccaaaaactagaagtgacaattgactttcaacagaaacagtggaaactacaagacagtatgtcaatataaaaaatagggtaaaaaacaactagaaacctacggttctataccagcaaaaatatcattccgaaataaaaaaaaattaaaaatgttttcatataaataaaactgagagaatatttcactagcagatctgaattaaaattttcactagtagatctgaattaaaaggggctgaactgagtattagaaaaaatacattaaatagcagtttagaggtacaagaagaaagaacaataaaaaagataaacattaattgcaggaaacaacaaaaatgataactagtgagaattgtacttgatgacaacaaatataactacaataaaaataaacacaataaaattagcaacattgatataacttgataatggtaaatggaattaagtattctaaattcttcccactgtccacacataactatattttttaatttatgttaggcttcaatgaaacaatgatacatggcaatcactgaaagaatagaaaaaatatacgtaggccaggtgcgatgactcatgcctgtaatcccagcactttgggaggccgaggcgggcagatcaggaggtcaggagtatgagaccagcctgaccaacatggtgaaatcccatctctactaaatatacaaaaaaaaaaaaaaattagccaggagtggtagcgctctcctgcaatcccagctactgaggaggctaaagcaggagaatcacttgaacctgggaggctgaggttgcagtgagccgagattataccattgcactccagcctgggtgacagagtgagactccgtctcaagaaaaaaaaaaaaaaaaagaaagaaaagaaaatatgtaattaccaagctaacagaagaaaaaagggaaaataaattgaaaacaaatacaaaagtaggggaaaaagcagagaaaggggaactttatatatccattataatattaaatataaacagcttaaatagtccaaagatagcaaggtgtttttttttctttaataaaacataccttcaggtttctacttgttgactgagagtgaggatcaagagatgagacaaaggagtaaattttgaggacaatagaatttgttccatattttaattgtggtggtagttagatataaaaatttctcaaaactttaaaaaatgttttcggttctatactcaaaaatgtatgctattaatataatagtgttaattttaaaaaggacagtgaagtcagctttaatgggtacctactggccaaatctacaatttgatcatgaaaataaaaaataacaatgcattacaacatgttgagaaaatgagatccataagtctatactatataaataaataagactagggatatctcttctttaaagcaaaaatacaaataaaaaactgaatgaataaatgaatgatagaaatataaaatcaaaattcagaatcaatatagtggtagctaattcagtcaggaatcatcagtaaatgcaaaggctagaggacagtcatttgatgaagaaccagatactgacatagccctagagtatttccccaaaaaatactatcagttacaggggggaaatggtgatatcattgtggagataacgaggaggcattcacatggccaagtgatcaagtttagcctgtatgttttctgacctgagaggaacatcatgatttttatcatattcctgacaagaatgtatcacttgaatagggtcatgaggaaacagtggaggaacccaggttgagggacaccataaagattgaaaggcctctattctacaaaatcttcaagtcatgaaaaactgagacagcctgagaaactgtttaaaggagatgtaagatatgtaagtaaaaatctatgcatgatattcgactgaatcaggatcagatagaaaaacgatactttgttgggataatgagatttaaatgaggtctgtgagttggatggtggtattgtattaatgttgatttcctgctttggataattatattgtgctaataggaaagagtaggtggaatagttcaggaaaagaaaaatgataatgatcataaaacagacattatacacacatacaatacacattatattgaaagagagagttgaaggttatttggtgaaacaccaacaattagggcatctgtatgaaggagtaagggaatacgagaggttttttatactgtttgaaatagtttgaaatagttctaagtaaattatgaaaaaagtaataagaaatatctacatatactgataagcagtgatcattcagcacatattaagtaaaaacaataaggtgtagagcagtttatggtgtgtttatcgtgtgtcttactgttagcaataatactggtattgttattttacaattattatataaatatagaacaagataaatatggtaattttataaagaactaagatacccaatataaaggaaaaggaaataaatatattttttaatgattaaatgtatgtattttttaaatgtattctttagttctgctcattaaaataacccggaagcactaaaaactcagtagcaatgaacatcaccatttcttagatgatggtgtccaaaatcaatccaatagaactagggctccttggagaaattcgttaattcctgatcatgtgcagaaaatgtacaaaatgaacctggtacttattttcgtgtaaggaaaataagtatcacaaagtacttactgggctagtgtcaaaaggataccaaaaaaaaaaaaaaaaaaaaaaaagaaacacagtagccaaaagtgaaaacattaatcaacatggttaatgactacagttgatcaaaatgtcaaataagtgttaaaacccatgaattcaaagcgatactttttgggatgaacaaaaaaaaactattaattgtttttttggagattgccagaatgccatcaaattaatctgaaagttaaaattacttaattgaaagccaacaaattaattctgaaagttaaagaaataaatcaaatactgatcttgtttttctgtatgaactgtatttcacaataaacagatagttctaccactaatccattgagtgactttgtgtgagtctctctccacctctccgagccttgttatcgatctataaatgaagatagtaatgcctgctttatagcaatgttaacagcattaaaatagacaatatatgtaatgcttctagtacagaggcttattttctctgcagagctttttataatacttaaggacatttaacctgtcatgcacttgttttgtattctacagaccattctccagttcattcatttatcataaaactttacctactgaagggtctaccacatattaagcactgtgttagagttgaagtatgaaaattaagacatgcttcctgacctcaactttttttttcttttttttttttttttttttttttgagacataatctcactctcttacccaggctggaatgcagtggcacgatctcagttcactgcaagctccgcctcccaagttcacaccattctcctgcctcagcctcccgagtagctgggactacaggcatccgccaccacgcccggctaattttttgtatttttagcagagacgggtttcaccgtgttagccaagatgttatcgatctcctgaccttgtggtctgcccgcctagggctcccaaagtgctgggattacaggcgtgagccaccactcccggccagaacttttaatctagtagaaccactatccaaaagacagttgttgaatcaaacagaaatttccagacccgtttagatttcagaagcctgtcaaggcagttctctaccacccatgcttcttaggcttaaaaaaaaaaaaaaaaaaaaaaaaaaaaaaaaaaaaggacgacagcagcagttttggtaagaaaataataagacagccaaattaacagaccaacaagtaacaaaaaaatagatataatatggcttagagttatagatgacggtgtccagagggtatgtctatattcagtcttagcctgcctgacagtacaccggcaccattaagctattcaggtcacgttaactgaataggacaaatggggcaagaatgaagattaatgaagacaaacagcatttgaaatggcaggatctaattctaggtaagctgccttagagatgacagctgaaatttgctcataccccaaaactacacccaacagcaattcattatatgtatcaaacgagatgagaatcaacgacccagagtatgtgcctgtcttctgggaatctcctgcacgcaggtggcaagccagatgcaaaaatctattacgttctgggtataaaggcttctattgtaaaacctgcatataaacaaggctagtgtccgctgagaaatcttgagtaatcatgacttaaaaaaaaatggtatcttggttgtgtgtcagctgttataaccagttgtggattaattcgtaactacgcactttttcttagagtattatgtataaacactcaaacgaaagcgaaacaaaagaaagtaaaagcagccagtggataaacttgcattttttaaatgctgaaaatcattcactgaacgattaattgctgaaatatttggtacagtgaaatatgtagcctacagaaaatagcagatataaaatggtgaaaataacagacatagaaacggtacaaatgacagagataaacatggcctcttcaatcagtgcatcccaacatttttcaccttgtgtcatacatagaaaatgatgacatctttacagcactcgagtaggctactggaggcaattggccgggaagctctgttatctaggtcttgctcagttgacccagttcaaaatgctcctccagtgaattcactgcacacctaagctaagggttttcaaacagtactgtgagtggtcttatgagttctgagatggagctggaggaattctggttaggtagacctctacactctcaccccagagcaactccacttttttccgtctccttaaagaaaaaaaaaaaatccacttatgaaaaaatacatttggcaaattaattccttcattctaagacaactgtaattaaattttaaaataaaaacgagtttggaaactagttatctaattattgcaatattcctcaaccctggctacacattagaatcaactggaaggcttttaaaatatacagatgcctgggcccgaccctcagtgattcagaaccagccatagtgtggctcaggcatttggtaatattttaaaactccccaagtatttcttatgtagccaggtttgagaagcactaaattagacctggcagccacgtagaaaaaggactgaaataagagtcagttgaaactcatttatccttgccagtgttatttgccagttacgaacaacttggagaatgggcgtgtactaattttcttgtttattagacattaacacttacatgtgagtttttcagactaggacatttcaccaggaaagaaaccaaggtggtcaatgatagcaggaagatttggaggctacagtctgagagttttgcgactttttaaaaagagaaaattttagagtacaatagaaaaaaaaaaacacaaattggtaacgactgagtatgctaagacttcatattattttcttcaccccattctctttcaccctctatgtgcaaggtaggaatcagcgttacttgaaaatggaaactaatgggaaagggtataaagctggcaacctcattaaggacaaaaaaggaaaaaataattgaagccaatagaggccatgaaggagaaaatctgaagcaaagatctggtttgcctgttttgttttctagaatcctagaatttctggtaaaagtggcatacagatgaagaaaatctataaaatctctgggagtagaaaaagtcagttgtgtacaagagattatgtaatcatttttttaactggagtttattcaaagttctcatttgctgaaataataatactgattgtttaatgaatacagtccatgggccagatgttttagaggttttatatatgttatctcaaatatatttttatagtaatcctttacttacgctctaattcttactatttccatgtcctgaaaggtatttatttgtattttacaaaataagaaattgaaccttgaggaatacagatatcaagtcctcatgatcagaagccagaatagatattatttgagttgctttctgtctacctccaatatctaaagtttttgcacagcacgtaaacacacttaggaattaaagcatttgacaaagcattgaatctgtggtaaacattcataaaattttgggaactgtatggaaaggaagagaaagcccaagatttctttttaattctctttaaaataaaaagcttgcggtataaatattgaaaacattatgcaataaaaagttgagtgacagttgtcaggtttggaactaggaatacaaagatgaagtaaaattggagcaagagaaggagggattaatcaatgccagatgcttttcagctagggtctgataaggattagaaaaaacacattttgtggatctagaaataaagcgaatatgtaataaataaaaacatcacagtctttttaaaacaagctcaacactgttccttctggcaggaaaagggaagggggaaaaaggaggagaaaaacgtctataattttgtgttttagaaaagtactagccagttcaggtcaccaaagaccatgaaataataaaaataggcagaagacatacatgttcaggattcagaacacagggagggaagaggagtaacgaagcaggtaaaatttgctcctgtgaatgcatagtcctctgtgcaaaaggaaaatctcaagagggtgcttcagaaagagatgggaagaaatacaaatggtgatgggcttacagtactgagacgagagaaggaaaagtaaaacaaatcattttactacaaagataattattcagtaaaaagaaaagatagggccgggtgtggtggctcatgcctgtaatcccagcacttcgggaggatgagccaggtgggtcacttgagctcaggagtttgagaccagcctggccaacattgcaaaaccccatctctactaaaaatacaaaattagccgggcctggttgtgcacgcctgtaatcccagctacttgggaggctgaagcacaagaatcacttgaacccaggaggcagaggttgcagtgagccaagatcatgccattgcactcctgttctatctcaaaaaaacaaacaaaaaaagatctttgaggacaagaaaaagaaaccagttcctttagagaaaactacatggtcaattagcagtataagggagctattatatttgtgagtgacagaaatgtttttctttttgattgctgtgatggttataaagccgtatatatgtgccaaatgcatcaaattgcccacttagagaattttaatgtacgtaaattatatcccaagaaagcagatttaaaaatcaagcaggaatgaaagaaagtagacagggtattcagagaaagagaaatctgaaagcataaaaacaggacattgcagccgccaagattcatacaagaacttccaggaagacagaggcaattgagtaacagcatattagaatatgaggcattacaggtggaaaaagaataaaggaattacagaagaccttaaaaaactaaaatcacaccaaatggggaaaacaaacaggccaagtgatttttctcttctctacctaaaatgtcatgtcatcctaatacataggcagtgccatatatctactggcaaacacaatggaccatttgggggacttcaccatggtgcccacagaaagccaggctaccatggtacttcttaatgtacacatactgtattttcaacaaataaacaacaaataaaatgcctagattagaagtggattatgtgtctaattcctccaaaaataacatgatttaaggatatcacatgttcctatctagttaaaaaaaaagttagcttttttttcctaggaaagttaaaaaaaaaaaggtggggggaatatcagaagaaaatgatggggatccaaataatacaaacaattacataaattggaaaaaaatgcatttactcaaaactaaagtgacccagtagtacttacagcaagcatggctagaaaaaaaatactgagaaaaatacttattttctgaccatgtcgtgtcatgactttttcccaaaaagtgagaaattttgcaaaaagatgcagtatacccaatgcacaaatttatattactatagataaatttaaaccatgaataataatcatctaaaaaagtacattataaaagaaaaccccaaggttttatggtacagaatagatactccaagtctccatccatataagagattacacattataagcaaaagggggaaattagagaagacagattagaccattctcatcaaacagagtcatagtggttaaagcagaaaatgcccggaaaaacagaaacactgtacttaccaaaaccttacagttagaaagtagagagtggtaagagccataaagggaaaaaaaaaagctgactgcttgaactttagtaaaaatcatggaacatgacaaacgagggaagtatgaagaaaacatctaaaagctgtcaatctaatcaatggttttctagtcaagattgtgtaaaataacctttgcctaaaaggttgttgatatgatactagcatccctatccatccctgggttagatgcggaaaaaaaataataataagtgaaaatgaacaggttgctctagtagcctctcgaagtccatagaaattcatggagttcccagatcattttacagaaaaacttatcaaaatttagaagagcgtaaatatgtataatgaatgaaggtgccggccagtccaatcattgcttatgcaatggatatttttccggaagttatcaaaagatgtcaagagtctgcaagagaaatggggtaagagatgaaagggcaaaaattcaaaagtacaaaaaaaaacaaaaaagatgaaaattaaatacaactgaattgaaaaagcaaaactgatggatgagtcaagaatgattatttgtcgtccttggtggtagaaacaaaatgaaaataagtgaagtaggccaggcaaggctcaagcctgtaatcctagcactttgggagggcaagacgggcagatcacctcatgtcagggatttgagatcagcctggccaagatggtgaaaccctgtcactactaaaaatacaaaaattatctgggcgtggtgatgcatgcctgtaagcccagctacttggcaagctgaggcaggagaattgcttgaacccaggaggtggaggttgcagtaagccagatcgcgccagatacccagcctgggcaacagggtaagactccatcaaaaacagaagggaggggaggggaggggaagaagagacagagagagaaagaaagaaaataagtgaaatagaaagggaagtatattcataggaaatttagtggctgatagaaaacgtgaatatgtcctggtgtcccttttattcttatactctagttgtgggacagctcttagccacagggtcccttttcattgccctatcaaaaaacacagtacccttgaccagaagattcattgtgtatctgtaactggagaaaggaagtttgggcaaaatcagtgcagaggagttcaatgtctgtataaaaacatcacaggtacctcataagtatatatacctactatgtgtccataaaaattaaaaaaaaattaaaaagcattttacaaaaagcaggagatggtaacaattgtagttcttgctctagattttacccatcagttttgaaaaactagtagaaagatttctgtctaatgaggaaacatttttcaaataaaactagacaacacgcaaaagggaaaatgacggtatggttgcagatgaagcctgaagatttagaaagaaaaagagcagaggattaaacaaagaaatcttaaaggagattttttttaacactcataaaatacatattgattataatgatcttagcaactgaaggaaatttaagagagttcacagcagggatgtcacatggaatatcttgctttgaatattctagtccaaaccagaacaaaattctgagtttatgagatgagaagagagcacaccttcaagagaaaagactggggaagtggcatgccaaagcattaaaaatctgaagacaacaattaaagatgaatctgctgagactatggaaggggaaaaaagcacccaattctcagcagtaataaatagcttatggggaggttcttactttcatctcattgatattaatagtatatcaggccagacgcagtggcttacgcctgtaatcccaacactttgggaggccgaggtgggtagatcacgaggtcaggagctcgagaccagcctggccaacatggtaaaaccccatctctactaaaaatacaaaaattagccaggtgtgggggcgggcccctgtaatcccagctactcaggggtctgaggtaggagaattgcttgaatggaaggcagaggttgcagtgagccaagatagccccactgcacttcagcctgggtgaaagagtgaaatcctgtctcaaaataatcataataataatatcaataattaaaattccgtaagttagagaacgtccagaattcctcactcttaacatgtaaggaattacatatgtatatatgctaagaggacctggtagttaaggggtataaaaaagtaaagaggtgaacagagtgaggtgtcagaacatctttattacacatcttacaaaagttctttttgttccttttgttcactattataacctcaagacctagataaatgcctgaataagtttctactcaacgaattaacaaacaaaagaaaaagtttaataaatgaacttgactttttctggtgatcatatcagtaatattaaaaatatatatattcttttactaaaaataaaaccccaggaattacaatgttggcaacttggcaacagcataaatgcagatatgaatatgtaaaagttaccagagaagaaatcaagaaggttagatacattaccaaaaagaggaagataaaaacataggaggaaaaatatcaacatttggggatcatggatttcattagaatccaaaatacattgtttatgagtaagttggagtgagagaattataagaggtgtgtaaagaaatttaaaataaataagccaagattaaatgggccacttcgtgagacactgtattctctgcattctctgtgccagaagaatttgtccagccaaggataagccaatgatcttggtgagaaattacagcaggactacagaggagcaaaagatttggagagtggaagcacgagatgatacctacattacctttcagcctagattctaggttttgttcttaaatattagtatgctttttacattaaagcagaaaacagaagcataagaaaatgagatctttgtgttgtgctgagcccatttctctctagaataaaaggcaactgcttgttgttttaatacagattttttaaaaaggaataaaggaagcatagatagggtgactgcatgttaataaacaatgctgaatgtatttttttccagaaccaccatacagaccaaggatcggaaagacaagtttgagtttgcaagatgcctttgctcaaaaatatcttttctcacggttaacagtcataactgatagagacaggaggcagccaagggttcccagtgaaaccctgccttcaagcataaaaaagcctgaaggctgaaaactcagactgctggtcccagatgaagctggccctttcccaactgtttctgtataatgaccacctgagcactcctggacagagtggaacctcgggaagctctcactgtttgcagaggggaggagcctggcctctcctgttcctgtgtggtgacctgggattcaaactgccagcaggattctctctcacttggctgagagttatttttcctttttccttttcacccaataaatactgctcctcagccttctatgtgtcggtgagcctaatctttcctggtcatatgacaagaacctggttatttctatgacataaccatatcttagttaatttatctcaaattcagttatctgtaggaatgggttataaggcctagagtttggcagtataaaaacctatcagtaatttacctcttatttttatcttacttccaaattaatatattggctatgagaatgagagatttcatggggttatatgaaagacatttgatatctttggtgtaggatagaagagcatttgaaggaaaacagtaattaacggagtttggacctcaaaacataaactgaccaacctgaaattttgtctagaactctagttatacccaacacacagatgaatagtgatattaagaccagtttggaagacaaaatccctagatttcttaattttacttagctttcccagtttagatttacttacccaaacttacaattccagagcagtgtatcaccatccttttcctgacttttatttatttggggtaggatatattgacatccacagagaggagtaaatgataatgataaaataattaacacttcttgaatacttaccttttctcaggcttgtggttagggtcatgcatacaattttttttaacttcacccatcaaacactacataatctgcatcttgtctccctttccaaactagcccccttccattctttctctagccaactatgctgcagccaaactgacttttcagttgctcaaatacatcaagcttatttcacttcagggctcacacttgaagtttgctttaactagaatatgcttcttctcttctacctggccttctcaaagctgattttttcgggggaagatggagtcattcagtttctagtcaaaagtaacctactgcccacacactgtaaaacaatccccacctgacttcattaattctgtattcttaccccactttttcttcaaggcacttactacctgaagttaccttaatttttctccatgtttatatctgtctcttcccagtaaaatgcatgctttgcaagggcaagggacagcttctcccttgttcactcctgtattactaacacctttattactgactatggatgctcaaattcattttttgaatgaaaaagtatattcatgatctttacaacaatagtacgaaaatgatgctttttacattacaaagtaatgagctacagaaagcagttaagtaagcttaccagtgtcactagataattagtggcaaaccatttccttatagtatcctctggctacaagtaaaagcttctatgttcatcacaacactcagtctcttcacatcccttgactcatattttttcaaatgataaagaaatgtatttaatgactaaaatgcaactacccaatttgagaatgtttatttggctatcataatataaacatgtagaaccaggaataacaacagttagatgattatccttacacatttttaataagagtgggctgaggtgttctactgcctctaatataaagcagcaggaagtatgactgtcatcctaacaagaagaaaaagctgggaaatctacaaaatcataactttccttaaacctatcagagagctgaggtttcagaacaattatgtgaactgagtttcaaaaggtagacaggacacctgaactgtttcacttttgacaaaacacatgagaaagaggcaagtgccattaaaaaaaaaaaacaagaaagaagaaacaagcaaaataactaattaattcttaaaggctgactgtggattcatgtgacagacagtttgagatccctggaagctcagacacaagggtatgtctacgttcacttacaagttcttttccataagccaccaccaggcactctcaaaaaagacttgattcaaagaaggagatccaagaaagaaccacttcgtggtgcacagacataaaatatgcccattctctgagccatcctttctatgacacaaaagtcaagccatgggagagggttagaaaatcctattgccctagcagccagaaagaatagtagcaaaattgtctgctgctgagggagggctaggaatgtggagagagacccccattatgcccagatatgcagatggagcacgaactttgagaaaaactttgcggtaccccaacccctaaacgaaacacaaggcagaggcagcccactgctgtaagcatttgaaggctgtggtgcactgaatataacaacaaaatatcccagctcaatcacttactaaattgactcaactcccacatccatgacctaaagaaggggtggcccatttccaggcataaatattattcacctcagtctctaccattcttctatacaatgtttgacctctaactgaaaagtatcagaaacacaaaaagactagaataagaacagcattttagtgaaacatcagttaaaagaactagagccagagatgacttggatgttagaactttcagatcaacaaaaaaatctatgattgagattttaaataatctagaagaaaagaaaggcaatatgcaataacagatgagaaatctcatcagagacataaaatatatgaaacaaggagtctaatggaatgctggaaatgtgaatagactctttagcttttaaattttcactggccaaaagaaaattctaaagctatatatgtatactctgatttttacatatctttaattatatagaacaaatatcatgtgctaaacttagacttaatccaagttttaaaaacaagtgacttcctgtctgatactgctgtttatctcagtcaccaagagaagtgaactagcaccccatcaactcttccactatcatatagattcttacagttccgatagtttgtacattcccttccttcaaatcccttttcctgagaccttcaggaacagtcatactataccttgcttcagctattcactgtttgtgtagatctgaaaaaggtaatttacctttctgaactttaatttctttatcagtaatagaaaaagaataacaattaccaggtcacaaatatgttagaattataagtaatatacatcaaatgtatgctatacagaagacacccaataagtggtggccatcattaatataatttggtgcttgtgtgcatagcatagccatccttatatctgaaaatgggggagagttgctcaggtgtctctagtgcacttatttatctataatggatacaaacaatatttgtcaggagtcagaaccagatcctccttaatccagatcaacataattggaagagtcacatcagacttctgaaccctggtttcctcaaatgtaaaatgatcaagccagatcatctccaggttctcttgaaatcctaaaattcgggagagaaggagccaagatggctgaataggaacagttcccatctacagctcccagcgtgagagacacagaagacgggtgatttctgcatttccaactgaggtaccgggttcttctcactggggagtgccagaaagtaggtgcaggacagtgggtgcagcgcaccatacacaagccgaagcagggcgaggcatcaccacccaggaagcacaaggggtcagggaattccctttcctagtcaaagaaaggggtgacagatggcacctggaaaatcggttcactcccaccctactactgtgcttttccaacgggcttaaaaaacggtacaccaggagattatatcccacacctagctcggacagtcctatgcccacgaagcctccctcattgctagcacagcagtccgagatcaaactgcaaggcagcagcgaggctgggggagggtcacctgccactgccaagttagttgtttgattaggtaaacaaagcggccgggaagctccaactgggtggagcccaccacagctcaagaaggcctgtctgcctctgtaggctccacctctgggggcagggcacaaacaaaaagacagcagtaacctctgcagacttaaacgtccctctctgacagctttgaagagagcagtggttctcccaacacgcagcttgagatctgagaaccggcagactgcctcctcaaatgggtccctgacccccgagtagcctaactgggaggcaccccccagtaggggtggactgacacctcatacggccgggtactcctctgagacaaaacttccagaggaacgatcaggcagcagcatctgcggttcaccaatatccactgttatgcacccaccgctgctgatacccaggcaaacagggtctggagtggacatctagcaaactccaacagacctgcagctgagggtcctgtctgtcagaaggaaaactaacaaacagaaaggacatccacaccaaaaatgcatctgtacatcaccatcaccaaagaccaaaagtagataaaaccacaaagatggggaaaaaacagagcagaaaaactggaaactctaaaaatcagagcacctctcctcgtccaaaggaacgcagctcctcaccagcaatggaacaaagatggatggaaaatgactttgatgacttcagagaagaaggcttcagacgatcaaactactccgagctacaggaagaaattcgaacgaattgcaaagaagttaaaagctttgaaaaaaaattagacaaatagataactagaataaccagtgcagagaagtccttaaaggacctgatgaagctgaaaaccaaggcatgagagctacatgacgaatgcagaagactcagtagctgatgcgatcaactggaagaaagggtatcagtgatagaagatgaaatgaatgaaatgaagtgaaaagagaagtctagagaagaaagaataaaaagaaatgaacaaagcctccaagaaatgtgggactgtgtgaaaagaccaaatctacatctgattggtgtacctgaaagtgacggggagaatggaaccaagttggaaaacactctgcaggatattattcaggagaactttcccaatctagcaaggcaggccaacattcaaattcaggaaatacagagaaccccacaaagatactcctcggggaagagcaattccaagacacataactgtcagattcaccaaagttgaaatgaagggaaaaaaatgttaagggcagccacagagaaaggtcgggttacccacaaagggaagccaatcagactaacagcggatctcttggcagaaactctacaagccagaagagagtgggggccaatattcaacattcttaaagaaaagaattttcaacccagaatttcatatccagccaaactaagcttcataagtgaaggagaaataaaatactttacagacaagcaaatgctgagagattttgtcaccaccaggcctgccctaaaagagctcctgaaggaagcactaaacatagaaaggaacaaccggtaccagccactgcacaaacatgccaaattgtaaagatcatccaggctaggaagaaactgcatcaattaacgagcaaaataaccagctgacatcataatgacaggatcaaatacacacttaacaatattaactttaaatgtaaatgggctaaaagctccaattaaaagacacaaactggcaaatcggatagagagtcaagacccatcagtgtgctgtattcaggaaacccatctcacgtgcagagacacacataggcccaaaatcaagggatggaggaagatctaccaagcaaatggaaaacaaaaaaaggcaggggttgcaatcctagtctctgataaaacagactttaaaccaacaaggatcaaaagagacaaaggccattacataatggtaaagggatcaattcaacaagaagagctaactatcctaaatatatatgcacccaatacaggagcacccagattcataaagcaagtccttagtgacctacaaagagacttagactcccacacaataataacgggagactttaacaccccactgacaacattagacagatcaaagagacagaaagttaacaaggatacccaggaattgaactcagctctgcaccaagcggacctaacagacatctacagaactctccaccccaaatcaacagaatatacattctgttcagcaccacaccacacctactccaaaattaaccacatagttggaaataaagcactcctcagcaaatgtaaaagaacagaaattataacaaactgtctctcagaccacagtgcaatcaaactagaactcaggattaagaaactcactcaaaaccactcaactacatggaaactgaacaacctgctcctgaatgactactgggtaaataatgaaatgaaggcaaaaataaagatgatctttgataccaacgagaacaaagacacaacataccagaatctctgggacacattcaaagcagtgtgtacagggaaatttatagcactaaatgcccagaagagaaagcaggaaagatctaaaattgacaccctaacatcacaattaaaagaactagaaaagcaagggcaaacacattcaaaagctagcagaaggcaagaaataactaagatcagagcagaactgaaggaaatagagacacaaaaaactcttcaaaaaattaatgaatccaggagctggttttttgaaaagatcaacaaaactgatagaccgctagcaagactaataaagaagaaaagagagaagaatcaaatagatgcaataaaaaatgataaaggggatatcaccaccaatcccacagaaatacaaactaccatcagagaatactataaacaccactatgcaaataaactagaaaatctagaacaaatggataaattcctcaacacatacatcctcccaagactaaaccaggaagaagatgaatctctgaatagatcaataacaggctctgaaattgaggcaataatcaatagcttaccaaccaaaaagagtccaggaccagatggattcacggccaaattctaccagaggtacaaagaggagctggtaccattccttctgaaactattccaatcaatagaaaaagagggaatcctccctaactcattttatgaggccagcatcatccttataccaaagccgggcagagacacaaccaaaaaagagaattttagaccagtatccttgatgaacatcaaagcaaaaatcctcaataaaatactggcaaaccgaatccagcagcacatcaaaaagcttatccaccatgatcaagtgggcttcatccctgggatgcaaggctggttcaacatatgcaaatcaataaatgtaatccaacatataaacagaaccaaagacaaaaaccacatgattatctcaatagatgcagaaaaggcctttgacaaaattcaacaacccttcatgctaaaaacgctcaataaattaggtattgatgggacgtatttcaaaataataagagctatctatgacaaacccacagccaatatcatactgaataggcaaaaactggaagcattccctttgaaaactggcacaagacagtcatgccctctctcaccactcctattcaacatagtgttggaagttctggccagggcaataaggcaggagaaggaaataaagcgtattcaattaggaaaagaggaagtcaaattgtccctgtttgcagatgacatgattgtatatctagaaaaccccatcatctcagcccaaaatctcctcaagctggtaagcaacttcagcagtctcaggatacaagatcaatgtacaaaaatcacaagcattcttatacaccaataacagacaaacagagagccaaatcatgagtgaactcccattcacaattgcttcaaagagaataaaatacctaggaatccaacttacaagggatgtgaaggacctcttcaaggagaactacaaaccactgctcaatgaaataaaagaggatacaaacaaatggaagaacattccatgctcaagtgtaggaaggatcaatatcgtgaaaatggccatactgcccaaggtaatttatagattcaatgccatccccatcaagctaccaatgactttcttcacagaattggaaaaaactactttaaagttcacatggaaccaaaaaagagcccgcatcaccaagtcaatcccaagccaaaagaacaatgctggaggcatcatactacctgacttcaaactatactacaaggctacagtaaccaaaacagcatggtactggtaccaaaacagagatatagaccaatggaacagaacataaccctcagaaataatgccacgtatctacaactatctgatctttgacaaacctgagaaaaacaagcaatggggaaaggatttcctatttaataaatggtgctgggaaaaccggctagccatatgtagaaagctgaaactggatcccttcttacaccttatacaaaaattaattcaagatggattaaagacttaaatgtgagacgtaaaaccataaaaaccctagaagaaaacctaggcaataccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacagaatgggagaaaatttttgcaacctaatcacctgacaaagggctaatatccagaatctacaatgaactcaaacaaatttacaagaaaaaaacaaacaaccccatcaaaaagtgggcaaaggatatgaacagacacttctcaaaagaagacatttatgcagccaaaaaacatgaaaaaatgctcatcatcggtgtccatcagagaaatgcaaatcaaaaccacaatgagataccatctcacgccagttagaatggcaatcattaaaaagtcaggaaacaacaggtgctggagaggatgtggagaaataggaacacttttacactgttggtgggactgtggactgttaactagttcaaccattgtggaagtcagcgtggtgattcctcagggatctagaactagaaataccatttgacccagccatcccattactgggtatatacccaaaggactataaatcatgctgctataaagacacatgcacacatatgtttacagcggcactattcacaatagcaaagacttggaaccaacctaaatatccaacaatgatagactggattaagaaaatgtggcacatatacaccagggaatactatgcagccataaaaaatgatgagttcatgtcctttgtagggacatggatgaaactggaaaccatcaatctcagcaaactatcacaaggacaaaaaaccaaacatcgcatgttctcactcataggtgggaaccgaacaataagaacacatggacacaggaagaggaacatcacacaccagggactgttgtggggttgggggagtggggagggatagcattaggagatatacctaatgctaaatgacgagttaatgggtgcagcacaccaacatggcacatgtatacatatgtaacaaacctgcacattgtgcacatgtaccctaaaacttgaagtataaataataataaaatttttaaaaaaaaagcaatcctaaaattctatgatgctaagcctggaggagctgttaaactgtgattttcagtaagataattaaggaggtttatttttctttctaagccaattagaatgtttcttatatctaccatgaattaatgtataatggaatcagaagataggccaaatttgacatctgtctgtggaataactgaattaaacggtacatacatgccagcacctggagttcaggtacactcattttacctaacagcaggcaactgtgttgttttcttaatcttttcagctcaaagttttatttttgtttatgttgagctttttctgtgatgtgaattttatttttctttatacaatcataaagatttgtgatcattaaccaattgctacctaatatacacataatttccactaaatttccatctgtaaaagtttgtatttgtaaaataattctttagcatctggctttattctagaactgtatgtggcaagattagtaaaactgaaatgaatcacacattggattaacatgaaacatttggtgttgccatcaagaaggtttactgagctggaaattaatgtaaaaaaaagttccaaagagggttgtttttaaaacatttcatgctttttacgtttcatcattatggctattaaaagaccttggactaatccctctgtatttcagggtaagtaatcacaggaaaattaacattatagaaaagcctaaaaattatttttattacacatatttcttttaaggtaaaaaatcaaaatattcaataatacaatcagtccttacttaacaccattgataggttcttgaaaactgtgactttaagccaaatgatatataatgaaaccaatcttaccacaggctaattgatataaataagtaagctcctatgccacatttctaatcacaacagcatcaccaaacctctaaataaagactctaaacgcctctaatattaaacactgaaataactgtgagatcaacatacatttaagaagaactaataaattcaagataattattcatccagttattccaggtcagggtcatggtggctggagcctatctcagcagctcaaggggatagggagggaccaactctgaacagaacaccatcccttcacaaggcacacacacacacacacacacacacacacacacacctgcactcactcagactggcatcacttacacacaccaatgcatctaacacacacaggcattaggacatgggaggaaaccagagtactcagagaaaacttatgcagacataaggagaacatgcaaaatccacagagaatgtggccccagccaggaatctatttttttctcatcagtgatataactaaactatgttgaacaaaatgatgttttttgaggacttgatgtatctggattttcagccaatttttttattgtattcaaatgtcatgtaggctccatttgccaaggaaaacaatttgatgttaaaataagaaaaaaaaacttccttcctataaaatagttataagcactactgatttttaaaatacagaaaattattttgtcctatagtaaaagtagtcaaggaatggtcatttgaaaatcaaataaactgtaagaagagggttcatagttcttccgaaaaagaaattatttcaggaaatttctcttttacttcaggggacccatgatacaatgcaattgaatcctatttatacttcaaaactgactttacacaggaccttataattgatagctgaataattttgaagacacaataatagactacataaattaaaagaagtcgtgtttttcaaagactacaaaactttataaggtgattttaagcttcaaatatccattttcctttgttggcttaccaaaaatacttacttaaaatataataacatagctacaaatttttaaataatttgattcctgcttccacaacagtgaacgctaacagaacttgtaggaaccagagagaatatagttaggctttgagggaatcaaagcctgcaatgaagacttgtcgcttcagatctcctcatgtaaggggaccagaaggatcctggcactaaacaaattaacaaatgcatgtgagcaacagagtgaggtggtacccaaaggccagcaacttactctggcagatccagggaactcctaagcaaagctaaatcctacactatggttccagagttaacaggttaacttccctaaattgatagaggagtttcggcataattctatcccgagtttctaagagtagaaaagttcatccccaagctatgctgaatatttcaaaagcctaacagaattaatgtcttaaattataacagatatttaatagacaaaaaaaaatcatggaattaagttatattatgagagatgctaaaaattatccacaaaaataatttttagatatttggaaaatctctaggcagggcaatgaagctcacagggaatatgtgatttttcctcccccgccctctttccttttacttttagtttcttctgcattatctttgctttgctctctctcttcctttctgttcttctttttttctttctctccaacttttactagcaaaaacaatcaatcattcattctggatcactggcacacactgaaagaaaaccatcttcttgactctcctactgttaacgggatctctggggtgtcgatttttctgactggaaacctctgtggccatggtgcctttgcccaagttcttgtcctgaggaagaatgagatacacagacaagcgaaaggtgaagaagaagaagagtttgatttagtgttagaacagctcagaggagtgggtagctcctctctgtaggcaggtcatcctgtggaatgttcagctgtcttcaaagaggaggccctggagaggataggtcctctctgtagacaggtcttctggacatttccgcaggtctctgaagctctgagcggagagggtagctcctctctgccggcagatcgttctctgcagctctaagcacagaggatactcctctctgcagctgatcgtctccgtgtctctctgccctcttagtcctctggctgtcctctgccctgctctggctgagtccagggccgttgtggacctcagacgggagaaagtgtgtgccagttggtccggaggtgaccatgggagggcctggaagaggcaccagtaattcccactctggtctgaggaactggcagcctagctcccagccttcagtccctgcgtggcctgaaggtggggccttactggagacccgcccccttctgcccaggaattaatctccctgccgctgccattcatggccctggggctcagccccaaccctgctccaagatcagagccagcatgggagccgaaagaggccaggtagcaggagaagacattctccgagcctgcagggattgtggggggcgaggggaccttcccaggcccccatgggtgcaggctgcagagatgcccagttcctgagcctgggagggcagccacagctgcactcgcagagctcccacccggccaactcagaaggggaagggttcctgcttgtccccagctccttcttgctgagtggagtgggaggaccaggtcggcaaccaggggttgggcggttgcagctacacccaggaggggagatcctgcctgctcccggttccccgcaagagcacagggaggctcagatccacagcgcagtctgggcagctgtagccccacccagggcacctctctgctgcagccggagtgatgacaacagccactgccatcactagaacctgtaaaagtagctgattgctccgtttttctgagcccaccgtgatacataccagactcaacacaaataacattgctttcacttgcaaattattatttttctcagaaatttggtcataagaaacttggaaatatttcataaagctcatatgtctactgacttgctccatcttgtagacagtctggtagcttgacaccatttattcagacttttgaagaatgtatgcctaggtttataaaaggaactagattaacccaataggctaataggaaagaacaataccagcagaaaaatagatcagtgctccacaattatcatatcctcttataagtcttagtttctggtcccgtcaattgtttgttttttgatattaccatatcctattatgtgcccacatcctaccaaaatgcatcagtcatgacatgatgcaatggtttctcaaagaactatatggtatttatcagttggtgaagctccattctaaatctaagaaatgattagtgataactgtagcaacatgcagctcttgcaatgagagtacagctcaacttcttcagattcatcctctcaaataggttatgtctgctcagaaaatagcacagtccttttctcctgggcctgaagaggatatccttccaacttctcttctatgtgaatgaccatcccttgaaaagagtccaaatattttcaccacctgttgaatatgtattcaaaacacacacactaaaaaaatgatacaatgaaagtcactggtcttattttgggcaactctgagtcttttgtcatattcattgtgcatcagattactcagtctcattaaatgaggctacctgtgtgattttaggcagtgagagatagatattttttacaagctggttgtctgcctaaattctgttgctgatgtttttctgggctactccttgactaagttttttaccttaacaacacaacttgaatttgccacactatagttttatttttaagtaaggtcccattggtcaaattcaatttatgtgactttagcagatacttctaataggccaatacaagccagtaattgttataaattagaaagctattccacacagttctaatttcagagagcaaaattatcctcactgatcttgagtactttgtatttttccatcatattaacagtgcccttggctctctcatatattctcattttggccactaatgttttgtcactttgctgctcacaaagcacatttgtcttgttcttttcttcttacaaaatgcctatgtctactcacagcaataaatgtgagaatgcaaagcattgcaaaacagcacaccatctttactagtaagaatttatggaacagtttaaatctatgatttctcaaaccttccagctctaatatgtcatccagcatttaaacacaggtctgtgcacatcttgctcctctagaatcacagtgataaaagataaattgtctcctgtcttctttcacagccttaacagtaattatagaagttcatgcttttacatttatagtcctagtatatatagatcaaggccatggatgtaggggtgcctaagcaagtacagagaaattttgagaaaagcacttcaggggtttgtatacataaagaacgaaggaacttcatgggggaaaatatcccatcctaaaacaacaaaagctgaaacacatgtttgatgaggtgcagtagactagtgcaaaaacaaaaacaaacaaacaaataaaagattgattactttttttcttaagtttttaattagtatgggtatgtaacagttgcatatacttatggggtacatgtgatattttgatacagacatacaatgtatagtggacaaatcagggtaatcatgatatccatcacctcaagcatttatcatttctttgtgttaggaacatttgaactacactactactttaattaggatcttccaagaaacaaacacaaagatgggattaaacactgacagttttgttagggaaaatacctgtgtgaaaaagaagtaaggaggcagccagagaagacttggagagtcagcagaccatcatgatttggagtgaagaagaaacagagagaaagttcgctggatgcgtcctagaccaccacatggtcgaagaaagcttcagtaaagccttcaggaaattggccaataacagtcctgtgtttccctgaaatgagtcagctttcttccctcagtcattaacagggattgtcctggaagaagcatggcttcaatgcaaacacactcttggatttcagggtgcagcagatggggacttaattacactccttaattgaaggtctgaaaggcacatgcccctcgtcaccacacctacgtatttgtcactataatcattcatttgcccagcatcccttatctcctccttgaggggcttcaataaaagaacaagtaaaaactaaatatgtatcttcgcaataaaaatatcttcacgacgtctagagtcaagggcattaacattactcataccatagactttggtgtctaaactcaagcagcttacttgggaggggagtggtttgagaagcaaggtggctgccattaaataaataattgcctataaatccgattataattttggtaagatctacaaatagaagcgcagggttcttaaagcctataacataataccttgccataagatttattcaggtgctcaataaatacttcctgtatacctactttggttcagacactgcactgctatagtcctcaaagaaagatgcctgacatggagataataccaccctcttttcatcattccgttgcagtctcagtgatgataacagtcggtggaagcagccacagtagcagtgtcctttgcagtgagaatatgtgggtccagtgccttcatttcagaaaccagctgtctggatactggacacaaaaaatcttgtttggtagaagcagacgcaactacttcatactttgctagaactgtattttatttaacttatggatcagcacctcatttctgtgtcatatatcacatgcccggcatcgtgccacctaatgaggaagagaagtgcccccacatgaagtagaatagagtggtaccctcactgtgtatgctttcaatcttttaggggcctaagcatcacagaagtgtagataccattaaaactaagaaaccagcagataataaaaatagctattgttaggaaatagccatgatgtttcacattctaaaggctaccagaattttttagaattatcaaactcatgctgggtaggtggacataaataggaaaaacatggctttgtgttagctatttttaaagttatacttgtataaaaaaggacacagaatatttcatttaacatatggatcaaccccatgtctccgtgttggatatcacatttccagcattgtgtcacctaaaggaggaggagaggctcccccacacaaagtatgttggagtgataccctagctgtgctggttttcattatattgcaacatatttcattctatgtaaggctgattaaatgtttagtttgttgtctattttttttgaccaaactaaaaggagtaagagtgtacaagctctttgtcagctttgaagttaaaacaaaagtgataatctatcacatctgacaagaagtaggcttcaaaaacctggatatatcaagattatttgaaatatagatctacatctactatttttaagagtgacctttgccctaagtattcactgtgccttgagatattacccaacgattgtatgaagtcatcaagattaacattaaaacattaattatccagaacctgaacacaaatttctacagtatcacagcaaatcatgtgattctcaatccagggtacaacaacatttcactaaatgctataaaaagataagaagcctctttagagatttcttatttcagagtgcaagccaaatgagggggcttggctttgccagcagtgcttattccacctgaagttgtaaaagtagctaaatagctgaaacaacacactgaatacaatatagtgatcaaaatgcatttctttagcaaacaatgctttcagagggtgcatagatatactgctaaaattttgaagaaacaagcattagagtgaatgacgttaagtatggaaggttttttaatatagttggatgaaaacatatttctaatatcctattttaaaacatttgctacattctgtttgttggttggttggttggtttttgagacggaatttcgctcttgttgcccaggctggagtgcaatggcacgatctcagctcactgcaacctccacctctcgggttcaagcgattctcctgcctcagcctcccgagtagctgagattacagtgggattacaggcatgcaccaccacacccagctaattttgtttttttttttttttttagttgaaatgtagtttctccatgttggtcaggctgttcccaaactcccgacctcaagtgatccacgacctcagcctcccaaagtgctgggattacaagcatgagccaccatgcccagcctacattctgttgtaataatacattaagaactgtttagtgaaacaccaaatgaaagagtacacacacacatacattctcaaaagtaaatatattctttaacttaaaaaatacaagtatttattttttaaaacctgcaagtgtaactactgatggagttatactttaaccggaatctttaagtgacaggcatcatttaaattcattcagttattcatctattcatttactccaaggtaatattatattctttgactgcatatcaaacaattgcagcaaaagcttacagccatagctcaaccttcctaattagatctgtagaataaatctttagatgcctaagtaaggccagaaccttggagatttaagttcagccccaatcagttccccacaggggaaatccaattcccagtaacatcaggattagtacatagggcttggtactgggctgtctttatgtgaatatttcactaaaagcataaatatattttctcaagaggtagtctacacgtgcattctccttgactaaatcttgcattctctaaagttaagtagattaaacacagataaacacagattcccattttatgggtttggttttactgtaagttatagctttcaagacttaaaagtgtgcctaaataaagtaaaaatgtaagtaattattatttgtttggcaagcaaaatatttcagaatgaggttctaggtggtgaagatattaagaaatcactggtgcccaacactgttggactatattcattttaaacacattttggttctgtcccctaatcctggtatgctaacagggatatactgtatttgtagagttcctcttcaggaattcaggtcatatttcagatcctccagacctcagatgtggttcaaaagatcaagaggcacttccttaattcaataaatattcatttaggatctactatatgccagtattctatggaagcttaattttgtaatatggttttgggcatgtgtacatatgtacaaagacatatatatgaagatattacccatagcattgttaataatgagaaataggtggaaacgattcaagtatttatcaatagaagatgatgtaatgattcacctgaacaacagaactttaagatcattaaaaagagttacatcgttacgtattaatatgcaaatatgccgaaggaataagaccaaaagttgtaaaatatatttaatttaaattttaaaaaaggctacagtaagaaatgcaccaaatgttaaaaggtatcatgatttaattaactgtgtaaaaatgagaatttcaaaatactgtgtagaatacttaaaatacctaatgagacagaaagaaatcattaaagtcttatacatgtgaaattttgctcgtggcaaagcacttaaaagagctgcagaattttcatattagttataaattattatacagagaaatcaaatggttcatgatttttatgataaatgctcccaagtgattttaaaatgtatatacatatttaatttatcctttcaagataaaggtcatatttttaacagtgagtgagagaagtggtttcttaaaaaataaagttatacttcagcaagaatattttggaaattgatatttggaaactttcctagagtcatgtcattttgattccaagaacaatttaagtatattacctatttaaaattttgtcacatatgatcacttcagaaatttggaaggagagtaccctaacattatttcaatatctttcagagtttcagtgggttctgcgccaacttgttaaaaactacaacaaggcagcactttctgattactttgcaagaacaagtgactgattgatacagtagaagatggaaatttactatataagttgagaaaaaatttgcatagttggtgcttaaaattgaaatatggaagtacacagtcaaaatattttacctatcagagtgtgcaatgagaatcttgaacctcgttcatctatagaaataaatggtgtattatttcttcttaccttgtctttcctcaggaatgatcgctagagtcactgctgtcacagtttgccttcctactttgtccttctatttcattaaatgttattagcatttatataagtattagtatcactgcctctatagtactaattccctctgtacctcattttcaccaaaggaatgatttcaactgtacctacaactagagatcttatgataatcaaataataatatggatatgaaattacagtatacatgataatgtctgaaactaatttgagatattaacaaattgcctttgtctgtttatcttaaactgcatttgctgtgtctctcaatactgtgaggctcccaaagatttcatatctattatttttatccccctgaaacattgataaataaccacttattcccaggaactaggctattattcattttcccatgatcaaagaagttagcacagaaagtatgtaaagatggtaaaaggctttgggtcctcagattgtcaggtaatccatattcctcatagcctgactaagcacaagaaaaggagcacccaccccaatatatatttgatgttctgatgttgatttctccagtcatcccttcacactcttcaccaatataatgcaaatagctgctgtgtctccaacaggaattaagaagaacatgttacactcacaatatgaatctgaatctttttcttttgggatgaacaaatctaacaaacataaaaagtataaattccaaaatcacgatggcacagtgtaaaacaccttgacttatcataagattctgcacatctattaccactggatgactgcataactattaatcaactaaccataaagtgatgcccagaacttgataaatactccaaaatactatgtattagaattattattgtaattgtaataaaaacctctaatcctcagtttcactatattaataaaatatgtgtgtgtcgggggaataatgtctgtggcacaacttatcagaccttctatgagaatcgaataaaatatacctatgaaacttctatgagaatcaaatataatatacctaagttatacctatgaaaagcccttgaatatgatacagttcagtataaatatgttaatagcttacataggacaacacgtccctgatggtttttgtatactaatgtaaacagaatggtaacaattataacttggttacaaggaactttacacgttactgcacctacaaatctattaacaacaaagagtcccaaaatgagataatacagagtcattaagggagtcattattcccaaatccatttttggagaactaaagcccatgagctgatgacagatgcttaaagagacgccagttgtcttatcttaatgcagtgagtatctccctccaccacacaaacttccaggaagttttcccgctagtcatttgcagatttgtaacaacccattaagacagtttgtaagtgtgcataattttgaaaacgcttttgcttaattctctctttataattacaatagatgaaacttcttctcttggctcgtttattaagaaaggatcatgaggcttgtgatagggtgaccatttaggtagaaaatgctgtaaaatatgcagcattagcaataacaaattcccataaatattgaagccatgggaaaactttgaatgaggaatatacgcatttttatgtgccatatagtaatgtaacatgataatgtatatattttgttcattttgaaatgtaaaatatattcattttttgctcatatttgctcattttgatctttaaattgaatggatcaaataaaattatatctattatcacttctttccacatgcatctgtgaacaaaattgaacaaatagtttacatgtagttatagatttataaactgaatacattttaaaatgaatatttaattttcaggtactgtgcgatggttttcaataaattgagatggtaccaaaaaaaaatcctgctgtagttctatacccaaagaaaaaaatactattaccagtttgtatataacctcttagaaacagtattttacttttttattctaaatggaactattaatagaagagcattgagaactatgtccatagagctttcaaatttttttaagaacaagtagaaattcaaacacaaaagaaagatttagtgacaactaaaacaagcctgaagtgttcaaaagaaaaataagcaggctagtttatgacaataacattgatgtgttttaccagacaagtgcaggaatgtagctggccctcaaagatagtgaagtcggtcagcacctggaaatagtaagaacttgtgaccttcaccttctgtctcttatctctgcatatctgcttttctttcttttatacacaagctttctctgtcctaggttcatttacatggtgtatggtggctccataacaactaagaaattttcacataagaaatatcctctatttaagaaataaaatgtgaaactgagtctcacgttttagttctagtaataatttcaaattaatggagaagcactttgtattagggtcccaacacaaaacggaaggtgtacttagctgttactttcagcacaaattaattaagggagtatttacagcaattgaggcaaaaattaaggaaccaataaaggatatagagacccaggatctaccaacagaaagaggcctttattaccctagacttgaaggagcaaagagagggagccaggagagggagccttgggagaagcagttttccagcaaaggttatagctaaaaataaatacgaccattgaaacaaccagagtgacaaggcagaaagacaatgagggaagaaacatctagacctgtttcccgtactccaaacccatctgcaagccagagggtaagaaaattccagttaggaggtctgtaggggtcagccccataggcacaggacggggcccagaagaatgcagaagaaagatggagaacgatggaaaagaagatgaataagatgggaaatgtgggtagagagataggcagaagagaggggatagaggaagacagtaaaaaataaataaaaatttaaaaatcccagcatacgctctaagaacaagcatatgctctaaatagtctacctaacttgaaattctttcttccccattcaatcagtcatgaccaaaaggttagatcactaaagggttactagagattatccctataacaacctgtatttgttctttctagcagtcattccgtttggtttatacaattattggttcacctataatattcacatatgctatttttggtttccttaagtttcttgaaaagctacttgactgctgccttacattatatgcagtttttgggtagtctgatgccagtttaattttcgtgcctttgtaggtgttactcatctttttacctggagattctgattacattatttttatgcttatttttactgttttggagttgatttttggagtttatttttctagatcaattttccaaagtaccagatggccactttcaattggagatttaaattattttatttctggtaagtttttttttggattatagttttaaatattgtttttccattgtttggtttttccatcatcaaggaaaccagttatacatatgttaaacctcctttgttttctaattcaactactttgttctctgactctttatttttatgtctcatttttattccctttgatttttttttaactttcctttgggcactcataatttacccttcatttcttaaatatttttgtctttttactgtactagtttcctgagttcagtcaactctcattatctttcttcctattggggtcaatgtcctgcctcaatgtttgcatttttaattcaaggtatctatttgtacatactcaaaagctcatttaagaatatttaatatgtggagtattatgttacagttttctcccccttcaagggagatcttttaagggagatttttaatcagcagtgaagactttattagcattttctaattttttttacaatagtctgctttttgctgctcttttttttttttggacatggctcaaatacaagagtattctcttttgttaattcttgtctctttgtgcagtctcttttatagatactgctgttaggttggggaaggaaaggaactgggaagtcttacttcagtttttgtttctgtagaattcttaactttctactcatattgctttcatttgcatcactgcttttatttttgcaagaaatacttccccctccccctccgtatgtctgatttccttccagaatgccaccctaaagttgatacttcctgtcctacacacttgcaagtcccttttaggtagccagaacaagtgacctatgttctgtgttttgactttcattgctgcactttttctttcttgcggtgattgtgtctttttttcctaagttctctgctcccctctactcttttgttgacatctttaagcctcccctccctctttacttttatcacaggcttgcagtggcaagtgcataatgaaaaatttgttgacatatctttccctcttcttacaggtaattagaaagatgtggtgttctctgttttctggtaacgcaagaagtatgggtcatgaatagtttaatgtgatctttttattttatgttactttagaataaagtctaggagatactggaatcagacaggtatcgctattctccaaagccctacgatcatttttatttgaaaaaaattaacaataaatacatgcatatgatgaaacaaaatcaagcagtgcaaataagtatataatgaaaatatgtttctctcccactccagaaccataatctccaagaatcccttctcaaagatcctggtacacattttatggaagaatcttccacagatactgagtacagatgcgatatatttccatatatttgtgtttatatgtaagaattctttatttcacacctaaagtattaaatacacaccatgttataaccatttaaaatataagcataaaaaatacacaaagagatagttctcttgttagtgttataggtcccataaaccaatagaaaatatttgaaattatttaaaattattttccctttgcctttaatgaaattaataattatatttaaatctatcttcttactatatatttttatttttggcctgtctattctatattcctgtaccactccttttgggttgaacaaattttattataccatttctttcattagcttgttacttctcaattctttttactgtagttttactggttaaaagataaagaactatatttactccttcctaaacaatgcaaagctctcagtatacttgaactctattcctttctgtttgccattattctcatgtatttttaaatatctaaaataatatttcattattttaagtcaattttcagttagattaacccatgggtttacttttctcatttctctttattatttcttgcagtttggagctgtaatctattatcagttttcttttgcctgaacaacacaaattagcatatactttagtgtggctctactaataatttctctcacttattgtataaaattagatttcctttcttttcgttcttggaagatattgtaattgagtattaaattccatagaatagtaggttggcagttatttccgttcaataatttcaagatatttcattttatgaccatttccatctcttccaaggtccactgtcattcttacttcgctcctttggagttatttttgtctctctagccacattaacgatttttcttttttagcattcttaatatgatgcatcaaaacttaattttcttttgacataatgtgcttcaggcataactgtgatctcaagtctttcctctgttttcccaaaatcttagtaatcttttcttcacgtattgcttttgtttgattctcttcttgattctttaattccacatgttaaaacttttaactatatgtttgtgttcttttctgcattttgcgttgctggactaaaacattcatgggtttttttcttcttttattttctatttcaccaattctctcttcagttgtgcctagtctgcagctgagtgcattcattgaattgctactttcagtttaatttttgtccttcacttaacctatcttcactatggtttgttttttcacctgatcttttctggtgaaatcagtgacttctagaccccaccaggaccatatttatcaaatgaccaatatgtctaatcaatctctaatcttcacttcctagagcaaatatctacactactttatattgaaattacataattcttaacatttattctgcatgctgcagaaaacaacagactatgaatctactcttcagaagatatgttggaagtattattagaaatgtcatttagaattgtgtttcactccaatacaggaagagtaagaacctgctatgaatatgcaaacttgctcttttttaaattgtttttaatttttgtgggtacataataggtatacatatttatagattacatgagatcctgtgatacaggtagcaatgtgtaatcatatcaggataaatggggatatcatcaccccaagcatttatcccttatgttatggacaatccaattatactcttttagttactataaaatgtacaataaaattattttgactataggcaccctgttatgctatcaaatactaggtcttattcactctttctaactatttattttgcacccattaaccattcccatttccctccaactccccctattttccttcccagcctctagtaaccatccttctaccctctattgccatgagttcaatggctttaatttttagttcctataagtgagagtatgtgaagtttgtctttctgtgcctggcttatttcacttaacataatgacatccagttccaaccatgttgatgcaaatgacaggatcttgttcttttaatggctgaatagtattctaatgtgtatatgtaccacattttatctattcatctgttgatggacacataagttactcccaaatcttggctattgtgaacagtgatgcaataaacacgggagtgcagatatctcttcaatataccaatttcctttctttggggtatatattcagcagtaggattgctggatcacatggtagctctatctttaatttttttaggaaactccaaactgttctctacagtggctgtactaattcacactcccaacaacaccatactagcttgcccttttatatacatcctcgtcagcatttgttattgtctgacttttggataaaaaccattttaactgaggtcagataactcatcgtggttttggtttgcttttctctgattatcaatgatgcttagcaccttttcatgtatctgtggtcagaccggttctctgctctcaaaccctgttttctgttatttaagatgtttatcaagacaatacgtgcactgctgaacatagacccttatcagtagttctgcttttgccctttgcatatgatctttgttagaccgttactagtagttctgctttctgccttttgaagcatgtgatctttgtacctactccctgttcttacacaccctccccttttgaaacccttaatagaaacttgctggtctgaaactcaggcaggcatcacggtcctacggatatgtgatgtcaccccggaccgcccagctgtaaaattcctctctttgtactgtctctctttatttctcagctggccaacacttatggaaactataaagaacctacgttgaaatattgagggtgggttcccccaatatttattaagattatttgatttgttcgtatacatttgaactccttctacattcgggttatcaatatcttttcagatgcatagtttgaaaaatttgtaatccattctgtgggttgtcttcactttgtttcttttctgtgcagaagcttttttacttgatgttataccatttgtccatttttaagtttgtctgcttgtgcttgtggggtattagttaggaaatctttgcccgattcaatgtcctggagagttcctgcaaagtttcttttaagtagtttcagtagtttgagatcttagatttaagtccttaatccactttgatttgatttttgtatacggtaagagataggggtccagttttattcttctgcatgtggatatccagttttcccagaaccatttattgaagagactgtcctttcccccaatgtacgttcttggcacctttgtcaaaatgagttcactgagatgtacagatttatctctgggttctctattctgttccactgatctatatgtctgttgctatgccagtaccatgccgttttggtaactgtagttatgtagtgtaatttaaagtcaggtaatgtgattccttcagttttgttcttttggtttaggatacctttggatatttggggtcttttgtggttgcaagtaaattttagaattattttttctatttctgtgaagaacatcattggtattttgatagagattgcatggaatctgtatattgctttgggtggcatgaacacttcaacaatattgattctttcaatgcatgatcatggagtgtctttccatatttttgtgtcttcttcaattttttacatcaatgttttatcgtttctattgtagagatctttcacttctttggttaattgttagatattttattttatctgtagctattataaatgggattagtttcttgacttgtttttcagattattcactgtggcatacagaactattactggtttttgtatgttaattttgcgtactgccgctttactgaatgtcagctctaatagctttctggtggagtagctgggtttttccaaatataggatcatatcatctgcaaacaaggataatttgacttcttccttttcaatttggatgccctttatttctttctcttgtctgattgctatagctaggacttccagtactatgttgagtaacagtggtaaaagtgggcatccttgtcatgtttcccctcttagaggaaaggctttgtttttccacattaacgatgatactacctgtgagtctgtcatctatggcatttattatgttgaggtatgttccttccataccctttttaacagtttttttaatcatgaagggacattgaattttatgaaatactttttcagcatcatttgatatagtaacttatgtctataaacatccctcttcttactactttcaccgtatcccataggttttggtatgttatgtttctattaacctttatttgaagaaatgtttcaatttccttcttaatttcttcattgacccactggtcattcgggagcatattgcttaatttcattgtgtttgtaaagtttccaaaattcctcttgctattgatttctagttttatttcattgtggtcagagaagatgcttgatatttcattttttgaaagtttaagacttgttttgtgacctaacatataatttatccttaagaatgatgcagcatgtgctgcagaggaaaaaatgtgtatttggcagctgttggctaaaatgttctataaatatttattagatccatttgttctatagtacagattaactctgatgtttctttggtgattctatctggaagatctgtccagtgctgaaagtggggtgaagtctccagctattaatgtattgggatctctctctttacttctaatagttcctatatatatcttagtgctctagggttaggtgcatatatatttacaaattgttatattatctcactgaattagcccctttatcattaaatagtatccttgtttgactctttttgcagtttttgtcttgaagtctattttgtctgatgtaaatatacccactcctgcctttttttagtttccattggcatggaatatctttttccatctcttttcagtttatgtgtatctttccaggtgaagtgtgtttcttgtaggcaaaagatcattgggtctagttttttaattcattcaaccactctctcttttgattggtaagtttagtctatttatatgcaatgttactactgataaataaggacttactcctgccattttttaaattgttttgtggttgttttgtggtcttctcttctttctttccttttttcctatcttttagtgaaggtgattttctctaattatgtgatttaatttattgctttctattttttgtgtatccattgtagttttttatttgaggttaccatgaggcttacaaaaaccatttcataacctattacctgttattttaagctgaaagaaactcaacactggttgcataaacaaagaaacaaaaagaaaacgagaaaaaactctacaccataactttgtcaccctacattttaacttgttgtttctatttatatctcattgtactgtctatgtcctgaaaagttgttgtagttagtatctttgattggtttatcttttagtctttcatttaaaataagagtagtttacacaccacagttacagagttataagattctgtggttttctatgttcttactaacaccagtgagttctgtaccttcagatgatttcttattgctcatttacatccttgtctttctgattgaagtactccctttagcatttcttatagaacaggtctggtgctgataaaatccctcagatgtctaggaaagtatttactcttcatgtttgaaggatatttttgctcaaaacactgttcaaggttaaacgtttttatctttcaacactttatatatatcatgccactctctcctggcctaccaggtttccactaaacagtatgctgctagacatattagagctctattgcatgttatttgttgttgttgtttctctcttgctggttttaggatcctttctttatccttgacctttggaagtttgattattaaataccttgaagctttcttctttagttaaatatgcttggtattctataaccttcttgtacttagatatgaatatctttttctagaaagttctctgttatttgcacttttaataaactttctacccccctctctccctctaccctctttttaagttcaataactcttattttgccctactgagtctattttctagatctcataggtgtgttgcattgtttttcagtcttttttcttttgtctcctctgtgtattatcaaataatctgttatggtcactaattctttcttttgctggattatttctgctactaaaagactctgatgcattcttcagtacatcaattgcatttttcaactccggaatttctgcttgattctttttaaatatttcaacctctttgttaaatgtatctgatagaattccaacttccttctctgtgttatcttaaatttatttgagtttcctcaaaacagctattttgaattatctgtctgaaaggttacataccgctgcttttccagaattggtccctggtgacttatatagttcattttgtgaggttatgttttcctggatggtcttgatgcttgtggatttttgtctgcgtctgggtattaaagagttatatatttattgtagtcttctcagtctaggcttgtttgtattcatccttcttgggaaggctttccagatactcaagaggacttgaatgttgtattctaagcagtgtctgcgctaggggtcacctcaagtccagtaatgctgtggttcctacagactcttaggggtatccccttgaaggtcttggataagatctggaaaaatatgctatagattaccaggcatggactcttgttctcttcccttactttatcccaaacagagtctttgttctgagctgcctgaagctgtggattaacataaacattcctttggccactgccacaaaactgtgctggttcagaactgaagccagtacagcactgggtcttgcccaaggctggctgtaaccactccctagctgccacctatgttctctcaaggcccttagtctctacaatcaggaggtagtgaatccagacagacttgtgaccttctcttaagggcaacaccaaattccctggtgcctgcagtggaaactgttcgtggtatgcatggtccagccacagccttgcatgcagccagcaccctgtctgtgagcagtggctagacactgctctcactcacacacccctcaccactccacacctggctcacccttggcaagcatgggatcccggctggtagcatgagcagaacacaacctactgggccaagtgggtggaacaagaccagtgggcccaagcaaaacgggcaatggcgccaccggctacagaggtttccggctgcaaaagtgacaccctaaggatcctgcgacaaagggccagcaatgagttcaatttattgtctcacaattgctgtgctctccctctcccaagagcacaggctctctctttgtgccacccagccactgacaagagttggaagagaggtggcatcagtgattcaaaactgtcctctttccctcttcacagtaacaaacctacacattctgcacttgtatcccagaacttgaagtaaaattaaaataaataaataaataaataataaaataaataataaaaactagttatagcttacatggtttatttaacttagcacctaagtcatcttcggtgttaatgtgaagttaatgaaaatcatttgacaaatatttgtcatgcgcctcctatgtgcaaaggacagtaaagttgtaccactcatgtaacttaatgtactctctgattaagagaggcaggcagtaagtaaacacactggtaaatacaaaatacattttaccagatgatgacaatggctatggagaaaaacaaaatatggtaaggatggggaggagtgggcaaggaagggtactacgttattgtcaggatgacagcatgacatgagatgaaagacctgataggcctgagaatgtaagccatgaagatttctgggggaagggcattagatgccagagaaaaaggaagtgcaacattcctgagttagtagcatgcctagtaggtttgggaaacaacacaaaagccagaaaacgtgttataaatgaggttagagtagatatagtggaaccataatgtttagggctttattagttactacaaaaattttgacttttaacttgaagcataggaagccactgggaaattttaggtggagaagtgacataacttgactttgttaaaatctcactcaggctaacacattgaaaataaatagcagagcatggggcataaggaagccaggagaccagttagaaggctattgctattggcatactaattgtggcatgtggtcatattctagatgttttttcaaagtagacttgacagcatttgtcaataaatactacatgaagatgatggatgacttcacagtgtttggcttatgcaagtggaaagatgagttatcaagatgtgaaagacaaggcaaaacaaaactagaaatagtatggctgggtttctttttagacataatacattttaacagctattagacatctgtagggagagttgaataggtcatagaacacacaagtctgtattctgagtgaaggtagagatacaaatttggaagtcatcagttcattggtagtagttaaagtctttacgtcagataaggtaagccagtgagtgagtgtgaaaactagtagaagtctgatgcttgaaccttagaatattccaatattcatatatcttagaaatgaggaaaaagcaaaccaaaagttacctgccaatgcaacagtgctatggtctgaatatttgtgccccccaaaatctgtatgtttaaatcctaacctccaaggtgatagtattagaggtggagactttggaaggtgatcaggtcaagagggaagagccctcacgtatgacactagtgctcttcaaaaagagaccacaaagagctcgtttttcccttctgccatgtggcattacaatgaaaagacagctgtctctcagaggaactgggccctctccagacaccaaatatgccagcacctagacctcgaacctctaagcccctagaaatgtaagaaataaatttgttgtttataaggcacccagtctatgctagcttgttatagcagtcaaaaagaactaagacaagaaacccagaggctgttaaaaaataaaaataaaaaaagattgaacaagtgatcatgacagattaggtatgacaaggactaggaattgacctctgtgcttaacaatatgaccgtaacttaagacttctatagaggggtagagataaggcctgactgatgtgagttcaagcaagaatggggaaaagggaactatatatactgagacaacatgcacaggtaattattttcaggagttttgctgaaagaagctaaaagaaatggaacaaactagagataaatttgaagttgagcaagtttaatttttagtatatgattacagcttatttgaataaaccaataagagtaagaaattgatgatgcaacagaagcagaacaattactagggtcatatccgcaagaggggatgggctgcaatgtaaaagcaacggggttggccttcaataaaggtacagacatttcaccaataattagagcaaatgcaatataaataaacacaaaagcagtcaactttttttttttttttttaactctgtggagtagaaaaaggattagacttagccaggtttgagatttttccagaaaaagtcaattcatagacaaagtggccatgaaggtatgcccaagggggtgattataatgattgggcatggactctacatgaaagtagaagtgaaaaaaaaaaaaaaaaaaaaaaaaagaaagtggaagtgagagcatatggtatgcgagaaatattgtaatggtagcaaaagcaatggaatgcaggatgctggtaggatttaagaattcttagtgtcagggcagtagaaggagtaagctggaaaaatgggagtggtgtttggaaagtgtaatgcttaaaatgaagattatggagaagagcaattattgacaatgccaacatcttggtcatgaccatagaagtatgtgcctgagacagggtaaaaaaaaaaaaaacaatcgctggaggggaggaggtaaaaaaaatgaggtagcagatatgtgaaaaataatataacacacatacatatatacacatacatattttatatgcatatattttacatatacgtctatgtattgagaaaaaggatgtgctaggtgctgagtttgaaacaatgtgcaggagaaagacctggagatctgtagatgcctgcaacaaggtggagtaataaaaggttcaatataacagcttgaacttaaagctgggtatttttaaggagaattgtctgaaaggtgccaagacagtatatgcttatctccaggcccagtagcagaagaatgcagaaggaaaaaaaaaaaaaaaccttcttaagagggcttcatgggaagccatttccttagagagagtcaagtttcatagagtgagaagaatgtttggtaaataggttaggaatgcagagttttgctgataacagacactgagtcccacacacttgtggggatgaaggataaatttggatgatgaagaatgacttggaagtcttagagatcatagagtaactgacaaaatcaaagataaagtggaaaatgggattagtcttgggtccttaagcaggatacattagggatacagcatgtgttggtaaaaagagaaagggggtcttgataaaagtgtttagagtctaaggatcctttcttcactaatattgatgaagtatgaaaggcagatgagatgttacatttagtgagatattctgaaacacatatacagagaaaatctgatctgtgtgataaatgctaaggaatatatacaatggagtttgagccaaaatattgtagggtatgtggaaagctaatattattaattcattcacacaattaattataatttttgttggaagccaaaacatctatttatttccctgatgttaataaaataagcccatctgatttatgcaatgctattttgcaattgtgcaaataaatcattgcactgtcaatttctacctgttggctgggtatctaaatcttggagatatttttatttttatttttatttttgtgatggagtctcgctctgtcactcaggctggagtgcagtggcacagtctcggctcactacaacctccacctcccaggttcaagcaattatcttcctcagcctcccgagtagctgggattacaggcacctgccaccatgcccagctaattattttgcaatttcagtagagacgggggtttcaccatcttggccaggctggtcttgaactcctgaccttgtgatccacccacctcggcctcccaaagtgctgggattataggcatgagccactgcgcccggcctggagataaatttttaatcatcaacatataatatccacatttcagacactcagaaaacccaaccttgaattgaagataattcctaagaacagtaactatagaatactctccagtccactaccacagtgcactgtgcttaaaccactgatccctggtaacacatgcaatagccttgcgatacgttatttccatttttcagaggaaaaaaatgagacacagtgagataaaactgtcctaggtcatgcagtgagtaaatatttaaacatgatatatctgagcctaaaccactgtcagaaaccatgatgtctgtctttcaggcttctgcagtgagtacttctcaaagcatagtccctggaccaacgaatttgtaagaaatgtgaattctgcgaccccacctcaaacccttgaaccacaaagtctgcggatggtgtcaacaattctatattttcataatccttccaagtgattctgatgcacgttcaagtttgagaaagtctatagtaaggagagataaaacatcaaattattgagaacatgataaagggcagaataacgaaccattaccctaggttatttatttctctcttatatgggtggtgtgtgggtgggggtggtatgtgttggggggtgggtatgagtatgtatatgtgtgtatgggaagggggtgtagtactagctaacacccctcctctgttataagtacctttagaattattatcaacttcaggaattactgaaactgttatgagagtcaaataatttggaaaaatacatccagcttattataatcttgccactctgaggagttggttatcagcacaactgttgtttttacttttttagtgtattaaatatatgaagaaacaataactcttacagttccaaacattaaagctctcattttcgctacaaaatctggtgccttataagtgtgtgagcctctcagttatgccagaagtgagacttcgcagaacaggacagtaatgtcacagggctatgagacaagagaactgtcatgacattaatctctgactccatatagggaacaccttattataaaaggcattcttgctgctgcagagctgttggcagggcagctgaattactgcaacagccatttagtctctctttttgagtgaatagagagtcaatatgaaatagattgcaactgacttttttatattacatgaataattgattttcatggaaaaatgttttctaaaaataatcatagcaagagttctctcacctagttccacactttccaaccaaaatagagaccactacaaaacgattaatcattcaatactttccctttagccctgatggcataatgataaactaaattcaccaggaaagaactctgagagacagaaaatcctacatctattaatttttgtgaggcacagcttatgaaaataaatggtggtgaaaggtaagtaacctcttgcatttgttcacctctgctaacttttactccagctacttaatatctatgatatcatatgtatcatcatcatagaggcaattgagaggtacaattacccccattttacagagggagaaacaagggccatagatgtttaacaaacatgcataggtaatggtatacattgtgtttagaacttggattggaatctggttctcttgaccattatacctctctatctgacagtgccccaattctctcctaaacttctgagtgacctgtctaggaagagtatgctccactgccacttaacaagtacatgatcatctaaaccagtagttctccaagtaaaacagagggacacctttcaggggatgttttttataataacactaggatgttatcaggctttttcacttgcattcattcaggagtgtgtggtggaattttccagaggctacatggtatgtgatatgaaaacagacaatgcagaagcagaaaagaatatccagctttcttctgttgtcatttagaagattttcaaaaacataaaaatggcaatcttcccaaattttttgttttaaaaattttcataaaatttatatcaacgtatgattttaatcattgtttcttaacttctaatatgataaatggtaacagatataatctgtatttttcacaagttattggaggcctcaatcactttcaagagtgtaaaggggcctgacaatgaacattttaacaactgctgaagagttgaccaacaaataaattcctatgcttcaattatgttctttcatttactcattcttcctttcttcattcaataaatatttcttgagccctataatgtgcaaagaagctccagatactgggtgtacagtaatgaacaaagtaacagcccttattcctagtaagggtagaaaacaatcatcaatgcataacagatacatgttataaacttccatatatattttaaagaaggagagcaagatgctatgaggtaaaacaatagagggaggaaaaagaaccctcatataaattaggaaggctatacggaggaataagaaagaatcatatgaaatgaatgacagaaagaagacctgacagaggaaacaccacgtttttaacatcttgaggtgataaagagcttgatgtcctcaaggaactgaagcatagacaggcagttagagtatactgagcaaagaagggacagaaaagaaagaggttggaaactgagccagggactgtatcttacaaaccaccatatgtcataataggaagttgagattgtattccatgcacagtggcaagtccttaaagaattccaagcagtagaatagcatgatgtctattaagtgggcagtagtgattgaaagaaggaaatctatcaaagttaaccaaaagaaatagaagaggcaaaaaatctgtggatcaaggggaggaaatctatgcattatcaaaaccttgtggagaaacaggcaaactaaggaagaagaaactgcagaagaattacatttttttgaacaataaggtgaggtgagctaagaatacaattggagtttgaccaaatggaccagtgtccacttgagtttgacccccaggtgccaccccagcttaccctagacaacgaaccttccctctatgtctataatataacaataaagcatacaaatggaaaaaacagtaataaggagcagagaaatatatgctccatctattagctccatctaagatgttttaggatgaggaagtaatgtgagttcggtgaaagagtaaatttgagtctgggtatgacataccatctttggcaagggacctcagactgagaaatggaatcatgatgttctctttgtaagttggtctttgatcaggacaattttaacatttattgcttagactgctctccctgccctaactctcacccaggaaagttgggcctgctctgtgagaggtagagatagagcccagagtcaataatctgacatttataaaagttcactataattgccatgtgagaacagactggaaaaaggggagcaaaactggaaagagtcattagaagtaaattataattgtcaaagggaaagatgatgatagcttgggtaaaatggtggtgttggaaatataaagtagatgactgtgtgacaggaattagataaaaagctaatagagttcttgatgcaatggtttgtgaaaatcaagaaagggagaaataaatattactcccatattactagtttgtgcagctgaatagatgatgactctatcaactgagataagaaaaactggggagaaacatggcaagtaagagagaagagaatcaaaactcagacatgttaggtttaacttatttgtgagacatctcagtggaaaatgtcaaggatgcagttggctaaaataaataaatcaataaagttggagcccagaggaatggtttgtaatgaggacacacattttggaacaatagacgtgcatattgaaagacataaaattctaagtgctgccttaacatctttgagcctgaaaaaggattaggttcaaaggcctaaccatcatctcccctgcttgctccaaatacactccacaccctgccagaattgctccactcccagcgactccccacctgtactagctgcaccccactcagtccttaacctaagtggtttcacttttctgcaagccagaattcttcaaacaggccaatcacacctttcagtgggaagcccgggacccccctacacccctgttactataaagcctgcctctcacagcccctgagcattaactctcttccaaagtacaacccccatgtcacctgcatggtatgtggtatcctcctctcccaaatcctgaatatgtgtaactagtaaacttctgtgagtgtaagtctcatctatccagtgttgggtgtcatgtatttggccatctcatactacttaggactagggatctccctttcaccaataacatgaatagcagattatcagaataacaattacatggtatataatgccactgagatgaataaagtcatctaggcacaaaattttaaaaggagtagccatcaggtacagtgatgatccagcaggagaagctgagaagtgacatgagagaataaaaggaaaaccagttggtaggagccctggaaaccaaaaggaaagattattcaaaagaaggataaaattttacctatccacactcagcaactgagagtcactgatgttaataaggcatgagcaggttcaagggagtagtgggaatgaaatcatattgaagtgaattaaacagtgagtgagagatgaggatgtgaagacaacatgtctttttgcaagattcagtaataaaagggagcagataaatagatcactatctagacagaaaactggcctaaaagaaatgagtctatttgggttctggtaggaataatccaatgggggaaaaggttgatgatgctaaaaaaaagaagggacatccaaagaaaagaggcccttgcgaaggcagggtctattagtccatttgcacactgctgtaaagaactgtccaagattggataatttataaagataagaggtttcactgactaacagttcagcatggctgaggaggcctcaggaagcttacaatcatggtgaaaagcaaaggggaagcaaggcaccttcttcacaaagcaacaggaaggagaagtgtcaagcaaagggggaagagccccttataaaatcatcagatttcgtaagaactcactattatgagaatagcatggaggaaactgcccccactccaattacttccaccttgtctctcccttgacatgtgggaactaaggggattacagggattataattcaagatcatatttgggtggggacacaatgcctaaccacatcacagggtgaagtacaaaagatcccatttggagagaatggtctttgatgagagcaaaaactcatcacccttgtaaaaaataaaactttgagtatgaatcctagtgctttgtagatatgatattagaaggaagagagagctcttttcttgtggtttgaatttttccattgaagtatgagcaagagtatttgcaactaagactacaaatttgaggagtgaaaagacagcaggaaagagttaatgtggaaactggagagaaagcccgcttgaaaaatcacagtggaattctgaaaatgtagtcactcttaattaaatcagtcctcgattgtctgcacatcacaaatttaacagtaactgctacaattttggaagccctaccatcacttcacatatattatcctttattttaaaccttactacaaccttatgatgctgaaattgtttttcccactttatatataagaaaattgaagctcaaaaaggttatgtaattgcaaagttaaaaagtgacagagcagctgagttcagttctatccaatgtaaaagctgttgctatctgcaccatatcagtttttgtcaaacttgaataatgcaaacatattttaaagttaaacaagtctcatggactcctaacactgaattgttaagtcgtttgatcttctcttggcatcaggagatttgtaaaccaaaataaagatgaggccactaaagttgtgtgaatcatttgtaaggtagtaatttaaatgatccacagttttcttaagttttttcctcctagggtgactgcaatcttcccccttcagacacatcgagacaatcactacacctccatcaagtgagtactcagctttgtacacattaccttgagaaaatgcagtgaacaaagtcatgtaaaataatccagggttcctatggaataatggcaacttcctaaatctaatctctttgcccgtaatctaactaccatatggaggaaaaaaaagggagcaaataaaactacctttaaaacatgccaaagaataaatttggagacaaggaatataaaacagtttacacacttgagatttcaacaagatggctgaccagagatgcctggcactcatacccctaacaacaacaacaacaacaacaacaacaaagactagagcaataaataaacaattaaaattcacgtatagtgtctaaaaagagaactggagtaccacaagggaggtgtgaattccctgtgaagcatggacacccagaacagcagcatagaaaggggagcagagcaccctgcttctggtactacatcacctccaacaagattgactgggaaccagaaaggactttcatttgcaggggaaaaggtaagcagaagatctccagcagctccattacatagaagtcacatacaggagaatcctgcagccctcacagaccatgatcacagctgggtgagctgcctagagttcacatggctacattgctccaaaatacaagcccatatggtgcacccctcacttccagtgacacaagttgctatagtacagcgtcatcttagaactggaaccaataaccagagtgtacctttctctgagggccattgactaccctgtctctccatccatgaggctctgtcatttttatcatgcttacacatgtgactacagcaccatattcccagttattgaaagcttgggcccagtgggatgtacgtactccagcatctgagcccctccactggagaggctatgccagagccagtggatgcattgcgtgtgtgactctttggcctgaaaaccaacccagcaaccagaaagctttgccaccactgccacaaatccccacactctaggccactaaggcacctgcagaaattgctgatgtggatttcagtggaagaatctgcatggagactacactattatgtagtcttccagaaccaaagctaacaaactacccaatgacaccctaggacaacagctacaagaagatgtctttcctttcaaaagctattccatcaaattggaagaagtgacaattccatcaaatgcacagatatcaaagtaaggataaatgaaacacaaaaataaacaagaaaatatgacacttccaaagaaacaaaataattatttaataacagccttgcaagaaaaggaaatctatgaaatgccaaagaaggaattcaaaatcataatcataaggaaacttggcaagttacaagaacatacagataaacacttcaataacgtcacaaaatgaggaatttaaaaaatgaggaatttaacaaagaaaatgtgaaaagaaccaaacaaaaatcctggaacctgatgaattgagagctacaacaacagactagaagaaagaattctgaacttgaagataagtctttggaaataaccatgtcaaaggaggaaaaaataagaagaaaaagtaagccaaagggacttatgtgatatcattaagtaaatatatctttacatatatttacatatatatttggttaatatgcttaatatatattacaggagttccagaggcaaaataggtgaagaaatgcacagaaagcctatttaacaaaacaatagcagcaaactttataagtcttgagagagagatagacgtccaaatccaggaagctcaaaagtccctaaatatattaaaacaaaagttcctcacctggcaacattataagtatgttagactgctcttgaatcacacaatgcagtattcaagggtgggtaatttataaagaaaagtggttttattggttcacagttctgcaggctgtacagaaagcatggcaccggcatctgctcaccttctaatgaggactcaggaagcttactatcaaggctaaaggcaaagggagagcaggcatctcacatggggagagagcaaacagggggaaggtacaacacatttttaaacaactagatcttatgtgagtttactcaccactaaggagatgtcacgaagccaattcatgagggctatgccccaataatccaatcacctcccatcaggccccacctccaagactgtagattacaaattcaacatgaaatttagaggggataacacccaaactttatcaatagccaaactgacaaaatacaaagagaattctataagtagcaagagaaagaaaagagtgaagccacatacatgggaatctccattagaccatcagcagatttctcagctgatgcattgcaggcaaagaaaaaaatgagatgatatattccaagtgctatatagggaaaaaaactgccagccaaatatactatacacagcaaaactgtcctccagaaaagagagaaaaaaaaagtccttcccagatgagcaatactacaaggaattcatcagccctagtcttaaaagaaatgcttaagggaggaatacaactggaagcaaaatgacaataattactattatgaaaacacatcaaagtataaattcattactagaggtacattcataatcattcaaatctctactatgaaggttaaagtcaatatggtcaaaaataactacagcttagttgtaaaagaacccacaatataccaatatgtatattaaggtaaaagtaatgtattgtgagaagtgggtgaaagtctagagggtttctatacaaccaaagataattttctctcagcctaaattagtctattttagctacaagattatttatattacccacacgttaacctcaaaaaaaaaatgcagcagttacacaaaatagaaagggaatgaaatcaaaccttagcaccgaaaggaaacagaaatcaccagaccacaaaggtaaacaagaacaaaagaaaaaacaaaggatctacaaaacaaccacaacagaatcagcaaaatggaaggaataagtatgtacgtatcaataacaaccttgaaggcaaatgaattaaattctccaattaaaagatatgaaatggcagaatagattaaaaaacaagatccaactatatgctcccacaaaactcactttacctgtaagaacacatccaatttgaaaggaaagagatggaaaatacattctaagcaaaaataaaaagggagcaggagttgcaaaaataaaaagggagcaggagtggctatgattgtaatagataaaacacactttaagtagaaaactatgaaaagaacaaacaaggttattatatagtgataaaggaatctactaagcaagaggatataacaagtataaatgtatacatacccaaaactggagtatgcaaatatatgaagcaaatattattagatctaaaaggagaaatacaatgtaatacaataatagtagaagactttaatatcccactttcaacaatggacagattatgcagacagaaaatcataaaagacacattggacttaaactgaactctagaccaaagggacataacacttacagaatatcctacccaagagcaatagaatatacattctactcaactgcacatggaatactctccaggacagatcatgttaggccacaaaatatgtcttaacaaacttaagaagatagaggtcatatcaagtatcttttctaatcataacagtatttaactaggaatcagtaacagaaggaacttctgaaactttacaaatacatagaacttcaacaacaggctactgaataaccaatgggtcaatgaggaaattaaaagagaagttaaaaattttttaaacaaatgacaatagaaacacaacataccaaaatctatgagatacggcaaaagcagtactatgagagaagtttgtacctcaaagtactgtttatacaaatgcatatatcaaaagagtagaaagatctccaataaacaacctaacattgcaccctcaagtaactggaaaagtaggaacaaaataaactcaaaattagtagaaaaagataataaagatgagaacagaaataaaaaagaataaaaatacaaaatattgatgaatgtaaaattagttttttgaaaagataaaaaaaatcaacaaatctttagcaagactaagaaaagagatgacaagtaaaatctgaaatgaaagcaaagacattacaactaataccactgaaacacaagagatcatgaaaagcttccagctttttgtctaacatgtagaaaaagaaaaagatgccatgttcaccacttctattgaacatagtaggtaagtgaaaaagtaattgagtttttttgccatatagtactgaaataacagtactgcaagtcctaaccagagcagttgggcaagaaaaaagtaaaaagaagcatccaaattctaaaggaggaagcgaaattgtctgtttgcagacaacatgatcttaccagtaggaaaccctaaagaatttttttaaaagctattggaatgaggaaactaagtgaaattgcagaatacaaaatcaatacacagaatgacaattagcaagatgactgactagagaaatttgaaactcatctctcccacaagaaaagaccgtggtgactggaagcccaggagggtggcaatgtagacattcatcctctgtagccccgtctctccacctggattggattggcccagagacaggagggcaattataaatatgtaagtccccaacactggaacaccaagatatgtaaaacaaatgttattagatctacaaggagagattagactcccaatacaataagagttaatgacttcaatatcctactctcagcattggacagataatctagacaaaaaaatcaacaaggaaacatcagatttaaattgcattatacatcaaatagacctaacagatatttacagaccatttcacccaaaagctgcagaatatacattcttctcacctacacatggaacattcttcaggactggccatatgtttggacacaaaataactctcaaaatgttttacaaagtgtacatcatatcaagtgtcttatctgaccacaatgtaatacaactagaaatcaataccaagaggaacagctgaaacaatgcagatgcattgaaatgaaatatgttcccgaatgaccggtgggtgaaggaaataattaataataacatttataaataccttaaacaaattaaaatagacactatatgccaaaacttatgggacacagaaaaaaatattaacaggcaaatttatggtaattaatgcctacatcaaaaaatacaaagatttcaaataaacaacttaacaataaatctcaaagaactagaaaagcaattacaaactgaacccaaaattagaaggaaataaagaataaaaatcggagcagcatgaaacaaaatttggactaaacaatacaaaacatcaatgaaacaaaaagttgttttttaaaagattagcaaaattgacaaattattagctacagtgaaaaacttgaggaacgacccacctaaataaaatcagaaatgaaaaagaagacatcataataaaaaccggagaaatacaaaggatcattagagactactatgacaattatagaccaataaatttgagtacctagaataaatggataaattcttggacacatacaacctactaagattgaaccaagaagaaatagaaaacttgaacagaccagtaacaactaacaagattgaatcagtaataaaaaaatctcccaaaaaagaaaagtccaagactggatggcttcactgctgaattctactgactcttaaaagaagaactaatactaattcttctcaaactattttagaaaactgaagtagagggaactcttcctatctcattctatgatgcaagcataacccagataatgaagtcagacaaggacacaaggaaacaaaagaaaactacaagccaatatccctgataaatatagatgtaaaaatcttcaatagaatactagcaaactgaatccaataatacattaaaaaataccttatgattaaatgagatttatcccaggaatgcaagggtggttccagatttgcaaatcagtaaacatgatatattacatcagcagaataaacaacaaaaataataataaacaacaaaaaacatatgaccatctcaatagatgcagaaaaagcatttgacaaaatttaacaccccttcatgataatttcttcagcaaggaaggagggagggagggagggagggacggaaggaaggaaggaaggaaggaaggaaggaaggaaggaaggaaggaagcaaagtatgtcagggagacagagagagagaagagatgagattaggaataaaaggaaagaacctcaaaatgataaaaggcatatatgacaaacccacagctaacatcatactgaatgaagaaaagctgaaagctatttctttaaaaactggaacaaaacaaggatgtccatgcccaccattcttatttaacatagtagtggaagttctagccagagaattaggcaaggaaaagaaatcaaagcatccaaattggaaaagagaaagtcaaattatccctttttgtagatgataagattttaataatataaaaacctaaagactctaccaaagaaactcatagaactaataaacaatttcaataaagttgcaggatacaagatgaacatacaaaaactcaatagtgtctctgtacatagacaacaaactagctgaagaagaaatcatcaagacaatcccatttacaatagctaaaaaaaaagagaaaaaataccctagggataaacttaatcaaggaagtgaaagatgtctacaaactataaaaacattgatgaaagaaagtgaagagaatgaaagcaaataaagagacctttcatgctcacagaaagaattaatattgttaaaatggccatactgccaaaagcaatctaccaattgaatcaaagccgtaacaaaatgccagaaacaatctttacagaaacagaaaagcccattctaagatttgtatcgaaccacaaaagatccccaaagctagagaaatctcagataaaggggagggaaaagctggaggcatcaaattatcttactttaaaacatactacaaagctgtaataaccaaaacagcatgatattggcattaaaacagatatttaaaccaacagaacataatagagagcccagaaacaaaccatgtatttaaagccaaccgattttcaacaaaggtgtcatgaacacactatggggaaaaggtcatctcttcaagaaatgggtacttggcaaactgagtatccacatgcagaagaatgcaactagactcttaactctcacaatatacaaaaatcatctcaaaactctcacaacatacaaaaataatctcaagatgaattaaaaactaaaacgtaagatcccaagctatcaaaacactaggagaaaacataaatgtttcatgactctggactgggcaagaatttttttgagaagaccttaaaagcacaaacaacaaaagaaaggatagacaaacagaattacaagaaactaaaaacgttatgcacaacaaaaatgcaatcactgagtgaaggcataccctacagaatgggcgaaaatgtttgcaaagtatgcatctaacaagggttaacattcagaatatataagaaacttaacatgaaaaaaatttgattttaaaatgagcaaaagacttgaatagatatttatcaaaagaatacagacaaatgtccaacacacacataaaaaaatgtcactatcactaattatgatggttaatattaagtgtcaactcaattggattgaaggatgcaacgtattgcctctaggtgttgccagaagagattaacatttgtgtcagtggactgggaaagaaaggcccacctgcactgtggatgggtccacatctatccacaatggacccacaatccaatccactgccagtgtggctagaaaaagcaggcagaagaaggtagaagaagctgaattgctgagtcttccagccttcatctttctcccatcctggatgcttcctaccttcgaatatcagactccaagttgttcagcttttggggtctaggacttacaccagtggtttgccagagactctcaggccttcagccaccgactgaaggctgcaatatcatcttccctactttgaggtttggggactcggactgagccactactggcttctttgctcctcaccttgcagacagcctacatgggacttcaccttgtgatcatgtgagtcaattctttttaataaactccctttcgtatatacatatatcctattatgtctgtccccctagagaatcctaatacactaattatcaggttaaggaaaatcaagaccatgataaggtatcacctattggtgacatcttggctgtcaccaaaaagacaaaaggtaggtcttgatgagtatatgtagaaaagggaacccctgcacactgttggttggaatgtaaattagtatagccattatggaaaacagtatgcaggtctctcaaaaaaattaaaaatagaactatcatatgatccagtgatcccactactgcatatatatatgcaaagaaaacaaaaatcagtatttcaaagaagtaatctgcattcccatgtctgtcacagcactattcacaataaccaaggaatggaattaaccggtgtccagtggcagatgatggattaagaaaatatggtgtatatatacacaatggaataatattcagccacaaaaaaagaacaaaatcctgtcctttgcaaaatcatgaatcaatcttacagacatttcgttacatgaaataagccagagaaagacaaatactgcatattctcactcatatgtagaatctaaaaagttcaacctcatagaattaactgaatacaactgtagttaccagagactagagagggtagggggcagtgggagctaggcagaggttagtcactagatagaaagttacaggtacaagtaaaagttctggtgtcatattgcacagtagggtgaccacagtcaacaaaaaaacattgtatatctaaaataactatacgagaggagaggattttgaatgttcctacagcaaagaaatgatagatatttgacgtgcttgatgtgctaattactctaattttaacattacacaatgtatacatgtatggaaacatcacattgtaccctatcaatatacaattagtcaattacaagtaaaataatttttaaaaatatagtataatttaatttatatgtaagaaaggcaataaatatatgaaattagtagagtcagcttcggaccccaatccagagtagataatcaggtagtgccctgcagagaagagagaagacagtggacagctaaccatggtagagtgcagataaaacctatgttagagggagtcaactattgaatggggaaagccactaagaccaagtttgagacttcatagatcaaagcatagctcctgagaaatcaaaaagaaggggattaaaaatgtgtggggctgatggtggcatcttggagaggggcattcttaaggcttgtgaagggaaagaagtaagcagtggggccgggtgcagtggctcaagcctgtaatctcagcactttggaaggctgaggcaggcagatcacgagatcaggagttcaagaccagcctgaccaacatggtgaaaccccatctctactaaaaatacaaaaattagctgggcatgatggcacatgcttataatcccagctactcaggaggctgaggcaggaaaatcacttgaacccgggaggcagaggttgcagtgatccaacatcatgccattgcactccagcctgggcaacagagcaagactccatcccccaccccgccccccaccaaaaaaaaaacaagcagtggaaatgtggaaatatagaaagaaaagagaattgcaaaattagaagacatgttatcaatttctttcctcatcaccccaaaaaaatacacgaaagattttaccacccccaaagaagagggtgctattaactaagacatctagaaaacaacaaaaacttcagaataacagacagaaaaatcttgtattggtagtccaggaaaatataagacattcaaaataagtaacaatggcaaaagccatccctacaaggctactaaagggaaaaaaattaaaaacattttagctgataaaaatgccctaaaataaacccaaagcagagaaaatctgcattacaatatcccaactggaattatctatctttaaacaactgtttggagatatttcaaaagattttgaaccacatatttaaatctttcaatataaatggattaaaaagggaagctatgaaatgagagtcaattaaattcaaaacaaactgaaaacaaactgaaaattatctcagaaatgaaagctaaatttaattacaatgtatgtaagagaatagatacaactttaaatatactaaggagaactgagaaatgaaaatatccaaggaaacaaaaacactataacaaagaaaatgatttcttaaaaaagaattatagagtgataaataagtagataaacaacaatccatcaaattattggagtccctaaagttcctaaatacaaatgttacatattctgaaaatgtagagataacacaatttttaaaaagagaagagaagggaaagagaaaaaggaacatggaataagcacagtgattgccctaaatgtgtgatgttggaatcaaaatatattcccttgaagcagaaaaactaaaaaaaccaaatcaggctcaaataagaaaacatataatgaaagtatcatttttaaaaaatgagtataaaagtaacaactggaacaaatatgttcaaatctgccaatacaataaaagaaatttaaaagaggaaaacacatacctcatagaggaaaaaatacagtaaatataggatcaattaatacaaagagaagcataacattaaaaaaatgacaaagctgggaccacacttaacaagccataacaataattgtaaacgggcttagcccacctacttttttgtttaaagactttcagattgattctcaagcaaaatacaagtctacactgtatgcaagacatgaagatacacctaaaacaaaatacagaaagattatgaataaaaggcaatacatggacaaacatatgtgaagcaaatgcaaacactgagaaaacaggatttgcaatactgatatcaggcatacagggcaattcatgccaaaaaatttaaacaaaaaagagtgctttgtaacactaagaagaacaatttacaataaaagtatcatttatgaatctatacaccaaaatcccacagca

SEQ ID NO: 20 - DNA, 1153731 bp, Homo sapiens
tgctctatgatctccatttgctttttcacttatctaacatctggtcaattgaatttgctttgttaaaatttggtcagttcttctttattcttgactggaacctgaataatatagaaatggataataagaatagtttcatgaacaaacccttaaagataggaattatagattggtttgtctatgtctttgggattcaatgcagtgttgtactccttgataaaggtaggcagggctggaaggctagtaacccatagcatttagtgaaatgataattagttaaatgatcatcctggctgtttgtgattcagtgacctcgtgtgattcagtgaccttgtgccataatggcacaaaggatgataacaaggattttggtgtggaataactgcttctgagtgttgcggagtgcttaaagaaagaaatcacaagcacaggccatagttaaggaaccaaaagacttttgtggttgccccccaaaagaatgtcttattcttgtagccacagggttaaattaaataatccagacacagagattaattgtgaaagtcacaaaatttcagtttacattggatttgcagctttgccaagtatctcatgtgaaagggcatttattgaaaagtactggggctataaaattaagcttgggagtattgattggactgagataaggctgaaaatcttgaattttccatttattttgaacccttttcttctaatagaaacaacctattttcttgtgtctgaagagtttatatctctttcttgaagacattataataactgcctggagaagagggtgtcttacaggagaatgcctattcttctaattcccaccatataaacacccttattgccactagggtcataaattagaattctagagtcacatcttagaatcctttaggagaacaagcacaaattataatccagaagaaaatagctaatattctaaacagtttccaagattttgttaatttaaaccagcagaaacctgggaaatatatatgagaatggatttttttttttgagatggaatctcgttctgttgccctgttgccaggctggagtgcagtggcaagatctcagctcactgcaaactctgcctcccaggttcaagtgattcccctgcctcagcctcccaagtagctgggactacaggagcacaccaccacacctggctaattttttgtattttagtagagacggggtttcaccacgttggtcagtatggtctcgatctcttgacctcgtgatccacctacctcagactcccaaagtgctaggattacaggcatgagccaccgcaccttgctgggaatggattttaacagtgtctttggtagccccttaaagataaagcaaggtagaatatacagtagaatgaatatttctgtccccctcccaaaaattcataaagtcatatgttgaaaagcctaagtcctaggaaatgggttttggagatatgggattggggagttaatgaggtcatgaggctagagcccttatgattggattagtgcccttatgagaggagacataatagagcactagctctccttctctctctagaccctgtgaagctacagtgagaaggtggctgtctacaaggcaggaagcaggccctccctcaccagacatctgatcttggacttcccagcctccagaactataagaaataaatggaactttttaaagctacctagtccatgtgttttcattatagtagcccaaactgactaagacagaatataatccttgattagtccaagtattttgatgcatgcacatttatcacaaatactagacttaactttcactactctagaagagctgacaagtttcgttggttgattaaaactagaatttaatggtttccctcgtttaatgtgattgagatgcccaacttccctgaaataacataaaggaaagaattcaaagtttcaggaagatggaaatgtggaatataattagtatttgaggcttggatattcatcatccccccacgacatcccttaagagtgcccagaagacaattggtttactaaggcattgagatatacattagtaataagagtactagtgtccttgataagctctgtgatcactttcctatctaggctgcaaagagaaagaactccctgatgtcaaaggagatgataggatcccagaagaacaaaagacaattggcagcacataactaccttggacgaggtgggaatatttaccataatgagctgcaaagatgtggtggaaatcagagtatttggacctatagggaaattttgaggattgctaattgatgaaaatgctctaggaataaatggttggcctagtagatattacttgcgcaatgtaaaacaagcaagcaagctagcaaacaaacaaacaaaacttctaattctggtgggttaattgctatcattgagaatcatggacactcacctagtttttctaccacagttagttcacagatctgcagccacttgtttaatggaggaatctcttctccctaaggatgggacctaccgtgtagccacaagtatatacgtaaatattcctccaccttcccaaagggtatgagtgctttaacaaaggaaatagaaatatttcctttgtcaaatattcctctatatagaaatacagagcatttatcatgctcaatagatattatatttgatctgtgtattgatgcattctcccactaccataaagaaatacctgaaactgggtaatttataaagaaaagaggtttaattggttcatgaatccacaggctctaattgaagcgtggtagggaaggcctcaggaaacttacaatcatggcagaaggtgaaggggaagcagatacctcttacctggcaggaaaaggaggaaagggtcagagggaggtgctacacgcttttaaataacaaccagatcttgtgagaactcacttgctgtcatgagaacagcaagggggaaatatgcccccatgatccaatcacctccctcaaggcccctcctccgacattggggattataatttgacatgagatttgggtgggacacagacacaaacaatttcaaactgacaataattcctaggaatccataatatgacagtggtcttcaagttaattagaggccaatggagtttaggcaatagatggagttttggtatgtgtttgaattacagtagattcagtagtttcatccataccctgtgtatattggtatatttcctcagttgtctaatgaggaattctaacagacagacttttaaaatgtcagaaggcacacattgtctctctgacccatagattgactgctattgtgaaaggaaaagccaagtggaagcccctggaatttctcttctcctaccataataacaaaggaaaaaccacaccatatccttataggattgcaaaggttagtgctaccaccaaaaccttgaaatatttgtaagtgctgatacctattgtacctcatttagtattcctatttagcctatgataaagggagatggaactttaagaacaaatgtgagtatcatacacataattaggtcgcaactataatggtagctgctgctgcagatatggcaaggtgactcgagaagaaaatcagtacagccgctggcaactataacacgtcttcagctagaacatgcttttattctctatctcactttgcaagatctatccatcagaggtagttcaattttaccccatgattcatcctcacaaacttgcttcctggcaacatcaaatcttttgctgtcactcataggctgcagaaatcttgaatgccttaagaatggccactatgctgagggtattgtgccgatcagatcagatgagcagaaaatatcaattacttcagttgctttagtaagacacctgccagccagattgtgggagatgaactttatgaaatttcagtgacacaccacctttgggcaatttcttaatgtctgatggtctgaagtttgttgagatatccccttcaaggtgcaagacaagttgcttcatcatgcactgttactattaaacgggaggcacatttaatagtaactggtggggctgtttaaatcttgcaggcagtttagatacattttagtgtactattctaactctttttactgagaaatccattgggatagagagacatcagctgtccagtactctcccctccatggtttgagtttcagctccacaaaacttgaccttcaagctccttagctactgctctaggaatagttccttatcagcggtcccagtcctggctctgaagtggtcccagtcctggtcccagtccaggctcttcacctggctctgaaggagctcctctaagtttttggggtaccagtaccagacaaacaacagacccttctcaaagacctgagtgcccagctttctgtagctacttctagcctgtacacttaataagcccaactccttcccttcgtccacccagtttcaggggtagtaactgtttcctctgccgctgtgatacctccaattcctatttttctgttttttcagttctctcataccaggtaacaatacattctattgaattcttgccattaaaatagaaggttttgtgtccaccttctggctggaaactgactgatacttaaatggaaatatgtttgtgaaattgactttgctaatgtttcctgaccatctagtactgagaaattgaaggaggaaaatgtttccaaagaacaaagtgggatgattttctattcagagaattaaaataaacaaacaactaatagtgatactacatgtacaaaagtctctcacttaacatcttagattatgtaactacaattttcatagacaaacaatggcttagttaatttacatttttatttggttctatgttttgctctaaagttcccttaaaccattcctaaatttagaaatataaacatttattctccagaattttgacacagctgggtctcctttctcccttgcatctgtgacttcaaattcttttaacaaataaacaataatattttcatcatctgaattgtcctcttgtagcttccaggctagaaaaataaaatgtgatagtgaatgcatttggttttatggtttagactatctctcagaaggtcttacgttttattcaatcttaggatgtttcagattttgggggttgatgatggtgattggtagttggtcaaaaaattttaattagatccagaggggattttggcatgtctttgtggtataatgttagaattattgtttgtttagtgctctcgatactgcgatttataaaatatgaggatatacttggtttcctagttttcagcttccctagtttttcccatggttctcttgcctgcttctcatgggaaggagatgctgccatccactgaaagatgtgaagtcagcagagacttagcatttcccaagaccttcttgcagacttgagcccccatgcggaggagacttctctacttctagcaccaaaagttctggcaataattttgggaaggcacccagagaatgcaggggatataattatcacactggggaccacctgcttcatggagttaccattttaaagagaaaggtgtgtaatgagacacaaaatttccttaaaaaaagtggggagggtgttgctcagaaaacgctactctttccagatttgcttttaaaggaaaaaggaaaatgatttcataaaaaatgaaaacatcactttcaaaaaagaaaaagggaagtgttacagagcaatctcaatggggacaaaatctaagtagtctaggagaatcattttatgtacttttcacacatcatttatttttaattcaatttattggaagtgtgtcagtgtctgagaagcttcgactactttagcacaatgaagggtgaaaggagctgaattcgaaggtggattggagttacttaaactattgggaacgcgtgctttctcttacataagacagaatacacagtgaccaatggcaagaaatgttctccacagcacttaggataacaggatttggtggttcaatgtttaaatgttaaagtcagacagacaaagttcaaaattttagcacaaattctccaaaagtggttcccattcaacatttttcaagttcatagtttgttaagatgactgtcaagactttggtaacaagatgttagcataagacctatcttgatctaacactaggcaaccactcttacataaaagcctgtgtttactgcactataataacatgctccacactaaaaagaatggtgaactcaactttctgcttctgggatccaaaagaaaaaaaattcccttgttataactctagtttatttatctggaaagtggagattataatattgcctttactataaaattatgtgtgaattaatagtgatcattctcttaattcatgatgtactaagtgtgtcatgcctggtttagagtaaaggttcaataaacattagctgtcactgttattattttaagagaaaacatgtacctaaaccttttttgttgttgctgagatgacaacaacagcttgtctcccaagctggagtgcagtggcatgatcaacgttcacttcaccctcgaccttctgggctcgggcaatcctcccacctcagcctctcaagtagctgggactacaggtgtgtgccaccacgctcagctaatttctgtgttttttgtagagatgggtttcaccatattgcccaggctggtctcaaactcctgggcttaagcaatccccccaaagtgttggggttacaggcatgagccattgagcctggcccctaatcaaaataggaaataagaatgccagactgggataggagcacaggcaaattttgctggggaggtgaaaatataggcatttttaaaaattcttcaatttcacacctaaagtttttgaatttcactgtatgaatgttttaccagaaacgggggtggggtaagaaccataaacattgaactctagttagtatgtttgtttttgtcaatggcgtgtttgctgttgtgaggctaccttcatgtattgtaggactgaggaagtgaatatggaaagtaagaggagccacagttctcattgttggaaaagggagttacaaatataaaatgggagaataccacaatatactgtattgtgttgaattagaattgaaaatatcaatataaatatactgacacttccaattatacacacacatactgtagtccccctcttactcgcagtttggctttctgaggtttcagttacctgttgtcaatcacagtccaaaaatattaaatgaaaaattttagaaataaacaattcataagttttaaattgcatgccattctaagcagtctgatgaagtttcatgacagtcactccatcctgcccaggacttgagtcatccatttatccagtgtatccacgctgtctacactatttgcccagtagtcacttagtcacttagttgccatcttggttatcgaatcatggtcatagaatcacagttcttgttttcaaagaaaccttattttacttaataatagccccaaagcacaagaataatgatgctggcatagtgttataattattctattttattttagttattgctgttaatctcttactatgcctaatgtataaatttaacattatcataggtatgtatgaataggaaaaaacatagtacatagtacctacagcttagtactattcactatttcaggtatccagtgagggtcttggagtgtatatcccatgaataaggggggattactgcacgcgcacacacacacacggatatccagtggagtctgccccagcatgagcccagaatgccagtcgtgatccttctgcaactttcctgcctcagccttttaataaccattctgcagctctctagaaatagaagcaaaaccacctgtgaagttgcctgctagcagcctacctgtgacctgggtggtcccacagatctgcaagcccccatggcctgcatgctctgatgacctcctacctctgtcagctctctacagaatggtgtctattgcttgcccacctactccaaaccagctctagcttggccaaaccagcaaacttttctgctgtctggtgggctgaaccacagaaggggcctgaactccttttgattttgtgcttccttggctaccctccctcagccctaagataccatagaatgtttctttatatcttataattgctctttcattgcagttaataatgctttatgttaagcttctcctatttaatcccctggtgcctctgtctcttggttaaactcacactgctacatgaccacataactaacataatcattattagaactaatttgcattttgtgttctttgatatgctgtgctaagacagacaaagaatgtcttccaccatatttctgtgaaagctatatagcctgaactttatcaccagaaaacactggacaaccaagttgaggagcaaactaaaaaatgattgatttgtactgtttaaaaatgtcaaagtcaaggaagaattagaaagattaagaaattttatggattaaagaaaactaaagaaactcaactggcatctatacacaattcttaatccttcattagatcttgtacctggtgaaaatatttataaaagatgatattgggccatttgacataatttgaatatcatcttttgaattagataagaatattgtatgacgttacgctgatcattagagaaatgcaaaatcaaaaccatgatgagatatcatctcacgccagtcagaatggcaattattaagaagtcaagaaataacagatgctggcaaggttgcagaggaaaaggaatgcttttaaactgttggggggaatgtaaattagttcaacaattatagaagacagtgtggtgattcctcaaaggtttggaatcagaaataacatttgacccagcaatcctattactgggtatatatgcaaaggaatataaatcatcctataataaagacacatatacacgtatgttctttgaagcactgtttacaatagaaatgacatggattaaccgaaatgcccatcaatgagagactagataaagaaaatatggtacataaacaccatggaatattatgcagcaataaaaagaaacaagatcatatcctttgcagggatgtggatgaaactgacagccattatcctcagcaaactaacacaggaacagaaaaccaaacactacatgttctcacttatatgtgggagctgaacaatcagaacacagggacatagggaggagaacaacgcacacaggcctgtcggaggagggtagggggtggcggggaagggcattaggaaaaagagctgacgtatgccgggcttaatatctaggtgatgggttgataggtgcagtaaaccaccatgaaagatatttacctatgtatcaaacttgcatattcttcatgtgtaccccgaaacttgaaaaatttttaaaaatatttatcatgttagatttcctgattttgaaaattataccgtgataatgtaagagaatgtccttcttcttgggaaatatatattgcataattttggataaaggggcataatatttccaatttgccctcaagtagttctggagaaatatgtgtgtgcatacccacatgcacacagatagaacaaatttgtcaatatgttaaaaactggataatttagattaaatgtatataaatatttcttgcattattctttcaagcatcctaagttagaaattacatcaaaatttctaatattttaaaaaagatatgtgagtccagagtctggcatgatgtaagtctcaaaccacttaacctcccactgcctctgctggagggtgtctctgcattctgcctccaaagggagtaatatcttcactagacactagacttggccctactcctgctttttaaaatcccctatgcctttctctctttgctacctggaataacattctcccttccctctgatggcctaaatccttatttccaaagccaaactctggctaatattactgacattagttaaagaggtctccctaaatttttagtttagatcacactggtttctcttccctaaaaatgcattatgctttctacttcatgtcatcaaataatagctctaaaatattttggaagtgcttttatctcctttcttttggaagggctaatgcttcactacataatgtagtggagtttgctggttattatttttatttttactttttttttgagacagagttttgctcttgttgcccaagctggagtgcagtggcgtgatctcggctgaccgcaacctctgcccccagggttcaagcgattctcctgcctcagcctcccgagtacctgggattacaggcatgtgccaccatgcccagctaattttttgtttttagtagagacagggtttctccatgttggtcaggctggtctcgaactcctgacctcaggtgatccgcctgcctcagcctcccaaagtgctgggattacaggcatgagccaccacgcccagcctagttcgtcagttttttgaattgcctctctcagctacacaattcattatcttattaccttgtggacgttgcctaacctctccgtgcctcagttcagtctatacaatgggaataacaatagaaccatactcatagtgttattggaggatgaaaaaggttgatttatgatgtaatgtacaaaaagcactgagaacagtgccctcatgtagtaaatgcaacttatttttttaaaagagccattacaaggcctaatgcagggaaaagatatttattacacccttgttaacaggttgattgacttatatagtctttattttcctccatattgtgaaatttttaagtccatatcacaacccctttatattagttcttcatagcaactattattctagacataaagattttcttatgaaagtaataaaacaagccaaccatcaaccaatcaactaataagagcaagcccccctcctcgtacggttactgtaagaagtgttacagtgttactgtaagaacaaaacactaactgctaaaaaacaaaaaaagaagaagaaatgaatagagaaatccattatacacagtaattgacgctcattgttatttttggctcttttcacacattttaacgcttgggattgaaatcatttcagctaaaaagcttctctgagttgagaagcttggattgatattgactgcttgcttggcagcaaggagacctgacccagctttaaaacgagggagcttattttcccaccgagtcaaggtaatgtgggaggacactgcctcgagtttagggatctcagggactctcctgaaatttgtgaaaattaaatcaatatatggaacatttataacatgctgcactaaattcttctgggcccaaatctctgtctttaagtcccttaaccgtataatatgtgtggattactgttatagagggcaacatgacctaattaataagaagcaaaaggatttgcagattcacaggaaacaaccgtcagagccacctgaggaatagtgctcagcaaaaactcgacagatgtgctgttgtaggaagcatgaccttgaagtttgggtgggatttcaactctgaagaaaagggtgaggaaatactaatgagttgtgtttggattcacgaatacgttagaactggcaaacaatgagacaccatcctcaggcggtagtctgttcagtttaattagaaagacagaaattaatagtagtagactcaaatatttaattagaatgcctttggtacagagagagtactcctaactaaattataatacaaacattcatctcataaaccatgaaaaagtgattaaaatcaccagtaggtaaaagccttatttatcaacctatataacataacagacagttctgtagcatgagctaggagtttagaactccactgagtcaccattggtattgattccccagatggtaagcgaatgggccattctttctttacaaaataatgcctttggcttatgctcaataaatcatatactctgagattcattccgcaggggtggtagcactcagccagctggtcctcttgtgacaatgacccatattcacataatggtcatcgtagtaggaagtctggagcacaacaacaacgtgaaactggccagcccatgaggtcatggggctgcccaccagatggcctctgagctccagtctccagctgaagctgaatgaagtaattaatgaccactgacatgagcatcacactttcaaatctctggcaacataatgatgacctttttctccattatctttttcattgttattttctctgaaaagataatacctctgaaggccaaaaggccagaacaagaggtcaggttggcaaggataaacgtggaattgattagaaatgggctcttcctttaggattggaaatgacaatttagcatgatggttggcacacattaagagataagtaaatgagcccatattaaaattattatagtcatttgcttaatatttccctcttctgactatacagttctactgcctttcttgttttgtaccatggtcttcacaaatttccatattggttttgaaacccagaacattgattttgaaatctaaactgattatgtctcccctctgcttagtctccttcaaggatttcccacaattcttataataaagaccctatagcatggagttacaagcatgatctcatgtctcccttcttctgtaaccttatctcatcatatttcctgtaagtctttttgctctagttccacgaaaagaggtttctttcagctgctggtaacttcccacataggcctttgcacgtgcagttcttgatgcttggaatgcctagctcctctcttctttaccttatcacctactcatcctgcagatctcagctgaagtacattttctcagaaaagttctctctgaccttcctgataagctgtcataaacactcacattatcagatgcttttctttctcagcatttatcacagctgtaagtgcccatttatttccatgatgatttactaatgtccacttttcccactagactatatgctccatgagggcaggaaaaatgtcatctttttcagtattgcatcccagaacttggcaccatattttgtacacagtggttttcacaaataatgttctgttcattaaataaatatttattgagcaccacagagctagattcatgacaattgcttaaaatgaaaagagaaaagaaagaataatggtcatggaaccataacatacaatcaatataatatataaaaggaaatgtataaaggataaaagttaccacaacaagttcagtcttctgcaatggaaagttttcttgtatgactcatttgtgtgtgtgtcccttttgtcataagcttctggtttcctagggacaacacactcatgcataaagccaggactacttttgagacaccaaatcagtagtaaagacttgtttagagctctgggtaaatcagcttattgaaaataattttataaatatttaagataattttatatatatagttttgaaagttcacttaaaagtatctatttaaattatgtgtcatggagtaaaaatatctggtaaagaatagctaaatcatcttatctgcatagaaatgatagatcagcaccataaaacagggttagaaaagaaaaaaaaaaaagaaatgatagaaccaagacactgactattggctgaaagataattttacaggctaagctcatttatgtcactttagaagtgtctagaaaacatcatttttcagaataaaaaataataatttccaaataaaaaaactaacttttaaggaaaggtttgttttcacttatgcttgaaagcatctgtttgagtgtttgtatccataatttactgaactgtggaacaaatatactatatgacatctgcctgaggcattggattgtaaatatttcatggctttataaatgtaccacgattaagtatgttttagtagtcaactgaataatgttttacagcatcaaaatgaaaaagtttctcttttttgtctttacctgggagctttgaaaatatatcacaaagttcattttatttctgatatattaggacaaaaaccaaagttcccccggtaattccaaagacagaaggaaaagagtcctgagtctgggtccacaattctcccttttttttccttttctttttttttttttttttgggagaaaatgctttgaaaaattctaattacaaattttccgctagaccacaaatttgttcttatatctgtggtatgcataataatatcccaaaagtgtccacatcctaacccctagacatgtaaatatatcattttacatggcaaagagactttgcaaatatgatttaaagatcttgagacgggaggtgaccatggaattagggatcataattagagggagaggttggaagatgatacgctacaggcttgaaaatggaggaagaggccacatgctaatgaatgcaggcaagttctagaagctggaaaaggaaaggaaagggattgccctttagtagtaccttaagaaggaatgcagccctgccaacacctcaattttcatccagtaaaatccatttcagacttctgacctccaggactataaggactataagatattgtttgctttcttttaagccactaagtctgtggtaatcaatgacaaccataataggaaactaatatactatgaaatgacatatatttgatactcagagtattaaatacattaatattgagtgaaataaattaaatgttaagtgggcctcaaaccaatcaatgaaacaaataaaattgaaaacattttttaacacattatctttcaatgtctttggtagtcaaacatatctaatcagaccatcccttgggttttctgaaaacctggaacaatagacaaatttgctttgaacccctaattccatgtcctgttgaagaccaaaactttctagccctgaaataatacagcatttaataggagtgataaggcaagttcaggaatggttataatacagcagaaaaatagtatggccacagatttttagagcggggtgggggagaagaggggagagggagatggagagagagagagagagagagagagagagtaaccagttgagagaaccagggtttgcttgttaaaaagatagcaattttagttatgtaaaggtgaacacctttataggcaaaggaaacagcgtgagtgaaaatgtgatgttaggaaataatgaggcagaaacagagaaaatttgcagttgtgagggaagaatgtaattggtagtttgacaggaatagcattgaatctgtagattgctttgggtaatatggccattttaacaatattgattcttcctatccatgagcatgggatgtttttctatttgcttgtattgtctttgttttcttttagcagtattttgtagttctcattggagggatctttcacctccctggttagctgtatttctaggtgttttaatttttttgtggctattgtgaatgggattgtgtttatgatttggcaatcagcttggacattattggtgtatagaaatgccactgaattctgtacattgcttttgcatcctgaaacttggctgaagctgtttctcagatctaggaggctttgagcagagaagatggagttttctaggtatagaagcacatcatctgcaaagagtgatagtctgacttcctctctttctatctgaatgctttttatttctcttgtctgattgctctggttaggtctactagaactatgttaaatagaagtggtgatagtggacatccttaccttgttctagttttcaagggtagggcaatgtttccagctattgcccattcaatatgatgttgggtttgtcatagatggctcttaaaattttgatgcctagcttgttgaagatttttaacatgaagggatgttgaattttacccaaagatttttttggatctattgagatgatcatgtgtttttttgtctttcattctgtttatgtgacaaatcatatttattgatttgcttatgttgagccaaacttgtatcccaggaacaacgcctacttgattgtggtggattagctttttgatgtgcttctggaatcagtttgctaatattttgctgaatatttttgaatctaagttcatcaagaatattaagctgtcatcttctttttcttgtgtctctgccaggttttggtatcagaatgatgctggcctcatagaataagttagggatgagtccctcctcctcaatttttttttgtaatagttttagtaggattggtaccagctcttttttacacaccttgtagaatttttctgtgaatctatctgctcaagggctttttctggttggtaagatttttattagattaaatttcaggactcaacattgatctgttcaaggtttcaatttcttgctggttaaacctttggaggttgtatgtttccaggaatttatccatttcttttatattttccagtttgtgtgcatagaagtgtttgtaatagactctgagggttttgttttgtttgtatacctgtaggatcagtggtaatggcccctttgtcatttctgattgtcttcatttggatcttctctctttttttctttattattcttgttagtgctctatcaatcttatttattctttcagataaacaacttttggttgcattgatcttttgaatggtttttatgtcttgatttaattcagttcggttctgattttggttatttcttgtgttctgctagctttggggctgctttgcttttgtttttctagttcctctgggtgtaatgataggttgttaatttgagacctttctaactttttgatatgggcatttagtgctataaattttccccttaacactgctttttgctgtgtcccagacacagtgttgagtttaggtcctgaatgtttctttagttttcttccttgatgatctgtccaatattgtcagtggaatgttgaagtctccccgctattattgtgtggttatctaattctttttgtaagtctctaaaaatttgttttatgaacctaggtgctccagtgttagatgcatatatatttaggaaagttaagttttcttattgaattcaaccctttaacattatgtaatttccttgtttgtcctttttgatcattgttgatttaaggtctgttttgtgtgcaattaaaatagccatcagtcctttatttgattttccatttgcttggtagatttttctctatccctttactgtgagcctattggtgacattgcaagtgagatgggtccctttaaaacagtgttgggtctagcttccttaaccaacttgccactctctgtcttttaagtgggcattttttagcccatttacattcagggttaatattgatatgtgcagatttgatcctgttataatttttttagctggttattatgtagacttcattgtccagtcgccttagagtgtcaatattctatgtgcttaagtgtgttactgtggtggctggtaacagtctttcatttccatgtttagcactcctttaaggacctctttaaggtagggctggtggtaatgaattcccttaatatttgcttatctgaaattgattttatctatccttcacttatgaagcttagtttggctgaatataaaattcctgattggaatgtatttccttcaagaatgctgagccagacatggtggctcatgcctataatcccagtgctttgggaggccgaggcaggtgaatcagttaggtcaggaatttgagatcagcctggccaacatggtgaaaccctgttctactaaaaatacaaaaaaaaattaacctggtatggtggcatatgcctataatcctggctacttggcaggctgcagcatgagaatcgcttgaacctggaaggcagaggttgcagtgagccatgccactgcattccagcctgggcgacagagtgagactccatctcagaaaaaaaaaaaaaaatagaaaagaatggtgaatataggcctccaacgtcttctggcttgtagagattctgctgaaaggcacactgttagcttgatggggttcctgttgtatgtggcctgcctgttttctctggctgcctttaatatttttttcttttatattgtctttagagagtctgatgactatgtgtcttgggaatggtcttcttatatagtattttactccctctctttcagggacaccaatgagctgtaggtttggtttctttacataatcccatatcttttggaggttttgttcattcttttttatacttttttctttacttttatctgactgagttgatttgaggaactggtctttgagctctgaggttctttccttagctaggtctattttgctgataatatttctgatggtacactaaaattcctgtagtgagtttttcagttctatcaatcagtttggttctttctcaaaatggctattttgtctttcatctcttgtatcattttactatattccttagattctttcgattgggtttcaactttctcttgaatctcagtgatcttcattgacaaccagattctgaattctaagtctgtcatttcagccatttgacctggtgaaaaaccattactgaggagctagcgcggtcatttgcaggaaagaagacactctagctttttgagttgccagttcttgtgctggttctttctcatctatgtgggctgacggttctttaattttggaagttgctgtcttttggatggggcttgttgctatgatattctctgaggtccttgagggtttgattgtggtattagttgggttcagtcgactggcttcatttctggatgatttctggggtcccaggttcagctcaccactcctgggcttcatgctctaacactggggtgctgggaccaggcttgtcctctggccctcgaggttaagcaccagctgcactggaatgtctgaggtgttcctggtctactgacaacaaactctgatgggggagtgccagcaaaaacatttcactgggggcagaggcagtgaggtccacatttgaacgtgtgtgccagtagcagccgggtggtggtgtggctgggtctatgtgagcatgtgtgccagcagcagggcaacggcactggggggttcatgtgcttgccttgctggtagtggggcagtggagtctgtgtgtgtgtgagcactcccaggtgtggggctgtggtggcggagtctgcacatgaaagcacaccggcaaattgatgggggtaggctgtgatgagtgcacatcagcaacaatgtgggagtacgctacgggcaagttgcagcggaaaggcatttgggggaagctgtgggcaggtaaatgtcagtagggacccatctgctaaagctgtctgatatttaggtgggatctgccactgaaggagctatgatggcagcttccaggaagtgtccccaatggaattcaaagttgtactgcaagtgggcgtgaccaaggagggggcccagaagaggatggcagacagtggggtcctcagattagactggccccatcccatgtgcaaaacagcactgcactgtccaggtctgacagtcaataaaggccaaagacacatagaagttcatggtgggctttgggggatgggtgtccctggctgtgctccactgcagcccttcctacacaaaacattctgggctccacacaggatggtgtgctgtctctgtcacttcttcaagtacctctccccgccagctcaattatccatgggggttgtggagtctccttcggctaggattctggaggtccatggtgagaatgggccactccctgcctacttaactcaccctttccacaggagccactgacggctaggaatgagtcctggtacttggcagctctgtgcagggctcccagcttccccactccccttcagcccagggtttgtgtcctccctccatccactctcaatgtcttccttccaaagatctgctcacagtgtgccagtcttcttgatgggctggtctctcagtgggagttgctcttcctggctgcatctagtcagccatcttggctcctgaggctcatgtttaatttttgcatatattatttctagcttcagtttgtcttaaagaaagtaaagtttaagtagttacatattttgaaatgtcttatgtgactacataaatattcataatattcatttcctccccacacaatataatgacagaattatttgcttaaaagactttggtagttccctttggctgattttttttgttgacccacaattatccatcctctccttgttaaaaataaggcttttatctaacatggggcccttccaccaaagacttcatttccctttctcccctatacttcggtgtcaccaggagactaacggatctattactcagatttatttgaatgatcaatgaaagaaaaaaaatcatatattttcttcattgaatggcagtgtgagaggaaagaaaaggcacatgactttaagtcatgagggctggaactatatttaacaacttttagccagttatgggtcatttgtctaggctagcttcagtttactgaattatacaattgggataatagtatctgctcttcatccctctccagttgtgagtggtcaactggtgtagtcaagtatttcacaaggattgctgatattggccaccaataaatatttaagccagaaaggacttttagaaattcagtgctgtcatttcacaggtcaaaaaaaaaaaaaacaaacaaacaataacaacaacaactacaaacggaatgcacccaaactaaaccaaaaatctctgaggtccagggagttgaatgacttgtccaaagtcacatgatccttagaagctgggtcagaaaaaaagccttttgatctctgacactgggcctgggaattttcaattacaccaccctcagcccatattctgaggctcaatgcaaacctttgttctttctcctcttattgggaaacaaacaacagcaaaaactgtacctctgagtcattcattgagccagttgagttcatatttatctccagagcctggctgctttgtgacctttcctgtattccattttttaggcacaagaaggaaagcagtcctccccagatccactggttcacataattgagaagtctcttatttgtattcctgtcaatgtcaattgaatgcaggaaagcctgtgtttaggataataactggtctgaagtttatgaaacaagattgataccagcttcataaaactcaggcaaaagcagtatcttttctacatcttgctatgcctttcattctaggaacctttatacttggtgactactgaaaaatgtaattagtaaaaataaaggcaaaaataaaaataacaattgaaaatatcttctaagggccataatttttgctaatgttctgaacttctttattgatttaatgacaagggaggatatacttactactttctctagttccaagtttattttctcttttttaaagaaagtgaaaacttctgagtatgtgcttaaatgtcaacatgtttaaaaatcacctagcttgtttatgcattggatatttggacagctaaaatgcatggccccagctaaatcctcaaagttagggttgttagaaagacataatttttgtgaaatgcaaacttctggaaaataagtcaattatacaactttctagaagtctatcccacttcatctattcatttttgctcataaataccaaaagcttgtgacaaatgtagggatttggtatttaaagatattctcatctctcatgatttggtaccactcacacttggccttttctttcacctctctagttcacaagcatgatacattaatcaaattaacaagtcattatttccaacacacatactttcacttttcttaactattgagagcctactgtgtgtgaagtccaattttaggctttttagctgagaaataacaccatttgatttatctttgttaaattttactccagattaacaaaaatgtattgatggcctgttgtgatctagcctgcatgacagtcacttgggagcaagatagtaattaatggcccttgcctctgaagagcttacagcctagttgaagatttgacatggcaaatattatgatggcagcaagcagtaatgggttgggagacagactaacaagagatagtttcctagaggacatagccctgggatgactcttagagaatgacgggcttaaaaaaatgattaatggcattgaaagttgaaacaggtcaaagagggtaaagaaccaatcagacttcagtattcctcggtggaatgcaaaagtttgtagactttctcctttctcaaatgtcttcaaccttcaatcttgagttctcatgtacatattcttcatgctccattctttattaaaatacttgatcaaaatgctgactactccaagaagcatttactgatgcccaaagaaaaaacttatttatgtttctaattgtgtatctaattgcctttaaatagactggaagacttttccattggcatctatacctattttatatgtcttcattgtattttgcaatgtgcacgtagccaaaaaaattttcatagccaattcaatttattcatataaactcaaacaccgtttcaacaagttctgcctcacagacattcttctacatttattaggttgccataacttctatttgttacacacctttattgctgaccacttttggagtaaccaatgtcacaacttccctttatttacacttgcatgcctattattttgtacctatagtcttagacctgacagtatccaaattcatcgataattttcaagtttggttgaatgttaaaataaaaatgagaccactggccgggcactgtggctcatgcctgtaatcttagcactttggcaggtcaaagcaggcagattgcctgagctctgggagttcgagaccagcctgggcaacacggcaactcccccatctactaaaaatacaaaaaattaggtattttgtatggtatagtggcatgtgcctgtagtcctggctactcgggaggctgaggcatgagaatcgcttgaacctgggagatggagggtgaagtgagccgtaagccaagattgcaccacttcactccagcctgggtgacagagcaagactctgtctctaaaaacaaacaaacaaaacaaacaaaaaaaacaaaatgagaccactgaaatgtagaggaaaaacaatcatcttttatatacatagtgttggctgaattagatatccatatagaaaaaaaaaagtatctttgatcctttcttcataacctattcaaaaattagacttattataaggcctaaatatgaaaaataaatttaaatcttctagatgaaaacatgggggaataacaaaaatgttgaagtaggcaaaatttcttaagcataacaccacaagcacgaatcatagaataaaagatttatgatttggatattgaggtggacatagaaatgtgatacccagataccacttgaaggaaaaagttgttgcccagctgctgggaggactgtcagtagacagcattcagccatcatctcactttagggattgcctttggggcagtgagtcagttttttcaaggcagtgtttttccagagacagctatgaccagaaactgattgagagacaggtataaatttctgccattttcgcccagtgcaggacaattctaagaggttatatatgctccagagctttctttgcatagctgagactaatgggcctgcatcattgcccaacttctccctttctcatttcttcttgtgagtcttgatccaaagggtggtctctataaccattaggatcaccagactctctaaaatacctcttgtctggagagtccaaactgcattagaagtcattcaaattaagaacttatgttcttcaacatattaagagagtaaaaaggcaaattactgcctgggaggttatttgcaacacatatggctgggtgcagtagctcacacctgtaacccagcactttcagaggccaagttgggaggttaacttgaggccaggagttagagacaaggctgggcaacagagcgagatcccatctctacaaaaaaaggaatttaaaaactatccagacatgctggtgtacacctgtagttctagctactcaggaggctgaggcaggaggatctcttgagcccagaagtttgagattgcagtgagctgttatcatgctactgtactccagcctgggcaacaaagtgagaacttgtctctaaaattaaaaaatatatatatttgcaacacatatatctgaaagttgttttgcatctagaataaagaacttccacaaatctacaggagaagatgaccattatataaaaatgaagaaagggattaatcaggtactttacaaatagaatatctagatggtccataggcaattcttctgtcatcagtgagattacaaaaattaaaacaaaaacccacaccaatgtaataccactatacatcagtattcgaaagtttgaagattataataattgacagtgctaagtactgataaggacatggagcaactggataactcctatcttgctgatggaagtgaaatctgttcaactactttgaaaaatgttttggtaatagctactgaatgtgaatatacagctaccctatgcctcaaccattctacttttgggtatacacccaggagaagagtgtttattttctaaatgacttgcataagagtatttacagtagtactatttataataacaaaaattttaaaaatgaatcaaatatccatcaaccataacacaaattttaaaattgtgatacattcatgtaatcaaataataggcagcaataataaatgaatgaactacacaaaacattatggttaaactgtacctctttaatattgagtgaaagaagccagacaaaaaaaaagacatactgtttaactgcagtgatcataagttcttaaaaaatgaacatggtattggaaatcatcatggtggttttcttggtgggggaagcattgactgggagggaaactgagggagtcttctggagtggtggaattgtttcaatgtgttttgatccaggaggtatttacataggtatatgcatggtaaaaattaattgaaccacacacttaataattgttcacactattgcatgtatgttataccttagcaaaaacaacaaaaatctcttaaggactctctctctctctctctctctctctctctctctctctctccagactccactgtccagagagagatttaatttgacctagattctattttactttggaaagcacccctggtgattctaatctgcagccagtgttaagacccacagatctaatgaaactttctcatgttatctatcacaagtaaaggatgtcttgtgtgaatgtcaaccttgagagtcaagtggcttacccaagggagcatacaacaaatctgatgcgtgcccaagctggcctgggaaccacacacatctcctagtttcattgcacttcaaccatgactgccttgtattgtcatttgcctcatgttaccaagtaaggacattctcattcagtgctttgcagatcccatcccaagtcttcacttcacatgacagcaaagtacaccttcctgagactctcatcttggttctattaagttcacctcgatgtgcttagacttgaagagggacagaatttgtttctaagcagaattaaactacatttcacaacatagaaagtttcactggtccagattcgataagctgctggcaatcccagagacatctacattggaaaatctttacaaggacaaacatctactggattgtctctcccttggggttttgtaagaattgaaggggatcacatgcataaaacttttaccacagatttgctaaataaatagcaatgatcatgtgagaataattgtaacactaataatgattataattctttaaaaacataaccacactagttatcaatttcagtaaatgtaacattagtatgatatttttctctcttactatttgtatgccaatttcatcagttgactcaaagagtgttccttagagcattatttcccctccaaaacagaatccagtccacagtcatgtaatgcatttagttgtcatgactttttagtaccttctaacctggaacatttctacagccagtttttgttgctgctgttgtttataacattagcattttgaaataatagaatttccctcttcctttgttaataaactgttactcatctcgtatatgtctaatgtttatccatggttcaattaggatatgcattctgtgccagaatactacataggtaaagttaggtttttcctgagttatcaatctagaggcacatgatccccacagtgctttcattgataatgcatatttggattactctgccatagtattgcctggtatttatgctatataattattattatttttcttcatcacaggtaataagcacttggttgggagatcccttaagatgatgcaaatactcttgttcacatcagaatttcctcataagtttactatccattgatgatttttgcctaatctaatctttagtatgacggtttcaaaatgatgactttccaactctcatactccttgcacatttattcacaggcccttggcattctattgtaagcaaaagctttcccttctccctcacttatttatttatctagttagctatatgtataagtctgttctcacattgctataaagatactacctgagactgggtaatatagaaacaaaaggggtttaatcaattcaagagttctgcatggatggggaggcctcaggaaacttataatcatggcagaaggccaaggcaaagcaaggcatatcttacgtggcggcaggagagtgagagaagggggaaatgccagacacttaccaagcaaccagatctcatgagaactcactcactatcatgagaacagcaagggggaaatccgcccccatgatccaatcacctcacaccaggtccctcctttgacacatggggattacaattagagatgagatttgggtggggacacagagccaagccgtatcaccatacaaactcacaagttactatttttccaatgcatactaatgttaatgatcaaggtgtcacttcaaactggctccttagtcattgtaacatgccttcatatattttttcttagtattttcttaatttttctccccaaaacatgttccaggctcacgtttaatctacccttccctggaatcagctgtttgagttctttatccatttataggtgtcatgatcttttgaagctgacaccacaaaaggcaaacaatcatgtccatccacaaaaatgaatatttgtgaggtaattagcagatgtgttaataccctcatagcatgaaccctctgtgttaaccaagttggtcccttagtatccgatgtatatcacatctgatcctgcctctctgcctttaatcatgctgttttcaccatctgtgatgccttctccacataggcagagatcctatgtgaatatttcttgttacttattgctatttgccctaactaatttcttttctcctctgtgaagctgcccctgactgatgtggaaggctgtggagacctctttctatgactgtttgccttgaactgtactgcttggcaagatatttagtctgtacctttttcggtaaaactagcagacacttctcagactagcttagcaaatgaagaagacatcctagaggatcccaagggtatctccttgaacccaagggctggtctttcatgggcctaatgaacttcaaccaggatctggaagtcttgggaacccaagctgctactctatccatctcattttccctcttgttcctcctctctattttcctatgaatattttctttatactatatttatagagaggttttatgagctacttcattgtacatgttccagttaggactcattcatttcttgcaaattttttcagttcacatgcttaagctcccagcacatgcatttcttgcatatcctttcagttcaaatgcttaaggctcccaggaattacagttttgaagagggagagatcctgttggttcagtttgattcagttgtgtactcttgagccaattgattctggcccaatgagtgtgtctttgtgggtggtattagagagattctaggccttagaaatggaatggagggtagtatgggctgtgtggacaatcaacaaagaagtctactttagcatttggtaaaatactgcgtactagtccattttcatgctgctgataaagacatacctgagcactgggcaatttacaaagaaagagatttaatggactcacagttccacgtggctggggaggtctcacacaatcacggtggaaggcaaaagacatgtgtcacatggtggcagaaaaaagaagagaatgagagccaagcgaaagggattttcctttatgaaaccattagatttcatgagacttattcactaccacgagaacagtatgggggaaactgcctccatgattcaattatctcctactgggtccctaccacaacatgaggaaattatgggagctacatctcaagatgagatttgggtggggacacagccaaaccatatcattctacccctggcccttcccaaatctcatgtcctcacattaaaaaaccaatcatgatttcccaccagtcccccaaagtcttaactcatttctctctgtgcattaagtccaaagtccacagtccaaagtctcacctgagacaaggcaagtcccttcagcctatgagcctctaaactcaaaagcaacttagttacttcctagataaaatgggtgtacaggtaatgggtaaatatagagattccaaatgggagaaattggccaaaacaaaggggttacaggccccatgcaattctgaaatccagcagagcagtcaaatcttaaagctccaaaatgatcttctttgactccatgtctcacatgtgtaattgtataaagcatagtaattgtgtcttctaattgtgtaaagtatagtaactatacagtaacactgatgcaagaggcgggttctcatggtcttgggcagctccacccctgtggctttgcaggctatagccaccctcctggctgctttcacgggctggcattgagtgtctgtggcttttccaggtgcacagtgcaagctgtcagtggatctaccattctggggtctggaggacggtggccctcttctcacagctccactaggtggtgccctagtagggactctgtgtgggggctccaaccccacatttccctaccacactaccctagcagagcttctccatgaggctcccacccttgaagcaaacttctccctgagcatccagccatttccataaatcctctgaaacctaggcggaggttcccaagcctcaattcttgacttctgtgcatccacaggcttaacaccacatggaagctgccaaggcttgggctttcaccctctgaagcaaaagcccaagctgtgtcttggccccttttagtcatggctggagtagcagggacacagggcaccaaatccctagagtgcacacagcagagggaccctgggctgggcccatgaaaccattgtttcctcctaaatcttggggcctgtgatgggaagtgttgcctcaaaggtctctgacatcccctggaggcattttccccattgtctgggtgattaacatttggctcctccttacttatgcaaatttctgccaatggcttttctcctcataaaatgggattttctttcctattgcattgtcaggctgtgaattttctgaacttttatgatttgtttctcctttaaaactgaatgcatttaacagcacccaagtcacctcttgaatgctttgctgcttagggatttcttccacctgataccctaaatcatctctctcaagttcaaagttccacaaatctctagggcaggggcaaaatgttgccagtctctttgctaaaaataacaagagtcacctttgctccagttcccaacaagttcttcatctccatctgagaccaccttagcctggattttattgtccatgtcagtgtcagcattttattcaaagccattcaacaggtctctagagagttccaaactttcccacattttcctatcttcttctgagccctccaaactgttccaacctctgcttgttactcagttccaaagttgcttcaacattttcgggtatgttttcagcagcacccaatctaccagtaccaatttactgtattagtccatttttctgctactgataaagacataccccgaggatcagccaatttacaaaataaagagatttaatggactacagttccatatggctggggaggtctcacaatcatagcagaaagcagaaggcatgtctctcatggcagcagacaaaagaagaaaatgagagccaagtgaaaggggtttccccttataaaaccatcatatcttatgcgacttattcactaccctgaggacattatgggggaaactgcccccatgactcaattatctctcactgggtccttcccacaacaggagggaattatgagagctacaattcaagatgagatttgggtggggacacagccaaaccatatcacactccttgaataagtcttctaattgtgtaaagtctagtaactagtattgactttgcaacaaagtcataaactgtcccatggacagtttttttttcctgccctttacagttgataatcaaatttcttagattgatttgtctatcaacagatcaggtccaggagcaggaataaggtaaaagataccttggtatcctagtaagtaaaatgatatttggccaggtgtactaacttttatagcatggagataatgccagtgtgagaatgtaaaaaaagagcccctgggatgatctaacttaatgagaacaaactgggatagagtgagcaggatctggaccaattatttcaccttgagtgaggagacaaaatactcacaaaattaacacaggaaagagagaccatgtcacctctgtggtcaaatagtaaagtgtcataataaagttttccaaatgattctcaggtcagagagaaccagctggtgggtgtgcatcccatggcctcagcatcctcagaaaggtttggcataggaaactgagctgctggaatgagtctttggccataagctctcctttctaagtcagtttctattttcccagtgaagcttcactccctgtcacaggagaatattgttccaggtgcataaaggctcacgctggtaaagagttacgaaagtcggttacatcttagtatgaataatggctggaaccagggttatgtgccattttaaatttgaatgtagattatgaggtcttgttttgtctggatttgaattccccatggttcctggcacaatattagttatactgtgagtttttccagtgatttacttatttgtccttatcgttcccacttggctcatgtttctactacttgtctaccaaactgtaagtgggaattggagtcaggagaacaagggctgtcaaagtcaaaataaatatgaaatgaaatttttttctctcttaagagaatttcaagtttcaatagtaaagctaaattagacctagctgtgcagttgcctccactggctactgtctgggtaagtttggcctgtatccccaggcattggaggtgagaacttttaacttaaactttcatcagtgaggagatggcatctcaaaaatatagaaacaagataggacaatataaaaatttacacttggtcatcatttaacaggctatacaaaactgttgggaggtaacacatacattccctattggagaaggataaaactctcaataaaaatgtaaacaatacttgagttcatcatttaatatcaatttcttgtgcacctctgcaaggtaaaatgctataatatataatggagagcccatgtcaaatgaaaagtgacacctcattaatacacgtacattggtatacaatttttccccaagattattgggacttctgagaagatagtaaattgctatttttttcagaaagaaaaaaataaacaatcaattcaataatcaggattttagaaaacaaagccaatttaattttcccccaaacttggagcaaagcgttttatcaaatattagaagcattttcttcttcttacatctcattttcttcttcttatacctctctttttcttccagccccagcactctagttctctcaatcccggtataaagttgaacaaaaagaaaagccttagtgctctgagaacaacatttgcagaaaggaagaaaattccaaattctgaagaactctggaatttttccttccaatgacacctaatagtcatttagctatgctgatagtcatagacactttctgagacatttgatttcagctacgccaagcttaggcagaaaagcaagtgatgaatgagtactgtgtaagaagagattgatcaaatagttgcaaattacttttctatacccatagaggccactctcaaagcataatctatattccctcagattctcttttacaattttggtgtatccatctcccagtttctgtgggctttgcttcttttcccctcaacagcaggctgacagtgaaacttaaagtgaaatcgcacctttgctttgcttctttcctttatttttgttatcttctaactctcttataagtcttcctgggagaagtatcatcatacattacttgcacacaaatcctcaatacaggcgccagtcctagggagcttgacataagacacttggtacctgaaatgaacctagaaagcagattctaagatgggattttggagttggattactcacaggcatgatggcaataagtacctcattactggagctacgtggtgtcttaatagcttctgcaggctgcagcagtgtaattgctagaacttccacctgcagtgaagtgaggatgcactagcttatgtagtatatctgacacttcgaaataaatataaggaaatggtagttgtaaggactgtggaattgtttggttgtcattagatgtcactgaaagggaaaattacaagctcaagtcaatcatttatcagattaaggtatggcttgaatatctttggtggcatttaaattgaccctcatcttctgtagctgaagggctaattgtgccaaagatctggaccagggcttcattttaagagactcatgggaaggtgaattttcattctcagcaatctgcaatagcaaagtcagggccctgataaagaaggggtcagacaatgaaacttgagatagaaatatatgggtagatgcatttggcaattttgaacccctgtatttcattgaatgctacgggcctacagaatgcaccaactccctcttggtagaagatagaagactcctctttgtgaaatatgctttgaaaggcaatgcttgtcttcttccggtgtactcccaatttctctccaggccagtagatcaattgccaggttcagttgtcaacataactccaatgagaaaatgccatcccttctaagggagcatgagagttattagagttattcagcaatggagctttggaacctggtttacatgtactagcagataagagaaagacatggttttgaggtagctcttgagggtgttgaacttctgtgtgtgtgtgcaaatataaagctagctcaatgagagcctatcaatatgggtgcactcccctgtggctcggaatttaattcctggcaagggcctctggagctaattctgaaacactgctagatttgctcataatttaaaaattagggtagccagactaccatcagagagtgttagagaggaatatattgtataagaccagagaatctacctgctgactgtgtttgtataacaggcctggaagaaactcagtgtagcaagatgaaatgaaaaaagctccacatcaccaagtcaatcctaagccaaaagaacaaagctggaggcatcacactacctgacttcaaactatgctacaaggctacagtaaccaaaacagcatggtactggtaccaaaacagagatacagaccaatggagcagaacagaggcctcagaaataataccacacatctacaactatctgatctttgacaaacctgacaaaaagaaggaatggggaaaggattccctattcaacaaatggtgctgggaaaactggctagccatacgtagaaagctgaaactggatcccttccttacaccttatacaaaaattaattcaagatggattaaagacttaaatgttagacctaaaaccataaaaaccctagaagaaaacctaggcaataccattcaggacataggcatgggcaaggacttcatgtccaaaacaccaaaaacaatggcaacaatagccaaaattgacaaatgggatctaattaaactaaagagcttctgcacagcaaaagaaactaccatcagagttaacaggcaacctacagaatgggagaaaatttttgcaacctactcatctgacaaagggctaatatccagaatctacaatgaactcaaacaaatttacaagaaaaaaacaaacaaccccatcaacaagtgggcaaatgatatgaacagacacctcttaaaagaagacattcatgcagccaacagacacatgaaaaaatgctcatcatcactggccatcagagaaatgcaaatcaaaaccacaatgagatatcatctcacaccagttagaatggtgattattaaaaagtcaggaaacaacaggtgctggagaggatgtggagaaataggaacacttttacaccattggtgggactgtaaactagttcaaccattgtggaagacagtgtggcaattcctcagggatctagaactagaaataccatttgacccagccatcccattactgggtatatacccaaaggactataaatcatgctgctatagagacacatgcacatgtatgtttactgcggcactattcacaatagcaaagacttggaaccaacccaaatgtccaacaatgatagactggattaagaaaatgtggcacatgtacaccatggaatactatgcaaccataaaaaatggtgagttcatgtcctttgtagggacatggatgaagctggaaaccatcattctcagcaaactatcgcaaggacaaaaaatcaaacaccacatgttctcactcctaggtgggaattgaacagtgagaacacttggacacaggaaggggaacatcacacatggcgcctgttgtagggttgggggaggggggaggtatagcattaggagatatacctaatgtaaatgatgagttaatgggtgaagcacaccaacatggcacatatatacatatgtaacaaacctgcacgttgtgcacatgtaccctagaacttgaagtataataaaaaaatacatatttaaaaaatttcagttagaaaggaagaagacattcaagagatctattgtataacattcaggctatagttaataacattgtattcctgaaaagtgctaagagagtggatgtcaagtgttcttatcacaaaaatggtaataactatgggaggtgatggatttgttaattagttagatttaaccattcaacaatgtacatgcacttcaaaagtcacgttgtaaactattgatacatagaattctatatgttaattaaagaaagaaataaataaaagaacagtgaccaaaaaaaaaaaaaaaaacccaaaacaaaacaccaagaagattaaaaaaagaagtacagccaatggtaagtggaatgtgatagtatgggtcagctattttttggagataggaggatgcagaccagttacatcctggagattacagcaatggggactatagctcatcttgctaaacttcttcttgaaattttctctcagaaattgtgtccaataataagtttgaaagtgtatcacagcatgcagtaaatgtaatgtgagaagcaagtggatttcagtggcgccagtggtagactagaggaggtactggtgctgtcttgctcctactgcctcaaagccattttactgtttctgtgagctcactcccagcttctatgtgctttgttttgctatgtctcatccttgtgactttctccagaagactgacgttgggctattagaaactcctcgcctgcaggctcatatcagaggttcctggaaacttttatctgactggcatctcttagccactgactgaaaggtcaatgaaatctcaactcctttgcctgaaagtggggcaaaccttgagttgtagatttctattccggagtgcccaatgagatcagtctgattttttttttttgttttttttgtttgtttgttttgccaatcatcacatcttttcctggctttctcctcttccctgacatgctgttatcccttgctttcttcctgatttctcctgggagcatgctcttaataaatcacatgcacacaaatcctcctctcagggtctgtttctggagaatccagtgtaggacacatacacgcaatctctattttcattttttcacacccctttgattaacactgtgataagtgcatattacacattttaagaacctcagtttagttaaaaataactgatgaaagtccctcctttggaggtgtccttttaatcctctttttgaataggccaccactagagagctggtgcagatggaacagtcaggattaatttatttttctcagaagaaacaacaggttaaaattgtgtgtgtgcatgtgtgtggtatacatacatatagaggtagagacagagagggagaaggagaggagggacagaatgagctagagagaaggacaatcggcagtcacacagggtgtatagacagcatctcttctttcaacgcatttcaacatacatttattcaccctctaaaatatgtgtaggataatgatgaatatgtcactctctatcctgagagctcatggtctaatgaagaaaagatatgtaacttttagtaattctaaggccagcctttggtaatccagggtgctctgtgaaaagtctcctaatgaaggtgaatattccctggtacccgtgatgatggagaaatagtagtcaatgcatgctgcctggaggatccttgggaatgtggaatttaatgaccttgaattctaaagcaaggttttttcccctaagagtaaggctgtaaaggcctcaaaagctgtggttctatgcttaccacatgtcaagtaaaaacttttatggagttcttatttgcaatgatatttcataatagctcgtgtgaagatttatcaagattgttgagtcatttcctgagtttgtggtgtgactgtagaataatgacattgatttatttaaaaatatagaccatgatttgtgtaaaaaatagatatttcctgtgcataaaaattcttaatctcttggattgttcttgtctcctctgtaaaatgggggctataataccttgcttgcaaatattggagctgtgctttacttaaagtccctagcgcaatccctgtataaaagattctcggtaaatttttcctgtgattccattatggggtataccattcccagggttaatgaacagtaagttattttttagggaattatcaagaaataaaaccaattcatatacatcaatgatgggccaagccacatgcctgaggctaaagaaaaagccagtaatatggatcctgagtccatttaaaatttttatatattattcaacattgattggttttgcattaatgttgatttaaaagcattggattaagacatgatttcttttgactattggcttttttggaagtctctagaatttgcccctaagacaagtgcctcactcacctcaccttagttccagtgtcgaacacattctcattctcttattgatgtttctgctcttatattggatgtcgtgctgtgctgcctagatttccctggctacggattacagtggccagtcccactgaggccaagagctactggcatctcatactggtgctgagtcccttccagagatcacccttaactaacagtagccaccttgtctaaatcacattgcccttctcaagggcatccacatacaatgaatggtaggtgtgggacaaaaagtccagtccccttgtcctagtttcagaagactctaaagggttatccaaagtccctggaggattgtttgaggcttttgttgtggctgcataccagcacaacttctccctctgctcagtcttacttccttcactttcccctacaggagttgattctaagagcattctccaatacatttcctggcaccccaatatccatcccagaatctgactcccaggaacaaaacttatgacagttgtgactaggggtggtctgaaagaggagatcttaagacgggatttcagagccgaagcacccactggcaggctggcattgaggaccccatcactggtgttatgtgcagcacagataggccctggcacaagatagcaatacaatattatacgttttaccagtaggaaattgagatcgtatacctgtgaaaagaagtgcaccagaaggtgcaatatatctgatacttgagaaatactgggaaatagaaattaggagaacactgttactggatgaagaagataataaggccgggtgcggtggctcacacttgtaatcccagcactttgggaggcaaaggcgggcagataatgaggtcaggagtttgagaccagcctgaccaacatggcaaaaccccatctctactaaaaatagaaaaaaattagccaggcttggtggcgggtgcctgtaattccaattactcaggaggctgaagcaggagaatcacttgagcccaggaggcagaggttgcagtgagccgagatcgtgccactgcactgtagcctgggtgacaaagcaaaactccatctcaaaaaaaaaaaaaaaaaaaaaaaaaaaaaaaaacaaaaccaaaaaaaaaaaaaaaaacagataataaaaggctgggggcagttcattagtaattaaaaattggatatgaaaaccagaggacctccttgtaagcatttatacagattcacatatcctgcagctagaaggcagaaaaagaggaagacagtcataggacttactgagaagactaatagaacttcaaagagtgtgtggggttctcagtcctggtaggtctgctaaggcaaggtcaggatcctaattggaaagaaataggactttgaggaataggattaggttgatgagcaaaaactgttgattgactagattcccttcaattctctatgcttagagaagtatcctacttttccctattactccacacctccaccctcttcattgaagattatgcaaaagcctctgctttgcttgatatggtttggctgtgtccccacccaaatctcattgtgaattctaagtcccacaattcccacctgtcatgggaggaactttgtgggaggtgattgaattatggggctgggtctttcccgcactgttctcatgatagtgaatgagtcttgtgagatctgatggttttaaaaaatgggaatttccctgtacaagctcttctcttgtctgctgccatgtgggacgtgtctttcaccttccaccatgattatgaggcctcctcagccacgtggacctgtaagtccactaaacgtctttcttttgtaaatttttcagtctcaggtatatctttactggcaacgtgaaaacggactaatgcagtgctagacagcacctccattcttggccactagatcaatagatagggttaatgcacaacaggatataaccagcaatttctgggcttgttaaggaggaaagggactataaaaagaagtgaagacctagcaaacatatacagacagaatttgggagagtgtatttggaactagattctgagggtgtggaataaagcgtggtagaatatagagttcgacttgggagagtttcttgacatgaagctactttcttgggatttgaagaaagtgaggcccttcactgagtgaagaagaaatgccagaatttttatggaagaaggtagatgaaggaatcaaaagacatagagaagtggtcttagaattacataccatataagttttgaaaatccactagatgaatgtttttccatcggaagatttgaaagaccatccatttatcaaagcaatgaggaatgtgctgctgaacagggagccagtgtcactgagaagctcagaggtctctatcctctcctgccctgggttactatgtagtctgaagagatgaaggccacctgggcatcccacagagcatcacaataatgaatttattgatgacatcatgctaatcagaccagataagaagtgacaagttcactagaggacttggtaaaagacatgcacttcagagagtgggttataaaacccatgaatatttggaaacttgctacatcagtaaattatttagggatccaatgagccatgctaggaaatcacctccaaagtagaggacactattgcatctcacaatgtctgaagaagcagcacatgaagaaggaagcacaatgcttagcagaactttttggcttttggaggcagcagttgtatctttggaatactgtactgacacacatattggagcacatgaaaagcatcaggaaaaggctctgtagtagaaccaggctctggtacaagcagccctgctgcttgttctatatgacatgtagggccctgtgtattagaaatgactgttaggaaaaaatgcaggaggaatttctagcaaggctaagtaggagactcacaatgtcatagtgcagtgttctggagcatgacaaggtaatctgcagtaatgtattaagcttttaaaaccagcccttggcaggtaactgaaccctaatagatacaggatatttgataatgagaaattaaagtccattcaggcagaagtgttcaccatgagttgggttcagatacaccctccaaaccacaagagcacgaaggcccagcaataatgcacactaagatggaagtggtacatccagagtcaggcatgagcggagctagagggcacaggtaaactgcaggtggcctagactcctgtattattcaccactattgccccggtgactttctaccagtccctgcttgtggctgcatgaaaggtccccataattctctgttagagaagcatgaaatccaagctttgttattctatacaatcaagcagactaaatgacttggccaattgatagcagtcagcctctgtaattggccaccccagtgctgtcacaacaaactcctgagccaagtagctatggtggcagacatggaagcaatgtttgggaccaacagcttgagctcccgtttacaatgtctgttctaactaatctagatgctgaatgcccaactatccagatagagacaatactgagtaggacatcatcctttgagaagaactaactacctacctggtgccaagtgtgtccatttatcctcttccattctgtaaaggatagtaagtcctcttgatgtgaataggtatttttttcaaattcaaggaataagtttaattttggggctaatggaccctccgttagccagtactactataataagtcttagaaaatgtatgattcaccactgtgggctgccatatgagactgcattagagaaattgccctacttttcagcaaaggaggtgcagcagtgcacatatgaccatgctatccattgcttcaattacaaacacaccacccagaagctgctggcctgccaaagtgatgaaacagcttgttgagggtataattaaatccccagcttggagtggacaccttgtgagggtaggcaccaacttctaagatgatgtatgtcttctaaatcaatgctttttatcttgtctgatgtgtctaacagctagagtacgtgggtctggtaagtaaggggtagaaatagtggtagtctaccacagaatcactcccaatgacccacttggaatgatttgttttctgtcttcccagtcctgggctctgcaggtttaaaagacttggctgtcagagaatgaatgcatctaaaaggaaaacactaagagaaccattaaattgtaagctatgactgcatccccattactttgggccccttgaactgagggaccagcaggaaaggggagatgttgtaggtgttgtcatgatagcaagactaatgaatatgatcactgggaggaagtagagataattttctaccatgaagatgaagaaaaatatgatccacatttttgtctcttgacaccaatgtgggcagttaatagacaagagcaacagccacagcctgagaagggtctcaagctcttaggaatacagatctgagtttcctcactagcaagcaaactagacaagcaaagaggaatctagaatgcatagtataaaaaggaggtgatggccagccatggtggttcacgcctgtaatcccaacacattgggaggccaaggcaggaggatcgcttgaggctaggagtccaagactagcctgggcaacacagcaagaccctgtctctaaaaaaaaaaaaaaggtaaaacaaaaagaaaggaggtgatgagtgtagttgtggcctcaagacaagaggcagtggcaggggtaatttttcctatacttcctcttgtaagtttactttaatgaaagacgtcacctgaatcctgaagaagtggcttccagaacatatatgaagcaagtgaatccaagtgactcatgggaaaagctgctgtggatgctgtgtggcaccttctaatccccccacttcagaactgaagttcttattcctctaactgcacatggttttggagactaatattttacacgtgtatcctccagatcttgccttcggctgaatagaaacaccttgcccaacatcgtaccctcttctctgggggcaaatgtggaaatataaaggcccaacacagctgtacccaaatttagaaaaacttcagagagtctttccaatctcagggttccccttaagatcagctgagtcctttgttatgactgcatcacaactgaaatttcttcttaacaattctacttccttcactttttctgtgggtgttgatcctgagacctttccttaaaattgtttccagagtctacttcctgggtgccctgagttttgacagcttccctccccaaactgcaccatccctaccttaaaactcactcttctactgccccctaacatacttgcacacaggctgaatagtctaaaattcctaatttctttccctgccttcccactaagtgaaggttcgtttttaatttgtggtactgattttgctttctctgttcagtaaacttgccctttgcaattaattccaaggttgtagtgcctgtgtccaagtgaaagtaaaaacatggtatgcattatttgcccgtttcaataatgtcaaacctcttgcacctgatgtgtttgacggattctaaattgagaagcatttgaattgagaagacctgagccttgtaaatgtacttgtcactgctgagacatcatcctcaaagacagcatgagctgaggatgcacagagggcacgccacctaagtaagatgaacacgaagaggcattttggaattctgttttatgcattagcaaataaataagcccagctcaacctatatgggagaaattagggaaaaaggggcaaagtgtagcctgaagtctttactcacaggggtcactcccagggcttttcatcttgaaattttttaaaaaaataactattaattttctccagcagagtgtcttgctgtcacccagagcgggaataccagccatcgtggctgacatcttttctctcacggtatttagtaaaattaaactgccagtcttcacttctcctgatggcttcagtactgtacacttttctcattgaagttttgttttttccttcttttcattaattttaaagaaggtcttggtgggtttaaagcccttatgttcagattggcatctcttgatgagacctaggatactgcaggtaaagacatcaggacaaatgaaggttggcagcataaaagaacacattttctcctttaatgacttgaaattttctgagtagagaaggcttgggcgagttctaagcccaaagaaggcttcattgttgctgaggggtagacctgtgaactgtgtcccaggataattcagactggagatgaggagtgatcttcctgccagacaagtagggttgcttgcaggacaagtattcactcacccaggtgatcacatctccaaactgctccaccagaggcatccctggaggtggtattgtgttacccttgttatcggttcatttgctggagctacatcacagagtgtgtttcatggattcaggacctgatacagccctcgaatcaactggactcttcaaatttagcaacacggtgtagaaattgttgaagctgccattgcactcactcaccttctcacatcaaatcacccatccagcttgattttcattaaatcatccattaggctagtttgctgtggagggtctcctcattcaatttcttggtcttttcttacctcttattttctcatttacatagactcctaaagcactcatgctgcattccttaggcccagcccagaatcacattctgttctttctctaatgttattattctcatttcaaacccatatccctttaccctcctaatagctaaatttacattccctaattatattcagaaagttgtatggctatcaatgagttatacctctttagaaaccagtttacttagctaagagttagaggaaagcacactaataaaagagattcagctagagataagaatgaagttttatctcatatggaatatttaccttttaaaggagagtacgtactaacccaagcctgcattccctaaaaacatacttttgtcttattcatgtttctctgtccctctgtattttccacagtgcattgaataagtggagagttcaaataaaagttgaattcactgcaatcaaatggaattaacgttaatgaaataaactctatggaacatattccacgtagctgcttatctttgcagttaaaatcagaaagactcagaatctgattttagctatcatcatataattgggtaagtgtgtgtttgggacaaataatgccacactcctgtttcaatttcctcatctataaaatgggcgtaataatattacctatctcagaagattgatatggggattgcatgagatattcataatatgctccgcatgtaacattcacataggtaatgcatgttaataataataacaataataggaataataatacaaatagttatttccatctcttgtgactgtggacttagggtcaatttagtgggtcaatccttaactatttctttgattcctttgaagtgcaagaaaaacagaatttctaatatgtaaaatcccattattatttctaaaaataatacaagggagtgagatcattgtgtctgaatcttattaaaatagagcagttggaaaactttttctgtaaagacctagacagtaaataatttaggttttgaagaaaacacatagcctctgtcataaatattcaactctgccattgaaccataaatgaatgggcatggctgtattccaataaaactttatatatacaacaacaggaagtgacctgaaggaagtgaagccaaaggaaagtactgagtaagtgaaattcaccattgagtgatgcctcatttgaatgactttcaaggccttgttttccatccagcatcaggaagacaccactctatcctaataattaactgtacatatgtgctcaacaacaacaaaaacaaactccacacacacacacacacacacacacacacacacacacacacgtgtggatttggtccctgggttacagtttgcgtagtgcatttgtggtcacggtggaataggtgaatcagggttgattcactataatttccattaagggctgactctagagttcctctagagttaaggaactctagaaaaggccatcctcttcccacacagaggtgacatagttatatcaagaaatacacgcttggcacagaggctagtaagatataaattgaaagacaatactaggacatgcagccaaggtaaacggattcaacaactaacttcagtatgtcaatctagtgttttcaggttatgtttctttgctgaggaaatgcttgattagaaaattagttactgtactgggcctccagttttagtccattggaccttaaatgaaaaataaagggtagaaaggatttgctgtttttctgtacacatacaaatgagcgagaatccagggaggaaaatattaagtcttcaatttttgatgtgcattgtctcatacccagaatgccttctttcattaggctatttataggatgtgttcacagctgacttaattatgacacaaaatcagtgaatgggagaggcttaccccactgagaaagagagaaagactaaaagagggaaacctgaactccaaccaggctaccactgaaagtttacatgggagagctctggccatgccaccaagctccctgattttttcctccagcctttcagtctaggtaaaaacagtgcagacttcaaaacaagtctagtagtccccacttctgaggagactccacactttaaaaaaagagaaatttaatggcagaaactgtcaccaattaagataattaaaatgatcaagcaaccagaatagaatcatcaatattggacaatattccacagtctctgaccagcctcaacaaagtaacaaaagtaccaaattctttagaaaatcacttctcagtgattatttatacataaagttacactagttcaatctgagtctgatgataatagatcaaacataattataaattgctcaaccttcatgagcacacccctagcttaatctgtatatggccagataacagtatgtggattttttttttccttttaaaatttgaggctgtggttggaaatacaaattgccaaacaaaaccaaattacagaaaccagtctattacagctttcagagaatcataagggacattaaacttgaatgaacattacaagagctaaaactcagcttgaattgaggcacgttcatttcaattgtatttgattattcttgttatattattactatgttcataactgttgtgatatttcagtacagagtgatttctccccaaatgtaatgtggcttgaaatcaagaatgccaacagtggtttgtgttgagccccattttagaggcaattcctcaggcagtagttcattctggaagctcaaagcaatttgctggtcagagcttgagcacttgtaattggagagaaagatcctttggaaaaaaccaccaaatttaagcctaagcattatctttaataattgcatcttcatgtgctggtgctgcaactacataatgtaccaggccttcggacaaggtgctatctctgttgtaaatgcctcccttcctttagtcttcctggtaaattcttcctcttcgttcaggtttcacctctaatagacgttcccttttatttctccatgtagggttgattataaaaaatgtataaataataatgataacatttattgttttcatgtgtgtaaaactataggttttatctataatatgttgcattttaatgcaaattaaaatatagattttaatcttctgtttacatacccaccttctgcaacagactattactttctcaagaggggaaatgttctttgctcaactttgtatttgcagtattcaacaaagtgatgacaccgaatagacataataaatattaattgagtagatttctaccactgtgaaatgaggatgatggtatctgtgctttccatcttatggatttgttgtaagaatcaagtaaaataatgtgtatgaaagttctgtgttgactaaaacatactctgcacatatcagaagttctgctaatctctcaactagacaaatatcatctgtattagcaatcacagagatccttgttaaaacagctggaatctcagtgtggtgagaacccaagctcctttcctcctcagctgctcaataagaatagaaaaatctaacgcatcctatgttaaaaagctgaagtgtccattgtggttcttctgaggaaaatgtagactctagagaaatgtagagtgtgattagatgatgagacgttttgaatttaaaatcccattaaatatttatttacagatattcttctgcagtgcacactttgtcgaacaggtttgcctctgaaatgtgaagtctttcccctcctctgaaggagttagttaaagagagaaaggttatatggcactttctgcttcatcgtgatgcatgagaatgtgcattagcccaaatgtttacccacaatgaattaaaaaataaattgtgtatatgggtgcagggaactactatagagcagttaaaatgaactgttactaatgctgtaacttgagtgattcacataggcatgctattatgcaaaaatgccagtgttttaacagaaaacacactatctgattccacataagtgaagtgaaagaataggcaaaaagtagtatgtggtgatggaagtcaaaatagcggtaaattctggatcagtttttgagtgagaaagagactgagagagccccaagggagctggaaatgttctatatagatatgaaagttattgagctgaccatttaagatttatgcacctcgctctgtgtatgtaatttctcaataaaaagtgtgacataacaaaggaaggtaaacctgcttttgggggatgaggtccatgaggaaaaatacatgagaagagacacagattcactcttctctctttctagattagactggttgtccctagagggaagagatgatgactggcttacctggctctgtatctcgttaacatgctcattcttttgttgtagatacattttgggctgctttcaatttgtgctatgatgaataaagctgctctaacataatttacatgtctttttcatggttatctgtaccgatttcttttggttatatacttagctgtaaaattatatgtggcacctaataggtgattaataaccatttgttaaataaaaatgaacatatgaggaaattaatgagtaaataatcttaaaaatgatccatgcacagtgcagggacttcgctccctttaggggaagagtgttgcaaaaggctggagatgggatgcgaagggatgagatctggttcctaaagcaggacctgataccatttacccaggggctgatttcaatccagaaagaacatatatagtgaccctgccctgagatgcaggctacagcaagtggggtcaggtagagtctgctacttgggtatgctcagcaatcactggtacggcccctgtccctttgtgtgagtcactgaaggggtccaggaggaggagcaagaggtacacaactccggctctgcttataggcaacactctatcatctggatgagtcactttagttttccgagtgtccctttgggtcatctcaaaattggtgaaaaggcagatcactgcgcttctctgacattcctgattcctgagaggagagtgagggcagctgcttgtgggttgtggcacaacctaagcaacttacaacagccagtaaaaattttttgcagtattgactttcagttgtcaaatttgtacaaatttgctcatttgaatgtataatacacctatgagttttattataaaataaagtttattataaaggcttctaaaggcatagaactctgaaacccaagtcatgtttaagtcttgatttccaagggctcttggcattattatcacatactctggatgttggtgaattcagtagtagatgatctgcaaagcaatttcctcaagttcaagaagacaatcctctttcttcccctctcaaaaatcaactggcaattagttatcttctatttctttctttctgtttttttattttttattttttgagatggagtctcgctctgtcacccaggctggagtgcaatggtgcgatcttggctcactgcaagctccgcctcctgggttctagcaattctcctgcctcagcctcccaagtagctgggactacaggcacccgccaccatgtctggctaatttttttttgtatctttagtagagatggggtttcaccgtgttagccaggatggtctcaatctcctgacctcgtgatccacccgcctcggcctcccaaagtgctgggattaccagcgtgagccactgtgcctggccctgttatcttccatttcttagtatcctagcctgaaaatagttgtctagtaatttatgagccagcaaacttatataacttatataggtttcttcattgtatctttgaattcaatcattctttactaactgataaactcttgcctttatagttatcctacatttccaaatctgtgatcaagtaagctagacatcaagtgaaaagttactccagtttctagaaaattgtgccatgatcatttcttagtgcctgcgacagttagtccacttacttctgaacaataagctgttgaaaaacttcatttagaatttgtattcattattttcatgttttctttctcttactaattagattcataattgcaagacttgctctgacagtagtaaacaactgtgtttaccatttaagaagaatgcctgtgcttctgagaattaatagatgatgacaagtgccacgattgtgtagcaaattaatataatatattctaatatgaaagttgctagggagactttgccgactttcctcctcctgctgtctcatactcagcgaaagcctgtgaggggccaaagggaaattctgcctaggcttcagccctcaggagaacatttccacaatgaaaatggagaaattatagaacccttaaatcggaaggctgtctccactccttgaaacaggaagggaggagcccctgtcccaagtaggtaaatttggtttaaaaaaaaattattaaaagtaaggatataattctcagtttgaaagatcatcccaaaggcacatctctcagacatcacaagtaacaactgcatgccatagaaaataatttttcagccttagaacaccaaatcatcaatatgttgtcttttgagagaaacaattccacgtgagaaataggaactaatctgaagaggaaaaaatgtgctgctgcctttacaacagactctttatttacatttgacaatacatgccataattatgtgtattgaaacagatccctgaaaccaactggtgtctcatgtaacagtaattcatatttatggatcactgctgacctagtctttccaaccacacagatgatagaaactcccttgctgaatgaaacagcctcttggaatcagcatcatatattgtttgcttgagctgaatgaaagtaaataaaacatgagatgggtatcaattatccctgatcttctaaaaatttagaaaataatgcccgaagatgaaccaagagagactgatgtcttggtttatctttataaaaacagacattttaattttatttaaagattaaaatgagaattaattattttgtgataaataaatgtgagggttatcttcaagaagcaagttatttgcttccgactgcagtagaattcatatttaaaataactgtatttatacacacatacatatgttatatataatatatatgcatgtacatacacacacgtatgtaatgtatataatgtacgtgcgtgtgtagttaaaaaaaatgcattcagggaagcttgcatacatccaaagagtacagcttagcatcccagataaaaactcagatcattactcatactccagaatcctacccatgtactctctctcagtctttattgccaccccctcccccacgcccaggtaatgttattcttgcttctattaacatagattagttttgcttctttgggaatttatataaataaactatctatgagtatctactctttcatatctgtcttctttggttgaacattgtgtgtatgagatccagccacacttctgcatgtagttgtaatttactcttactgtatatattatcaaatttgtaaatatactacaaagctttcttctattgttgattgatatttgagtatttttcttagattcattttaaatgatgttcgaatgaactttttataattctataattgaaatacatattatatgagatacaaaataatatgttaaactgtaatttgggagaacaaacaaataggtgtcaaagaaaaattgtaccagacagaactcaacaggcaaggaagactttaataaagaatattgcaataggtgagggagattaaagtcaactccactgaaacaaaaggcaggtgaaattttaatcactggaatgagctagtgggatagtgctggaggacattagggtggagattagcttggtctatgtgattagcccctctatgtttcctaactggctgttactggagttagtttgtactttcccacagagacaggagatagtggcactatcttacttgatgattatatttcaaagatatggctcccaggtccttaacaaagactttggttataaaactggcaagaagctaggagaagacttacatctcaaaaaggcagagaaagaatttataattgcaaattttctaaagtaaatgctctaggaaaaagaaagggcctatggtgaggaagaaatctgtttaaagtttagtaaactaaggggaatgctaaggtaatattgatcattggaaacatgttcaaatattaccacataacactattgctggttaatttatttttcattgcatttattccactctgcaatttttattttttctacctgtaataaatattttaatcagtctcattatagattattggcatctactaataactgaaaacttaccatgtacaaccaagggtgcagaaaaaaacaaggcttctttgagcaacatgctccagagggaagaaggaaaaatgaggtcagtgaacaaaggatttatgtaaaagtttactgatcaccctgagttcatgtcagagaagaaaagcaaaccagccctccaatcctccaatccttttgatgacctgtacaagcagaaaaatatacagttttcaaagaaatgtgtccaaggagagacacattttgacgtcaactatgtgatcatcataattgaaaatatgagggaaaagagacacacaaagatgacaatagctcaaaactaggatgcattaaaatgttatgctatatagccctggaggcccttaatctcaaggaatggtgacagaattgtacttggattaatttcccataactctcacgtttcatgagaattcaacatatatctctacactgcacatcattatttccacccatcctatgcccaacttttccttactcttagataattaattccattctgaagccctattctgtagaatgtatataaatatcagaaatatgacataaccaactttttatgaaactttcccacttatgacctcacagtttgtttacatctgtaccagcagactgcaattgtattgaagaaacaccactgctaagcaccatctctttgggggagaaagtttgaaaaaactgggttaaattaattacaaataaaaaaggtttctgtatgtaagcaattcttggagccttgagtcaattgtgatgcttcaagagagtgagaatttattatgaaacatttctaactatatttgactaagtaattctttgtatgtttatgtaattgtgtgtgtatgtgtgtgtacatgtgcatatttaaaaactatttatcatacatggaatatacaatactttgatacacaatgaggactaagctctgattttttttatcttgcccaaattcctatctaagaggtcggtagagtgatgccctacaaaccacaaattctcatcagatgagttttatttaaccgcatatatcatgacctactttccaatttgacttgactctagcataacattacgtgacaagcaagaaagtcaaaatattttaccccaaaacatgttcctttgccatattttgaaatggccctgcaaagctgtcctttgtgggaggaaatttgtatttgtaaagaatctctgttaacatagctagatccttttcttccaggcactcttaatcctgaagatattaatttagagtctagcaccttttaaaggtctgaatagttaacatttgtcatctattgtctctaagggcagccactataacactccaaaagaaccttggtctccacgatcttttatcttaacccaaatatttcctttctattgatcccaagactttagacaaactcactcaattgtcaaccagaaaatgtttaaatttacctgtaccctggaggcaccgccatccctacctgcccccactttgagttgtcccacctttctggaccaaaccaatgcatttcttaaatgtgtttgattgatgtctcatgcttccctaaaatgtataaaaccaagctacaccctgaccatctggggcacatgttctcaggacctcctgagggctgtgtcatgggccacggtcactcatatttagctcagaataaatctcttcaaatattttacagagtttgcctctctgtcgacaacactgattagaatctcaaaactcaagtgcctacaaggataagacatctattgcaaatgagtaaaggagacaaggtagggactttgacaaactgggaagagcatgttcataaaaagtgagcagccactgctctgctcccactgattactgccatacagaaatttcaccagagtattttcagatcttttgtttttccaagagaagagaataatccagttatttatgtgaaatcttcctatttttggatattagcaaataacttgggggtttttaaaacactgcataggtaaaacaaaagaacctgacacacagattgaatccacaagctgccaatgtgtaacctctgaatagcatgcatctgccactttgtggcatcttttgcaaaccatagtcttatgaggatatttaaatcatgaattttattatgtaaattttatgtgcagaaagaaaatgttaatccttttattgaacattacttacccggcactgttttgagcactcaaacctataatatttcatttaatctttactttgggaagaaatacatggttatccctaattttcagaccacaaaatagaggctattaaatagatgaagtagcatgtacaggtcaaaatattagtaagtaaaagaggtaggatggagggtatgcctgacattaagtcttgatgcctgaccattaatgctatgctgcataactcttcccttctataaatcagtgtatacataatgcatgtccaattactgtctctttagtttatacgactgaatgtaaacttgctgaggacaggaaccatgctgcatatatttttttcctcacactttaacgttttgttagacatataagatgttttagcaaatgctgatttaatgaattggtgtttggatatgggcctgtttagtttttcttactctactgcaggaaacaatgcataaagctgagcattttgttggctcttgataattaaagtgaagtatattttttgagtaatattaaagtagtatagggtggtggacaagacaatgcatttgtcttcctgtcaataaccttgaatttggtgcaagtttatcactaactagtcattgtagaccttagtcttttcatttctaaattaaaaaaaaacatagattagaaatccctaatttcaataactgtgtgattggttcatactgttgggagatcaagcttaaaaattaaagaatgtactgactctcagacttaaaattccgacttagggctggtttcagatgtggcttgaatcatgtcaccaggatcccctcctctccatctcttaattcagcgttgcttttcattgtgtgttggctttcttctcaaatggctttctccttgtaatgtggctgcagaagatccacatcttatatcattttatcttgaggtccagctgaacagaggaagcttcctcttccctaggccttgacagttgtgcagagccaggccctcattggctccaatgaggttgaattcctatctgtgaaccaatccctacggctagggagattagacctgtttacaagcttatactataagtgtaagagttcacattagaatctcctgaggagctttgaaacatacttacactgtttcccaccctagagaaattaactcagaatatctagaggtgagagtcaggcattaatttttttaaagctccctttgtgattccaatgtgaatcctggtttgaaaaaccccagttcaaataatttagggcccaaacctgaagttgtaactaaggcaagctcatttcaaacacatgacctgagccttggtaacgggtgatacttcaaatgaattttgggcaactctttagcagatgatgtttgatgcatactggattttaaaaatcttcggctccactattttgaacaaaacaaatggggactcctttcatttgttcccattatgcatcccttttccccttcctatcataaagtgagaggtaagattcccctgggctcccacagtcatgtggcttggcatatcaagtagcctgagagctgggagttaaaacctgaggacattcatgtctctctttctagaagttatagtctgtacattggtcatcaatggatgcattaaggcctcccccagagatggctccttacaacattaccctgttctgcaaatttacctgtgacttccatccacagtattcacatcattcttatgctctcttgagagttaattcttcttataaataactgacatgttctcctgaagaaaaatgtatttccagattcatgaaaatgtaaattaggatttttaactacaagttcaacaggctggactcattctctggcaataaagcatgtcagagcaatataaaacatctagaaaaaacaagctgtgccttaaaataatacccagacacctgactgtatcttccagaaaatagagactttagctgaggtccatgcatcagaatctcagaaattctgaaatgctctcaattctagagaactcatcaacatcatttcagtgctgtagcaggtatcttctatgcaaaataatctctttcatagtccaaaaagctaaatgtattatacctaaatacatttccctgctaggcatttccacctctggcttctctaacattccttgcacaggggtcccgcctgttcaccatgttctctacaaagatcttcagaggtataaccattgatagtaaaaagacaacataaattcatacctatgttatgacaggcactgcctcagttctatatagtaaatgctttctctgcagccatatgagttaaggagcattctaattcacttccaaaggtgacaaccctgataaccagagaagttaagtaactggttttgattttacacaactactaagttgaaaagttagatttggaactagagatattttattataccaaatcttaagtgttaacctatcaaggaatctaatttattttccacaaggaaacagtgtctgaggttttgaactttttaagagtagtaccttgttcattgtggagtgccctggacctcgtccaatgcttggcacagactgggtgctcattaaagaattgttgaatgaaagagataggcaggtgggtggtaatgatgcatttggctgtgaaacgatgtttcaacctcctactcttttaactcatactcaaatttgacagctctttgaccaactaagtctgttatcatcaaggaaataggagcttccatattcctcctggcaggtttggggtaccagattatttcttttttttttttttttttttttttttttgagatggagtcttgctctgttgcccaggcttgagtgcagtggcatgatctcagctcaatgcaagctccgcctcccaggttcaagggattctcctggctccacctcctgagtagttgggatttcaggtgtgcgccaccacgcccagctaatttttgtatgtttagtagagacggggtttcatcatgttggtcaggctggtctcgacctcctgaccttgtgttctgcctgccttggcctcctaaagtgctgggattacaggcgtgagccaccgtgcccgaccgtttatttctttttatttgttctcaggccaaagaagtagcaaatgcttttctgaactgtataactgctttttcctttcctatttcatctgatgtctctgttttggccttatcgctaaatcagtgcatataagaaaatgtatagttttaaatacatataaaagacaaaaaagaacaatccaaaaaaatcagtgattgagaatgttacctgtgaagatggaaagaggagaaaaaattaaacaataggaaggaaaccatataaatgtagagatcaatacggtttccaaaaatagaaaaaattcaataaaattgatatatgtatctttgaaaataatattagtaattctgtagctagactgatgaagtacaaataaagaacaaacaaattaccaatatcagaatgagaaaggaggatattactacaaatcctataattattagtaagacaataaataaagttgttccacttttggaaaggttatgtgagaagatctgtagacctgctccctagtgaaacaaacatatcttgtgagtattattaaaaagcaacaataacaatttaaattttctggaaattatcctatgggcataccatgaagaaacatttactcaagaaatctactaaaccttagaaagaatggtgaatttgtggcacttggtctgtgacctggtccctccctccaccttccctaatgcagcatggtgcaccactctagatggggatagccaaaaaggcaatggtccctctatcttcaattctcagtcaaaggatgtggcctttcactgggacggacatgtcccccatatttcacatcacttctcagctgcaaattgccgagactagattcctggaaagtgtggctgagaggtcagggaatcccttcctgtactcagtccctagtcacagcatggaggttctaccttaggtacaacaggcctagaatgctgagcctttattggtcttactccagcttgcttgtaaagtggagattctatgctgaggaaggcaagccaagaacattagaagccactgaccctgcacaattctctacttacaaagctgaagtgttgttttgagagaagcagacattttattcttgtccacaggtttggagctgtgtcttggaaattttgcaaggagagaagctgtgtgtaagaaagagctccaaaactttctctgaatgaactgatttcatttgaaaaagagggtggagtagctgaaactaaagccactcttgaaaataatggggattttggtgataaatgatgaaaggtaggctgatagaagaaagcatcagcaaaagtgaagacagactagtagagattatacaatctgagaagagaaaggaaagagaatgtaggaaaatgaacagagcctcagagaaacatgggctaccattaagtacactaacatatgcattacgagaatgactgaaggagaggagagagaagaaacagaaaataagtaatagttgaaaacttttcaattttgataagaacactaatttaaaatctcaatgaaatccaagtaggataaatacaaacagacccacaccaagacacatcatagtaaaaatattgaaagacaaagagaaaaatcttcaaaaaattcacagaaaaaaagaaaaaaagaagaaacactttcagaataattatatgaggtcatattattctcataccaaaagtaggaaaaaacatgaaataagaagaaaattgaagtctaatatttcttatgtatataaatgcaaaatctgtaataaaatactagtaaaccatatgtagcaacatataaaaaggatgatagactatgatctagttggatttatcccaggaatgtatggcttctttaatatataaaaacaaattaatgtactacatccctgacagaataaatgacaaaacccaaacgatcatttcaatacatatagaaaaatcattttataaaatttaacactccttcccgataaataactcaacaagccaggcatagaagagctcttctataacccgataaaagacttccatgaaaagtccccagctaagatcagacttaatggcaaaagactgaatgttcttcccctaaggtcagggaaaaaacaagaatgacttctctctacacttctattcaactttgtactgtgggttctatacagataaattaggtaatatatgtaaataagtagcatcagatcagaaaaaacaactgtctcaatttgcagataatatcatcttgtatatagaaaatcctaacgaatacactaaaaattattagaactagtaaacaagttcagtaaggttagaggatacaaggtcaatataaagaaatcaattgtttttctatacacttgcaatgaacaatccaaaattgaaattaagaaagcaactacatttataataacatgaaaaagaataaatagtaatacatacaacataaaaagcaaaaaattatactctaaacctacaaacactgataaaaaattaaggtacatgaaaagtaagtacatgaagacagttgatgtttattgaccaggagacctgatatttttaggatataaacactttccaaattgatttaaaaattcaatgcaatctctttcagaatcccagctgtctttttagtagacattaatataataatttcaaaatctataagcaaattcaatggtcctacaagaggtaaaccaaacctaggaatattaggtgttcccacaggagaaaagaaatctaaaagtttggaaagtatatttgagggaataatcaaagaaaacttccctggccttgctagagagctagatagagctatccagatacaagaagctcaaagaacacctgggaaatgcattacaaaatgatgatcacctaggcacatagccatcaggttatctaaagtcaaaatgatggaaagaatcttaagggctatgaggcaaaagcatcatgtaacctataaaggaaaacctttcaaagtaacagcagatttcttagcagaaaccctacaaactaaaagggattggtgtcctatttttggcctccttaaacaaaacaattatcagccaagaattttttgtccagtgaaaataagcttcataaatgaaggaaagatacaatctttttcagacaaacaaatgctgagagaattcgccactaccaacccagcactataagaactgctaaaaggagctctaaatcttgaaaaaaatccttgaaatacaccaaaattaaatctccttaaagcgtaaatctcacaggacctataaaacaacaacataatgagaaagaaaaaaacccaaaaaacccaaggtatttaagcaacatatagcacgacgaaaaaagatattccatgcaaatggacaccaaaaatgagcagtaatagctattcttacatcagacaaaacaaactttgaaacaacagcaattaaaaaacaaaacaaaacagggacattatataatgataaaaggactagtccaatgggaaaatatcacaatcctaaatatataggcacctaacaatgaagctcccaaatttataaaacaattactactagacctaagaaatgagatagacagcaacacaataatagtgggggacttcaatactccactaacagcactagacaggtcatcaagacaaaaagtcaaccaacaaaaaatggacttaaactataccctagaacagatggacttaactgatatttacagaacattctacccaacaactgcagaatatacattctattcatcaacacatggaatattctccaagatagaccatatgataagccacgaaacaaggcttacaaatttaagaaaattgagattatagcaagtactctctcagaacacagtggaataaaattggaaagcgactccgaaagaaaccctcaaaaccatgcaaatatacagaaattaaataactcactcctgaactatcattgggtcaacaatgaaatcaagatggaaattaaataattatttgaactgaatgataatagtgaaaaactatcaaagcctctgggatacagcaaaggcggtgctaagaggaaacttcatagcattaaatgcctacctcaaaaaggctgaaagagcacaaatagacaatctaaggtcacacacctcaaggagctagagaaacaagaaaaaaaagcaaacccaaatccagcagaagaaaacaaataaccaagatcagagcagaaataataaaactgaaacaaaaaaaaatacaaaagataaatgaaacaaaaagctggttctttgaaaagagaaataaaattgatagatcatgggagagattaatcaagaaaagaagagagaaagtccaaataagctcaggtagaaacaaaacagatctttcaaagctactatgaacactttaacgtgcataaattagaaaacctagaggagatgaataaattcctgaaaatatacaaccctcctagactaaactaggaagaaagagaaagtctgaacagaacaataacaagcagcaagatttaaatggtaattaaaaattacaacaaatgaaagttcagtgccaaatggattcacagccgaattccatcagacattcaaagaattggtatcaatcctattgacattattctaaaatatagagaaagagggaatcccctctaaatcattttctgaaggcaatatgatcctaataccaaaaccaggaaaggacgtaacaaaaaagaaaactacagaacagaccaatatcactgatgaacatcgatacaaaaaacctcaacaaaatactagctaatcgaatccaacagcatatcaaaaaggtaattcaccatgatcaagtgggtttcataccagggatgtagggatggtttaacatatatataccagtcaataaatgtgatacaccacataaacagaattataaacaaaaatcacatgatcatctcaatagatggcagacaaatcatttgatgaaatccagcatcgtatatgttaaacactcagcaaaattggcacagaagggatatgccttaagaaaagccatctatggcaagcccatagccaacattatactgaacagggaaaagttgaaagcattctctctgagaactggaacaaaacaaggatgcccactctcaccactcctattcaacatactactggaaaacctagccatagcaatcagacaagagaaagaaataaagggcatccaaatcagtaaagaggaagtcaaactgttggtgtttgctaatgacatgattgtatacctagaaaactctaaagtctcatcaaaaaagctgtcacttgtaatgaattcagcaaagtttcaggatacaaattaatgtacacaaatcagtagccctgctatacatcaacagtaaccaagctgagaatcaaatcaagaactcaaccccttttaaaatagtggaaaaaaataaaaaataaaaaaataaaataatacctaaccaaagagctgaaagacctctgcaaggaaaactacaaaacactgctgaaggaaatcatagatgacacaaagaaatgaaaacacatcccatgctcatgaatgggtagaatgaatattgtgaaaacaaccacactgccaaaagcaatctacaaattcaatgaaatgcccatcaaaataccaccaacattcttcacagaactcgaaaaaataatcctaaaattcaaatgaaaccaaaaaatagcccacatagccaaagcaagactaagcaaaaataataaatctggaggcattatattacccaatttcaaactatactataaggccatagtcactaaaacagcatggtactggtataaaaacaggcatatagatcagtggaacagaacagagaactcagaaataaagccaaatacttacagtcaagtgatcttcaacaaagcaaacaaaaacataaagtgtgggaaggacattctattcaacaaatgatacagggataattggcaagtcacaagtagaagaatgaaactggatcctcatctctcaccttaaacaaaaatcaactcaagatggatcaaagacttaaatctaagacctgaaaccataaaaattctagaagataacatcagaaaaacccttctagacatgggcttagccaaagacttcatgatcaagaacccaaaagcaaatgcaaaaaaaaaaaaaaaaaaaacaaagataaacagatgagacttaattaaactaaaaagcttttgcacagcgaaagaaataatcagcagagtaaacagacaatccacagagggggagaaaatctttgcaatctatacatctgacaaaggactaatatccataatctacaaggaactcgaaaaaaccaaacaaccccatcaaaaagtgtgctaaggacatgaatagacaattctcaaaagaagatacacagatagctaacaaacatgaaaaaatgctcagcatcactaattatcagggaaatgcaaatcaaaaccacaatgcaataccacctcactccttcaattatggccataatcaaataataataatactaaaaagatgttggtgtggatgtggtgaaaaaggaacacttttacactgtttgtgggaatgtaaactagtacaaccactatggaaaactatgcggagattccttaaataactaaaagtaaatctgccatttgatccagcaatcctactcctggttatctacccagaagaaaagaagtcattgtatgaaaaagataattgcacacgcatgtttatagcagcacaatttgcaattgcaataatatggagtcagcctaaatgcccttcaatcaatgagtggataaagaaaatgtggtgtgtgtgtgtgtatatgtataccatatacatatacatatatatatatatacacacacaccatggaatactacttagccataaacaggaacaaaataatggcaattgcaataacctgtgtcgaattgaaaaccattattctaagtgaagtaactcaagaatggaaaaccaaacatgatatgttctttctcactcataagtggaagctaagccatgagaaggcaaaggcataagaatgatacaatctattttggggcctcggaggggaaagggtgggaggaggatgacagataaaagtctacacactgggtaggtacagtgtacgctgctccggtgataggcacatcaaaatctcagtaaacaccactaaagaacttattcatgtaaccaaacaccagctgttcccccaaaacatattgaaataaaaaaagttatgtttacactatactgtagtctattaaatgtgcaatagcgttatgtccaaagaaatgcacagatcttaattaaatacttcattgctaacaacaacaacaacaacaacaacaaaaacctatagatgaagatggctttactggtcaattttaccaaccatattaaggggaaaatagtatgaattggacactaatgctttcagaacatggaggagaaacaaacatttccaaacacattttctgagaccacattcatcctgatagcaaaccagataaatacgttataaggaataaaaattaccaaccatttccctcatgaatagacaaaaaaatctttatgatagtattagaaaatcaaatccaaattgtgtaaaaatgatagtatattacagctgattgacatttatatcaagactgcaagattggcaagattgatttaacttctgagcaacaatcaattttattcatcatgttaacaaaatgaaaagaaaccccatgtgattatctcaatacatgctgaaatagcatttgacaagagtcaacatacattcattataaaaaaacggaacaaacaaggaatagaaaagaacttcctcaatctgataaaggagatttatgaaaaaccacagtgaaaattatacttacagatgaaagaataaacatcatctggttaagatgggaataatacaggcctatatattctcagcaattctattcaatattgtactagaggtcctagtcagtttcatgatggaaaaagattaaattaaaggcataaagacaagagaggaagaaatataactatcttaatttgcagattatatgtcagtaagtttttaaaaaatctactagactaagaagtgaattgtagcaaggtcatatgatacaagtttcataatcttgaattaattatatgcgtatatactagcaataagcaattgaaaataaaattacaaaagcaataatatttataataacatcaaaatttgaaccacttagatataaacagagcaaataggtaaactattgcatggccagaagaccaaaaattactaacaactaaaactaatatttctacaagaaatgttaaaagacctaactaaatggagatgtatgctatagttatggactgaagacttaatcctattaaaatgtcagttctgtccaaatgtatctatgtattcaatacaaaccctgtcaaaatccgagtagtagttctaaaaatagatacaatctgatattaagatttttcagtgtaaagcatttaaaatattcaaaataattttgaaaagagcaagttggaaaaacataacacctaatatcaatattactacaaatgtagagttcatatgacaatatcatatttccattaaaaatagatatagaaataaaaggaatagaacagtaagatcagaggtattgtgtgtgtgtgtgtgtgtgtgtgtgtattcaattgatttacagtaaaagtgtcagggtaattaaatatgtgaaagaataaccttttcaagaaatgaagctggaacaactggttatccatttaaaaaaaaaaaataaccttgacgcttacattatgtaaaaaaatttactcaaatgatcatatgactaaactgaaaccatacaatattaagcaataataggagaaaatctccatgatcattaaggaatcacaattttcctcgataggccctaaaaagcaagaaccacaaaagaaaaaaaaaattgattaagtggactttgtaagatttagcttttggccaggcgtggtggctcactcctgtaatcccagcactttgggaggtcgtggtgggcaggtcacctgagatcaggagtttgagagcagcctgaacaacatgttgaaaccccatctctacaaaaaaaaacaaaaacaaaaacaagataaattagccaggcatagtggcgcgcgcctgtaatcccagctacttgagaggctgagcaagagaatcacttgatcctgggaggtggaggttgcagtgagctgagattgcaccactgcacttcagcctgggtgacagagcgagactgtctcaaagaaaagaaaaaaaaaatacttagcctcatgcctgtaatcccagcactttgggaggctgaggctggcagatcacgaggtcaggagatcgagaccatcctggctaacacagtgaaaccccatctctactaaaaatagaaaaaaatagctggatgtggtggcagttgcctgttgtcccagctactctggagtctgaggcaggagaatggtgtgaacccaggaggcagagcttgcactgagccgagttagcgccactgcactccagcctgggcgacagagcgagactccgtctcaaaaaaaaaaaaaaaaatatatatatatatacttagcataagtttaaaagttagcacagactatctttgctgaaatgagggtggtattaatagctactttgaaggggtgttgtaaatgtgaagggcgcactgtagaggcttctacagtgttgtccatgattcctggggctgtataccacgtttccataaagacgcatacattttagattcaattcccccttccttagcaatgcttttactgtattgatagctttaaacattacatacctattttttaattgtatgtttagaaaggctggggggtttacaactcactagttttcatagtcctgcttatgagagctgattagtcaaaggtcgaggcaagaaacattcttcataatcttgtaaacatgagtattacttgttattcacataattactgccctcgcaatcgcgattatgttcaaaacccacagagcgctgcaaggtatgttaaacagctaatatacttaggcaccgtgctaagtgatttatacctattgtctcatgttatctttatggaaaccttgtgaggcaggtcatatcctaaatttatagataaagaaactgtgggttaactagggccactcacttgtgacatgagtcaccctatatttgattccacaccaccctcattcaataccgtacaattagctggctaaatgcactcaccttcattcataatctagatatgatcaaatagatgtcctgtgacagaagcagtggcaatgaaccaggcctatctcattcttactacgtttcaaagttatataaaacacctgatccttcttgaaaaatctttggcatgtgaaaatccctgaaatatctttgatcatagaatcacaaaactagttagctagaggcaaagtgaaaatatttcaattcaactccttcctgtttgagatgcctcgaagtatcagatgccttgctcaaagtacgttggaagactagaggcttagcttgccaaattccaaattctatccttttgcagtaattccaactgtctccaataatatgctagatacaaaatctggggaggatgagaatgcactgtgaatcagaggaaaacaggcaatcctggagctttccttaccacacaccgagaaggatggtgaggacgtaataggagccggcagcgagtctcccggagccggtggtgtggaggaggtgggtgagccagaaggcaaatatcatcagcatcagacgcgggacagacagcttattgattttctttttactttagtcacgacgcaagtcggtaaatagcagatcatgtcgtgggagccaagctggaacctggcaacatcaagaagaagctaaacattgaagggaaggcttactcttgccgcaaacgtctcacatccatcagtctctcgtgtgcagctctttaggtcataattaggtaattaattatggcattctgtcaagtactgcaaggtgccacagtttcctccccagcgtcctatagttctttctaatgttcacatttagatgagaggaacaaggaagcttggttgtttccttcctgggaggaggctggtgcatgtacctccattatcatgtgctggtagatgagaggtgtaagactgggatgggtggaacctctgtttatggcccagcatctgctgagaaaaacctattcggcgttaagttcagaggtcttaacttccagacagccaggacgcaactaaattacaaactgtaactgtcacccaaacgtttttagtgcctcaacccatcagatgatgaaaggggtcatgggctgtgatcaccaggaagatctaaggctaccgttatcaaatgggtcaggaaagcttatgtttggcccctaaacgatctgcatgggtgtctcttgggcagcatcggtggcaaatgaacgaaagcatcgacttcatccagagaaaggcctgctaacttaactgggaatgagggtctgtgtcacgccaccaggaagttaacctgtatcagcagaggccctgggatagagggaatataaaatcgatggtagaaaaagaaaataagttatctgtctaggcctagaaaccagctgtggtagtgagggttctaattaatattacacatcttctccttatacatttcatccaagaaaagaaaaaaaaggaaaaaaaaaaaaaaaaaaagaaaaggtagcctgccagaatcctgaaaaatctcctcccagaactaatataagtagatcaaagcgcccccaagaggcagattgtagcagacacagtgtcccattgcccacacctaatccctttaggattagcacacccattgtctcagctgctggtaggtagatagccaataactcaaaacctcgttgcccttcttagcattcgcacttgggtgaagagagccatttgtcctagattaggcaggcctcatcagtgagcgggagataagagggtagaacggcttggaggatcagcggaggactttgttgtcactgtacagcagccaaattgattcctatgcccatcctgcttcctttaatccccaaaggtgttgattccgacagtaaccctctgtgttcctcctgtatacatcctaggaagctaaactgtgaccttttctctgtcccgtgcctttcatgctttgctgtagttttgtacttaacacctgggataattattcgtcagctttagtatgttttgtaggcagatatatgggcaatagattgttcccaattaattaatctgaaaatgcctatacgttgctgtaaattgtgagacacagtctctcagggataaaattctagaactgcactttttttttcttcttttagcactttaaacagatcctttactttgctttttgtttttaattactcacatgattaaatcagcccgaaggctattattgttttcttgaaggtaatacatcctccacccaactccccctacttctgaatgctcttatcatttcgttgcttttttaattgtttacatgtgatttgcttaggtagagctttctttgtaatttttcctccttgggattcttaaatatgattgcatcttgtcagttaaaaatggttagtatttcttcaaatttttccttctgaaatgtcttacttcgtgccttgtatatcttttaaacatatctcatgagttttttataatcttcatttttctattttctatcatttttggtctctgcctcaaatttagatattttctacaggctttctgctatttcaaatctgacattatatatacccaatacttaattttagtgattgaatttttcatttctaaaatttttgttttgacacattttcatgtattaagtctttgttgagaatttccctcccttcctctatttttgaatatatgaattataattattttaaagttcctgtctggaaagtctaacttttttttgaattttcctcttttttttttttaccccatttatttggtgggtggcacttagtctttgttttttccgtatattacaatttattgattgaatgatggacttctaaatgaaatgaagttgggaatcttgatgatgctttctttctgcaaagatgcttaaattttgtcaggcaagtcatgttgcagcaagtaagctttatcctctcaagaatggttctaggttttactgatctatttcagttttgtgtttaattctagataatggtcttgactcctaaagctaagactttttgggatatcgaagagatcccagggtgtttattaaggcccttcttggcaatatttgaaatccaattttcatctcctcagcactgaatgactgctggtatctctgctccttagattatattttgtgctgtgtttcgtggagttttcccagtgcatgaagaatatggggatactcaatgagaataaaaatgagaatatttgtatggagattttgggacttctttctatgtgattctctctcttccaagactttgtctctcataattctgctgtctggtggttctggaatttaatctctgacacttaagattcttaaatccactgaaattggtatttagtacttggagatatgttccctgcactgcacagtggaaaatgccctcagaaaaaaagtcaaaagtaatgtgttgctcacctgtgtattttccttgtctctcatattatggcccctcaggtactgtttgagttggttgctcttcaatgcaaacatataaccatatgtatcacatatgtatgtatgtgtgtgtatgtgcagttggccctctgtatctgtggttccatatccatggattcaacttactgtggattaaaaatattttaaaaatattgcatctgtactgaacatgtacagacttttttcccctgtcattttccccccaaaaacaaagtataacaactgtttatatagcatttacattgtcttggttttatatgtaatctagagacgatttaaagtgtgcaggaaaatgtacagaggttatatgcagccatacaccactttgtatcagggacgtgagcctctgcagattctggtatccttaggaggtcctggaaccagtcctccacagataccaagggaggactatattgataattttttttagtgggagagttcatctaatccaatttataagctggatctctgcctttgctgctaactttatttgtttatcttttacttcaatttggcttacacttcagtattctaaaatttttgttattctctgaacactgttttctcttatacctttctttttacatatggtattttctcttttttcaatacttttccttaccttattgactttgtaggggtttgcttgtcctttaagttagcactcagccatctttttttttttttttttttttttttttttttttagatggaattttgctcttgttgcccaggctggaatgcaatggcgggatctcagctccttgcaatggctacctcccgggttcaggtgattctcctgcctcagcctcctgagtagcttgggattacaggcatgtgccaccatgcccggctaatttttgtatttttagtagagagggggtttcaccacgttggccaggctggtctcaaactcctgacctcaggtgatccacccgccttggcctcccaaagtgctgggtttacaggtgtgagccactgcgctcagccaacctgtttcttttctcccaccaggatgaattggttgattttccaatatgatacctacaatttcggttgactgcttccataaatagaggattttcatcctctattataatcagatgtttatttttctgtcttcttctctagattgtgagttgtttttttaattaagagtgactcttttgtacgtttcagtatcttcagagcctactagtgcttgacacatgacatgtgctaggtcgttttgtagttggtttatcaatgaatatttttgcttctgtcactatagattttgtcttcaaagagattgcttgaaagaggtgacctttgagccctattatttattgaagagaagggcttgatgagatggaaagtctcttctgtcactatcagtctgggaatttcccagtagacaacaggcagtaatcccaggctttcatgttggttgaattatttggacatattaattatagtaagattacttaatcccaacaccactttccctccttaattcacatttcctccctacctcacctgtacatccttataaaatgcaacacattcattctaccttgactaatactatttagccttacatatttctccctttccccatactttgggaaattcaatgtatccttcaagggtcaggctatatttcctccatttcacgaaattttcctaaccactccatgcctcactgtttccttatgtctctgaatatatatcattaggctttctgagattcatactattatttgccaattttttttctggggattttattttgtccccataatagatgctgcttgaggagaggtagtagggattttatcttcctcttattttttcaacactcaatatatcagcacattggtgagcttacaagggaatcacaggaaatattgcccaattagatgtttagtcatatgtctttcctggctggaaatgttgcaattatattttctaataaaatattacccctactttaagcaatattatcgtaagagcttagtgactttgaccttatccagttttccatacctttaccactattttgtttacttagtattcttccttatattgactttaaattctattctatcaacactactcacctatgcacatttagcctcatcccaaatataaaatcattagttaaatggccgacttaagctttatttcttcctgatatctgcaaaacgttattttaaataatttttttctgtaccacctaaattctcctgcatgtcactatggctatactgaacatacgaggattaaggccgtctgatcttctttctactctgtcttcctgaattgcagaaacacattgtactgcaattagataacattcctggtgtgaggcagcttgggtaattaatccaagctccactacttaccttttgttccaaccttggcttttacctggttggattaattttcatattattagctttgaatacagatttgctctttctgtcttaactgttcagactgaaaagttagtttagtagtctgcctggccttttaattggactgctcctcattttgaccatgcatctccatctgcttcaatttagcccagttcttgtgaattgtagtaatggttacaaggtgaaatggaatcagacacatgtagctaaaggaagtcactaacgatgaaagctagtcatgcactctaactctgccaagcagtagcggaaagcgtattcacttatgcatcaaacccaggtctgtctgcgagtgatcctcagaaatgcatttcatttccttaaagctcaattttctcctctgagaaaaatgtgtgaatattaatatgtgcctgctggggtttatgtgatgattaagtgagaacagaaattaaatgttcttattattcctaccaaaagaaatactcaataactatatggcattattattattattatattattatacttattgctatatcagtaccactatttacaatgggcccaaatagctggaccaactccagatatttcatttcttggcaacttttagagaattcagagtgttgcctgctgtctcactctggcctggcatctgggactccagctctattggctgcttgtggaggcagctgtttcctacaaaggcaagtcttttctcagggaaccatgaaagcagagaaacacaaaacaaaaactgaaagaagtaattctgtttattattttttctgagatgaatatttgctaagaattagaaggcaggacccaagaatataggaattattcaatggaaaaagatatacagtagattaggaaaacacatattagtttgggcaggtgacatggcagcacccttcctgtcagggagaaaagagaaatgaatgttgagtagttcaccttcaaagggcaagtgagcagaggtctgattaatttctttattgaggcacatttttctccggagaaaaattcaccatattcagagcattaattccacatccaccagtttgctacttttgcacttgtcatccattaggccagagtttgaagtttttgatggttatttatcattggcaaaaggaacccatcagctgcaggagagagtaagcttttgcccatgacagtggggtgataaacattgcttggcctttttgctaattttaatcaacagtaagtagttgctgcttgctgaaagcacatggagaggtatttaagtgccctggtccatggtggtggaggctgagttgataaggaagccagggatcagacagcccggcaaagtgaccatggtgatgatcaggtgcagagtgaattgtcttcatcccagtgacataatccaagatagtttccatgagcattttcctgtgcatgaaaatcaattgcaagtagaaaagaagctgttgcttctggagatattgattaaaacattgtatttacatgtagttatttggccagatatctcagtccatttgggctgatgttacaaaattctatgaacaaagtggtttataaacaacgtaggtttatttctcacagttctggagcgtgaaaagcctaaaatcaaaatgctgggaggctcagtgctggtgaacttcctggttcataggtggttgtcttcttgctgtgttctcacatgggagaaggagaagcaagctccctggggtctcttttatgagggtattaatcccattcaagaggtctctgtcctcatgacctaatcaccctccaaatattattaccacattgaggattaggctttaacatataaaatgagggaggaaccatatcaacaatctgtagcaccagacattcattgagtactgggttgagaggcactaggtatttagcaatgcgagtcatctgggttgttcttgaggctgagatctcaaaaacactcaaaaagtcagaggatataagagaaagaagacaatcacatatatctgtgcttgagttccagctctacttcttatagccatgaaatactgagcaaatgatttccccttgctgagcttcaggtaaaatggacaaactaaagctcagaaatgagaagtaattttttaaatcgagttaataataatacctgcctcaagaagctgttttgaggatcaagcgaaaaggtgtttgtgaaagagcctgtattagtttattattatttctgtaaaaagttaccacaaacttggtggcttaaaacaacacaaatttattatcttactgtgctgctggatggaaggccaatgcagtacaaattggctaaagtcaagccgttggaaaagctgcattccttctgaaggctccaagagacaacctgcttctttgccctttctagttcctagaggctatctgcatactttgggtcaaggccctcttcctccatcttcaaggccaggaattgtgggtcaaatcctttttcatcatgtcactctgaaagcctcttctgcttccttcttccacatttaagaactcttgtgattacattgggtccacctagctaatccaggatcctctctcattcttaaggtccttgacttaatctgatctgttgagatccgtttgtcatgaaagggggttcaaggattagaatgcagtcatttttagggcaaacattattttgtctgctacagagccccaaacctatgggagttctgccgatggtgctattggcttattggaacatagtgggtttttattgaaaagttgaggagggatgacagctatgtttatctctctttcaccattgtcttagaagtcacttcacctttccttggacctagtctgttaagagatagggtagttcatttacctccatgccttgataggtctatttaaaatattttgtgtttaaaaagttttccatattttgcaaggctggtgtcaagctgccagatgtggggacaatgagccaaattgaaagttatcagtcaagctcttactccctgagacagtgcgtgcaagaggcagatgaaaatataggttccagatcctcagtgtttcgcttttccccatggaatggcaccaggctaggattggatgacaagcagtgcagatgaaggagtcgcctcactgctgagaagccatgaagaaaaggcttttgcctttttctggacccagggggccagaagaaggggttgggggaaaaggcaggagtggaaaaatattttattttcaattgtcaaataatattcattagatttatggggtacaatgtgatgttgcaaaacatgtatacattatggaatgttcaaatcaggttaattgatatattcatatcttgaatacttatctgtttttttgatggtggtaacattttaaatctgttcctttagctgttttgaaatatacaatacattattattaatagttaccatgctgtacagtagaacaccagaacttattcctgcaggctaactgaaactttgtaccctttgaccaacttctctcctttcccagtccacaaacccctcctaaagcccctcgttaccaccattctactctacttccatgagttcaacatttttagatttcacatggaagtgagattatgcagtgtttgcctctgtgcctggcttatctgacttagcatcatgtactctaggtttatccatgttgttgcaaacaacagaatttcctgtttttaagaggctgcatggtattccactgtgtttaataccaatttttacaaatccatctgttgatacacacttcaattgtttccgtatcttggctattgtgagtaatgctataatgaacagggaagggcagatatctcttctacatactgattttaattcctttggatatatactcagtaggggaattgctggatcctatgttaattctaacttttgtttttttgggaaacctctacactattttctgaaatgactgtactaattgatagtaccaccaccagtgcataaagcttcccttttctccacaagaagcgacagaattttgagtcagagtgaagaaaagtcaaggcctttgataaagaggccttgggagaggctcctgtgaagtgccttggaacttccaatatggaagtctctaaatggatttggctgagcctgagtccttgactgcaatttccttcagagaactgcagtgcactgactatgtactgggtctcgttggcaagtacagctttcccccataaggcctgtcaggcagagccctgtaattgcctgtggtcaggcctgaaagatcacacataggattttggcttgggccagacttggtaggtgggatgcattaaaaaacaaacaaacaaaaatattaattgaccacagagtaattgctatgacactttgcagttgtaaaatggtactttcttatggaaaaaagcattactcatttgtgggtataaatgacacttagaattgcaggaagtgatgtataagtaaccatgtttgtcataaaatgttatatactgacctttccccatgcaatttgcatagaattgctatagaatcaggcctggaattagaacttgaatcctaaaacccaagtccaggtttttgcttgtgaatttaggctgctttttggtaactgaagcagggataattcttttttttcccccttagtttaatgtatgtggtagcagaaaaagcaaggaatcttttggtctatacatgtagctgattttagtaggatgtatagattttagcctagagaaagatggggctgaggctagacaatcttttgtgatcattttcttcattcccatttggctgaagctggaacatttctggtggcacatcttccatgactttgtcctgctgggttttaaataattcacatgattgccctcttactatttttcctggaatcttattccaccatgtaatgaagctattaaggagttcttgacatgatactcttatgttcaattctggagaaattttcttttagtcagtttaacctcaataaggagatcaataagtataaaaattaaaaagcaagaaaagaaagtagtagcgaaaaaggacaggggtaagggagtggcattttgtttgttgggttggttttgttttggctggaggggaggaaggaatgtagacgggtagtgccaggacacattaaaggaaaggaagagttgaggagagagaaataaacatgtctctccgaatggatctgaggaggcactagcagccaagaatcaatagcaaattccctgtctaatttcttcagtctccgtgtgaaacaaacctcaaggttctgattttggtaacttccgtgcatgtggtccagtctcaggttgttaacttcaaattgatatttaaccatttaaaaatccatttgtacctatgttaatctgcgtaacaaaaactggaacattagcactggagagtttggggaatggagcgagaaaggtggttttgaatgagatttatctcttccaaatttaaaattgtaacatatctgttgcttttttcacctacaaccacttcactcccttcccctatccctgaaaactccctcctattctcagttttgaaactgtgagttctcaaggtactagatttctacaactaataggaggctggcaggtagcactcaagaaggctctgtcatttccagagattacaaaaagcaccagattctttcccactgaacccattagggtagtgggaagcagagtttccaggtgggtgccacaaagggtaaggcatctgatggcattcttggggtttgcttgtacaaagatactcaggtgtgggagggatgttcaatgaaatatttctttatatcaccccaaacagcaatgttttaagaggaatcaagacgtgtttcatcttacatccatttgatgccatagttttgttaatggtggaaggtgtccaggttcttggcattttgaacaaagaattggacaaaatgcacaaaccaagcaaggaaggaatgaagggatttattgaaaatgaaagtacactccagtgtgggagcaggcccaagcataggagctcaaaagccctgttacggaatttttgggagtttaccccctagaggattccatcggttatttggtgtatgccctatgtaaatggagacgatgaagttacaaggtcatttacttggtctacgccctatggagaggatatttcctgtcacagctgaagtgtgaatcgattggccttatgttccctgcctccagaccctattttcccgccttttactcttttgttcaccctccctccatctcctagcacaactaatgtcgtttttggaataaaattcgaaatctttaacagcagactgtgactgatctggcccttgcttgtctctccagcctcatctctggccatcttccctgcatactgtccacactggccatgagcaatgtcctaaagagtggcacatgcctccacacctaagaggcctccacatgctgcagtttccttgtttttactgtgctatccaataccatcctctttctccaatgaaacctcacttattgtattattgcttaattatcacatcctcagagaaaagttctgaccacccttactcccatactagatcagtttttctgtcataagttctcataagatcctatacgtttcccccaaagcaattatagttaatcacactattgcataactaaacacgcagatgtatcttttcctgctggaaagaaaactttatgaagacagaaccctgtctatttcactgtctggtaccactggtccttagggccgtgctgctacagagtacataatgagcagctttttgttggattagtcactgtatgttacaaccacatctgagaatgaatggagagcaactgcccaaattcaaagacctttgtgagaccattaaaaataattgaattgagaaaacaaagcattttctacatagaaacatgtgtgctgcctttttaagtcatcaaagaaatattccaactgtgtgctagtatattgttataattcctgtttatacaacagaacacccacactccaaacacatagaatatctctacttaatagctacattttctgttgtggatggtggacaatttctcctatgcttctgtatcttttcatatatgtgtccatatgtgtttgtgtttgtgtatattgtgtgtacgttttatttctaattcaatctgtaaacactaaaaaggataaatttacttttttacagcagaaagtgcactgttaagtaaactctattcagtggtgtgctggggctgggttatattgtcttgtgagagctgatcgtatgctctgatcaactttgtccattcatgtcaaatatgtaatacggagtcagaaatggtgggagtatttacatcatgaaaagtggccaacactagaaatcagggctattttttttgagagtctgttgctaagcatttaccagcaaaaaatggttataatactagttaaggttaacaataattgcctatgtcttgagaaaattaatagtttctcagagtagtctacagttaatggattggtgtgatatatcaattaagagatccaaattcatgtagatgtacagactggattagatgagtgaagggattccctgttagagataggcaaaatttctccacattcagaaactgaattattcaaagatgtgaatacagtgaactggtaaatttaaaatccagcatttacaggtgtcaattttaaaaagaggcaatgctagtaattttaggaggagaaatctattccagagttgttgctgggataaaaggacatgggtattgtaaaaatatgagggagtaaaaaatatttgatgggctttttaataggaagactcaggaacttgaaaattatgtaagcaaaagcataaaaattgcttaaaatagttattgtactaagtctgcattggtgaagagcattccacacaaagtggtagagacagttgaaaacaatgaatctatttcagaaatagggttttataatcacaatttttagaaaatgtatgagttggaattgaaagtttagccaagcatgatactgtaacaacctaaatcgaacggctaaagatccaataaaagatgatcagagatgaggtacagagctcagcccaaatctgtgggatctgggggaaatgatcccagtttcctgtgatgtcctcaatccttgtagatttcctttcacctagactctgctgtactcactgcctgttttacccaaaagacagtgagattttgatgcttctggtagtcattatcttcagaatgtagcatctttagctattctctttgctttctttgtgcatagcataaaacatggctgaaagttatgtcaagtgtgaaaacagtcattctctgcatctaagtcacatttcattattctcacctccagtactaataatctccaggcacatcctaccaatgcctcttatatattttggtcctactgctgaacagctttaaattttcaggcctggctaatttatacagacaccctctcatgcgatgttaaagcaaccacagcatagctctcctgggactaactaaaacaatgggattttcttttcttttttttttctttctttaaatcaaatagtaggtctcagccatgcaggtggtccagctttgttcactgctgtgtgttttaactaagcttgtttttgagtcatactgtaggttccctgctgagtgttcctgggtcctaaggttcttgcgggttctgagagggcctctgtcttctcttattggactctgtggtggatccttcaaagattattgatttttaaggtatttggtttttatagactgatttagttcacactaatttctgaaatccacccaaagttatttgtgtttctgtcttctgcttgtgaaaccttagttttaatatataagcacataatctgaagctaagaataagtgaaagaaaaagaccctttttcatttcattattgttattatatttttgttattgtggttttagctaaaaaattagcagagagctaaccagagaaacttgtgactttgtttttagacattaggttggatggcaaagtgaaatgtggtctagaatagagtctaatcctgtgttgctaccacctagctgaatgactttagcaagctacttcatcgtttcaggtgtctctttcttcatctgtaaaataaataactctaaagctcctttttctctaatattctatgaagacatagcacataagtcagaataccttagagagtctggagagggagacacctgctgtagtccagtgaatactcatataaggctgaaggaaagatcaatacatattaaactgtcaaaacgtaatgcctttattttctcctaaaaaggtgtatcatccatactgtatccatatataatgttactgcaacaaggcaagataacagaaaatagcaggggagataaaaacaaatcttactatttgtcagacactgtgctgaatgctttgcacatatcatcttcttataatgcaatagcttcatggggcaggcattattatcaccaccttacacatgagccttaaagaggttaagtaatttgcttaatgtcatgtcactagtaaattatgtatattgtattccaatccaactcactctgatgtaaataacactgccaccccaagagggaaagagactggtaccatcccatatcttttgttaagtggctggatctaacacctggataagttgattctggataactctatagtccaactctacagattctggagaactctatagtccatctcagtatagactgcaggagattttgttctgggatgtgtgaaggaacctggaactcacatgtatctttcagtagggtagctctctgactaaataagaaaaataaatcttgcttatatcagactgttgctatctgtcctttgggggagacagcatctctgccatgttcatcagcaatgtctccaaggccatgatccttcaactcatcatccagttttctgaggaagtggagagtgagtgaagttgattgattgaatggtcctgtgcctagaaaacaacaaagtgattttaacccagagccatgtactacattcagctcattgctaactgcaaagacattcatctataaagtaaactcactgggctgtttattcctttttattgtttataaaaaaatatttatttttatttatttatttatttattgtttttttgtgtgtgtatgtgtgtgtgcattaaaatgacaataaactggaattaatgtgcttactctgaacctaaaaagaagatacttggtggatactgaggtaatctttatgctttaccaggagggtatacacgctttgagttgtctgtgaaacactggagtatgttaagttatccatctatttttggagtggtattcaatgactaggcaacccttgctaatgtgatgaaggcacagattctccatgtcagccaaatcactcaagggaacgtcctctagaacttctaagctaaaagtgacctgaggaacactctagtctagttttacactggccagggatgagatgttgtgcccattgagaatctaatacaggactttgaccctcagtaacagatatccctctgtattcattggtaattagttttaagttgtaggaaaacctcttgagctagtttaagattaaaattaaaatatacttaaaggttaagagaaggtcacaatgaggcagaagacaggttctgagtctcaggaaggaatggaagcagaaaagggaaaggtattaggcatgtagggagctccttgggcctctcacatttctgctttatatgatcatttttgtcattctctggagactagcttttcccctacactcacacttaattacatggtagaaagggctgttctttgtgtagaacaagagtagttgttctatatcaatgaaagtttttcgattggcccaacttgtattggatgttatggtagactaaattgttggttctaatttgtcacttccttgtagaagaacaataacattcacactgttgttatgcctttgtgttgggtggatactatcctttgggcattggcatgtgatttgctttactttggctaatggactttaaatggatatggcagaagcaaaagttttaactgtgctcagacggttatccttttatgctccagtgatctgtcattagaagaatgtactctacattgccactgttccttcagcttggacctcagagtaaatgtacatgaagtagacataaaccaaatctgcaacctggaactaagccagtttacataacccagactaaagtccttttgcagacccataaaatatgaataagtacttgttgttgtaatcttttgacactttggcatgatgtaatatgtaatgttattgtgcaatagttgactgataaagaaattggtactgaaagtaaagtgttaacgtaacagatgtctcaaatcttgtctttaggactgttagtaatcggtgagaaaacactgatttgaagctaggaaagtggaaatccattttatgtggtggcaaaatatttggtaaatctctctcttacctgtggtaaattggaagacagaaaatattcttaataaagttgaacattctgccaggtggtttagaagcttaatattgaaaatattagttgatggctactaggtgaatttgataagttacattaagaaaaaaactgaaatcaggaaaacaatttgcaaatataattgataaggaatatatacagtccatatattctaagatttacaaagttaaaaaataaatctctttatcatttcaaatatctggacattaaaatgcaaagttttaggatgaattccaaattgtggacattatctttaagacatagcttaagggcaaaagaaagtcaatgacgtggttgtcatactgtttgttaagaacctctggaatgggtgttgagttttatcgcaggccttttctgcattttttgagataatcatgtggtttttgtcattggttctgtttatatgatggattacgtttattgatttgtgtatgttgaaccagccttgcatcccagggatgaagcagacttgatggttggggttaatcttttttgatgtgctgctggattcggtttgccagtattttattgaggattttcacgtcgatgttcatcagggatattggcctgaaattttctttttttgttgtgtttctgccaggttttggtatcagggtgatgctgacctgataagatgagttagggaggagtccctccttttctattgtttggaatagtttcagaaggaatggtaccagctcctttctgtatctctggtagaatttgactgtgaatctgcctggttctgggctttttttggtttgtaggctattaatcactgcctcaattttagaacttgttattggtgtactcagggattcgatttcttcctggtttaatcttgggagagtttatgtgtccaggaatttatccttttcttctagattttctagtttatttgcacggaggtgtttacagtattctctgatggtagtttgtatttctgcgggatcagtggtgatatcccctttatcattttttattgtgtctatttgattctcctctcttaaactaggtattgatggaatgtatctcaaaataataagagctatttatgaaaaacccatagccaatgtcatactgaatgggcaaaagctggaagcattccctttggaaatcagcacaagacaaaaatgccctttctcaccactcctattcaacatagtattggaagttctggccagggcaatcaggcaagagaaagaaatacagggtattcaaataggaagagaggaagtcatattgtctctgtttcctgatgactggattgtatatttagaaaaccccattgttccagcccaaaatctctttaagctgataactaacttcagcaaagtctccagatacaaaatcaatgtgcaaaaatcacaagcattcctatacaccaataataaacagagagtcaaatcatgagtgaactcccattcacaattgctacaaagagaataaaatactcaggaatacaacttacaagggatgtgaatgaaggacctcttcaaggagaactacaaaccactgctcaaggaaataagagaggacacaaacaaatggaaaaacattccatgttcatggataggaagaatcaatatcgtgacaatggtcatactgcccaaagcaatttatagattcaatgctatccccataaatctaccactgactttcttcacagaattagaaaacactactttaaatttcatatggaaccaaaaaagagcctgtatagccaagacaatcctaagcaataagaacaaagctggaggcatcgtactacctgacttcaaactatactacaaggctacagtaaacaaaacagcatggtactggtatcaaaacagatatatagaccaatggaacagaacagaggcctcagaaataatgccacacatctacaaccatctgatctttgacaaacctgataaaaacaagcaatggggaaaggattccctatttaataaatggcattgggaaaattgactagccatgtgcagaaaactgaaacaggatcccttccttacaccttatacaaaaattaattcaagacagatcaaagacttaaatgtaagacctaaaaccataaaaactctagaacaaaatgtaggcaataccgttcaggacataggcaagggaaaagccttcatgtctaaaacaccaaaagcagtgacaacaaaagccaaaattgacaaatgggatctaacgaaactaaagagcttccacacagcaaaagaaactatcatcagattgaacaggcaggcaaagaatgggagaaaatttttgccatctatccatctgacaaaaggctaatatccagaatctacaaagaactcaaatttacaagaaaaaaacaaacaaccccatcaaaaagtgagtgaaggatatgaacagacacttctcaaaagaagacatttatgcagccaacaaacatgaaagaaagctcatcatcactggtcattagagaaatgcaaatcaaaaccacaatgagataccatctcactccagttagaatggcaatcactaaaaagtcagaaaacaacagatgctggaaaggatgtggagaaataggaagacttctacactgttggtgggagtgtaaattagttcaaccattgtggaagacagtgtggtggttcctcaaggatctagaaccagaaataccatttgacccagcaatcccattactgggtatatacccagaggattataaatcattctactataaagacacatgcacacatgtttattgcagtgctattcacaatagcaaaacttggaaccaacccaaatgccaatcaatgatagactggataaagaaaatctggcacatatgcaccatggaatactatgcagccataaaaaaggatgagttcatgtcctttgcagggacatggatgaagctggaaaccatcattctcagcaaagtaacaaagtaacataggaacagaaaacaaaatagactgcatgttctcactcataagtgggagttgaacgatgagaacacatggacacagggaggagaacatcacacacccgggcctgtagcggggtcgggggataggggatggacagcattaggagaaatacctaaatgtagatgacaggtttgtggtgcagcaaaccaccatggcatgtgtatccctatgtaacaaacctgcacgttctgcacatgtatccccaaacataaagtgtgaggatggatagatagatagataaaaagaacctctggaaggattaagaagatacaatggtaaacttttggctgaagaaaaaacattcagaagtgtaaaaggcatgacaacatagaaacctgataaacccaatgttttcttaattgcagattgaaaacttttctatacagagagaaaatgggaatctcaaaattacaaatggcaaaaggacttcaagtgatgtataaaggttctttatttaccagctttctccagccttgcttccatcaagtttgacctgtgtttctctgacccagaaaacctgaaaacacagttggatttcttgtcctaggccacctcgtcaaaatctacaccttgcttgatgtgtctttctcttaggcctgaatagatggtaatacagtgagacaaagaacagctgagatgagtcaccgacaagctttcaaaaaggagatggctgtcagacagaggagacagaatgcctcagcattttattgtgttcatgaaaactgtcagaacacctagaaagacatttaaataataatgagttctggtcaaccaaatgaaaaacaaaagaaatgtgagtatctttcttttcctttctctttaatcattaaatgtgaaacacatagaaacatatagcattattgagaagggtctcatcaaagttttatttttccaagtcaattccacacttgataaagacatgcttgggcaccagaacaagctggatatagagaataggcaacagaatgctcatgtcttcatgccaaggctccactggcttgtaactcagacaaaagtcagatgccaaggggcttctgctggctctatctatagatactcagtagatgccaatgcttagatcttagtgtaggtatacatattccttttatctccaagagaaaagaatagggattcattaagctaatcagaatgaaaatggttagccacatatagcatgctagacttggagtcaaaagacctgtgctctgggacaaatataatctagcctatgtaacacacacatactcttaaattttactttttttctccattggtaaaatggggaataataagaggtaaaacaaaatgcttctgtattaatctaacacagaaaaaatttctcatcttttattgcttcatttcctccatgattctctcatacttattctggttttacagtgtaagatgcagcttatgcttggcccatgtctgttgatgttgacattctagatgcataaaaagcacttcctctggttctcctgtgctagattagtgagcaaagcagcctgtgctgaagtcctcatgggagaggtaaagatagactgaggggataggcatcattctatagtgtatgttttccagaaaaacaatctaaaacccacctattagaaattatgttctcctaaaagatatttttgttcaatcttccaccagggacaagactagaatattctagcatgcctcttcatttcttctttttctattcatcttctactgtctgtcagccacacattttcttccttgacctaataaaacagcccagtgactatgtttgttaacttgagtttgcacttggagcctttccttctagccaagaaacattcctctaagaaattttttagtgaataacattttctccattccattccattccattccattccattccattccattccattccattccattccattccccatcccagaacttctgtttaaaggatgcaggactgaagaccttgctaaacacacatcaaaacaaagcccctgttttcttattttaaaaaagacttactttttaatccaattgtcattagtacttttggattatttttcttaaaattgttcacaaaattttgttagtttaggccccacaaaacctaaattcaactgggccttcctcctatatataatctcttctagaatgactgacgagaagtctggaaatgcatccatgaggatgtccacttggttttcgctcaatatttccatgctgcccaaactttgctcaaggcaagaggggcactataacagaaaacggaaactagatgactgttgtcaatgtcccagagtcttacaggttcaattgtggcattgcctgtcaaatatgagagatggttagaggcacaaaagatgggtaggattttgtaaaaagttttgtttttaatttttgtggtacatagtaggtgtgtatatttatgaggtacacaagatgttttgatacaggcatgcaatacatagtaatcacatggaaaatgaggtatccatcccctcaagtatttatcctttgtgttataaacaatccaattatactcttagttatgtagacatgtacaattaaattattattgcctgtagtcaccctgttatgctatcaaatactatgttgtgttatcaaatactactcattgtttgtaactattttttttgtacccattaaccatccccacctcccctcagccccttaccacccttccagtctctaaaaactatcccgctaccatctccataagatcagttattttcatttttatgttccacaaacaagtaagaacacgtgatgtatatctttctgtgcctggctcatttcacttagcataacgacttctgcttccatccatatggttgtaaatgacaggatcttattcttttaaatggttgaaaaatacttcattgtgtatatgtaccgcattttctttatccatttgtctgttgatggacatttaggttgctttcaagtcttggctactgtgaatagtgctgcaacagacatatgggagagcagatatctctttgttataatgatttcctttgttttgggtatatacccaggagtgggattgctggatcatatctatttttagttttctgaggcatctccaaagtgttcttcatagtggttgtactaatttactttcccaccaacagtgtataagagttccctttttgccacatacttactagcatttgttattccttttcttttggatataaaccattttaactgaggtgagatgacatctcactgtagcattgatttgtatttctctgatgatcaacgatgttgagcatcttttcagatgcctgttgatcatttgtatgtcttcttctgagaaatgtctattcaaatcttttggccattttaaaataagactgttagatttttttcctatagagttgtttgatctgcttatatattctagttattaatccctagtaagatggatagtttgcaaatattttctcccactctgtgggttgtctcttcactcttttgattgttttctcactgtgcagaagctttttaacttgatgtgatcccatttgtccattcttggtttggttgcctgtgcttgtggggtttaatttaagaaacttttgcccagaccagtgtccaggagagattctccaatgttttcttgcatcagtttcatagtttgaggtcttacgtttaagcctttattgcatttgtatttgatgtctgtgtatggcaagtgataagggtctggtttcattcttctgcatacggatatccagttttcccagcaccattttttgaagagactgtctttttacccagtgtatgtttttggtaactttgtctaaaatgagttcactgtaggtgtgtgatgttgtttctgggttctctattctattccatcagttgatatgtctgtttttatgccagtaccatgttgttttggttatgatagctctgtagtataatttgaagtcaggtaatatgattccttgagttttgttcttttttgcttaggatagctttgcctattttgggtcttttgtggtttcaaaaattttaggattttttttctattgctgtgaagagtgtcattggtattttgatggagattgcattgaatctgcacattgctttgcacaccatggacattttaacaatatttattattccaattcatgaacatagaacctctttccatttttttggtgtcttcttcaatttctttcattagtgctttatagttttcattatagctaatatttcacttatttggttaggtttattcataggtatttaattttatttgtgactattgtaaatgaaattatttttgctttccttttcagatggttcactatttattaacctacaaaatgctactaatttttatatgttgattttgtatgttgcaactttactgaatttgtttatcagcttgaatacattttttggacaggctttatgtttttttaaaaaaaatataagctcatatcgtctgcaaacaaggctaatttgacttcttcctttccaattaagatttcatttatttatttctcttgtctgattgttgtaggtagaacctccagaatgtggtgaataatcaaggtaaaattgggcatccttatcatgttccagatcttaggggaaaggctttcagtttttcccaattaagtatgatactagctgtgagtttattatatacggtttttattatgttgagatatgttccttctatccccagttttttgagggttttcatcatgaagaaatgttgaatttttatcaaatgctttttcagcatcagttgaaaaaataatatagtttttatccttcattctgttgatgcaatgtatcacattgattgatttgtgtatgttgaaccatcttggccttcttcattttttggaaatactttgagtaggattggtattaattcttctttaaatgtttcatagaattcagcagtgaagacattgagttctggtctttttattatggctttgatctcattacttgttattggtctattcaagttttagatttcttcctagttcaatctttatcagttgtatgtgtctcagaatttgtccatttcttctagattttccaacttattggcatattgttgcttatagtagccattaatgatactttgcatttctgcagtattggttgtaacgtctcccttcctgtctctgattttatttatttgcatctgctctcttttttttttagtctggcaaaaggtttgtcaattttgcttaacttttcaaaaaccaactttttgttttattgatcttttgtattttcttcattttaattttatttattctgctctgatctttttcttttaccaactttaggttcagtttgctctagctttttcagttctttaagatgcatccttaggttttttatttgaagtttttcttctttatttgatgtaggcacttataggtatacattttcctcttagtactggttttgctgtatccctaaattttggtatgttgtatttccattatcattttttccaagaaattttccaatttcctttttaatttcttcattgacccactggttattcaggatcatgttaatttccatgtaatagtacagtttctaaaactcctttcatgaataatttctagttttagtccattgtggtcagaaaagatgcttaaaattattttagttattttgaatgttttaagacttgttttgtgacctaacatattgtctatttttgagaatgatccatgtgttgaggaaaagaatgtgtattctgcagctgttggatacaatgttctgtaaatatctattatgtccatttgttctgttgctgcttttaggatcctttctttatccttgcactttgggattttgattaaatgccttaaaggaatctttgggttaaatctgtctggtgttctagaatcttcctgtagttgaatattgatgtatttctctagatttgggaaattctctgttattatcttttaaaataaactttctaccctatctctctctctctcttttttttgatggattctcactctgttgcccagaattgagtgcagtggcgcgatctcagctcactgcaacttccgtctcctgggttcaagcaattatcctgtctcagcctcctgagtagctgggattacaggagtgtaccaccatgctcagctaatttttgtatttttagtacagatggggtttcaccatgctggccaggctggtctcaaactcctgacctcaggtgatccgccagcctcggcctcccagagtgctggaattacaggggtgagccacctatctcttttttttacctcttcttttaggccaataactctttggtttctccctttgaggctatattctagatcttatagacatgcttcattgcttcattttttaaaattcttattcttttgtcttctctggccatgtattttcaaatagcctgtcttcaagttcaccaattctttcttctgcttgatcaattctgctattaagactctaatgcattcttcattgtgtcaattgcaattttacctccagaatttctgcttgattcttttcaattattttaatctctttgttaaatttatctgatagaattctgaattccttctctgtgttatcttgaatttctttgagtttcatattttgaattctctgcattaaagttcacatatctctatttctcctggattgaccccagtgctttatttagttcacttggtgaggtcatgttttctgggatggtatggatacttttaggtgtttatttgtgtctgggcattgaagagttaggtatttattgtagtctttgtagtttgggtttgtttgtacttgtccctggggaggctttccagatatcagaagaacttcactgttgttatctgaggagtatctgctttaggtggcacctcaaacccagaaattttatggttcttgcagactcatggaggtaccgccttgatgatctttgaagagatccataaaacttgtctggattatgaggcagagtctcttgttccctactgttattttcttccaaacaaacagagcttctctctattctgagccacctggatctgcagatagcgtgacacaagcacccctgtgaccactaccactacgtctgtgcttggtcagacctcaagccaactcagcactgggtgtcacccaaggcttgctgtaaccactccctggttggtttaaggtgtaggggctctacgatgagccagtggcaatgtcagccaggcctgtgtccttctcttcaggagggtgggttcccttaggccctggatgggtctggaggtgctgttcaggagccaggcactaaagtaaaataccttagaagtctatctgttgttctattgtactgcagcttggctggcagtcagaacacaagacacagtccttcccaattttccctcccctttccgaaggcagaggtgcacccatgtacaccaccaccacaggcccatgtggagtattgccagactactgttgatgttttcttaaggcccaagagcactttcctcaccttgtggggaatgctgcctggcctgggactcacctttcagggcagtggtctcccctctagcccagagcaggtctaaaaatgccatttaagagccaagtcctggaatcagggaccccaagagtctgctttgtgccctacccactgtggccgagctggtacctaaggtggaagatagggtcccctttacttttcccttcacttttctcaagcagaggaagtagtagctggaaatgtgctgagtctctcacttaaagtcagcaagtcacacaatctcacccaaggcccactgtgtactacctgtgtattgctaatggttactcagggcccaaagattcttcagttagcagatgatggatcctgccagaactgggtccttcccttcaatgaagtggtttcccttctggacaagggtgtatctggaaatgttgtactggaggtagggcctcatgactctgactggtgccctatcctgttgtggctgaactggtatttaggatgcaagacaaagtccttcccacttttccctctccacctcaagcagaaggaaggggtctcttttggagccacaaactgtgcagcctagggttagggcaggggtaatgccaacattcccttggccaccctggcagttgtctcagtaggtcacatgcatctctccctgtccactggctctggaccagtgcagcactaggagtcatctaggagttgtagtctttgtgtcctagactgccattcaagttatttggggtcccacagtactttagcctgcagttccaaggcttgcaggaactcaagttctgatcactgggatcaacaattaacctctggctagggctggcttaaatgctttctccgtgggtggacatcagctgacttcggtccagttttgctttctgctataacagggcagtggtgagttcaatgtctcacaatttctgtgctctcctgcttcccaaagcgtagaatcactctctgaaccaagttgttgctgctggaggatgggagaggagtgttgctggcgattcaagattgtttttcctacctctttagtgcccctttcagctatttgaaattaaaaagaggtactgtgggttcttacctgattattggttcttatgaaggtgtgtagatagttgttaaattagtgtttctgtaggtgggggtggtacaatagatggagccttgtattccaccatcttgctccaccccaagtccaaaattctttggaaaggacattattttggcactagtaggaagtaaaatagggccattagaccttaaacatgtgtttggagttaataaaattactttatggggaaatcctaaaatccatagaaaagaaaactagtaattcactatgtagggtcactggagaattttaaaatgggcagtggggcagcacatactattttaaattgctaaccttgtctgttttagaagttgtcacaaagtaaaatagaagatttttttttttttttttggatttcaaagaaaaatgcatttcaaaggaaacagcaaatagagtgtttaaaatcaccgggtatactccaagagagaaatctgaaagcaaaactatcaattttaagtgaagggatgaagcaaggaagtaaaggctttctgatgctctatgagatgtgattattaatgatagtagaatcttttcaaaatgccccagtaggtcatgtattgtgctgttttacaatataaattcaaaacaaacacctgttgcttcttggacctcactgcctattgcctaaccaataccacattttttttcctcttactaaccatcgggctgaagtcccatttctgaaaaataaataaagctactgcaaaatagcaggaaaaggaacagtcttcaccccaacctctctcactataagcacttcgtattcctgtgtgtttgtaaggtttttcttaatgtttcagtgggttttcattgctttttttttgctactttcccataaggttgccaggtacatttaaggaagaaataagagttctatttctaacatggtctttaaaaatgaaattcagagaaataaatatttaggatcatttctgaattgttgtgttgtatatttattgtatctccataatgttaaaaattttcagttattttgctgttgtcttaccaacatgatgattatttgaacaaaaaatatatttttaggcactttgaaggatgcagagttgattaggatgtagtcaatgctttcacagaagttttaggtgaagaaaaataacacaaaagaaaaatatttataacgtatgtcaagttatttactttatctgaagttgcttaaaatgaccaaattcgagcgtacaagtctgtctgcccaataacagcaaatatagcatttgcacctttatagtctcttacatcaagaacagtacttggcatagagtagatgtctagttatgtctataatctttagaattatcagagagacagttctacagccatacagaatgtaattgggcagctaaaaatgcattagacactttactatcagggtgatgctggctgcacaaaatgagtttggaagtattttctgtaattctattatttggaagagttaacaaggattggtactaattcttctctgaatgtttggaagaattcagctgtgtagccatctggtccttgggttttgtttcttaggaggtttttttttttattactactgcaatttttcatttgctattggtctgtttctagtttttttttttcatgattcagtcttggatggtgtatgtttctaggaattcatctatttcctctaggctttccaatttattggcattataattgttcataatagttccttatgatccttttacttatgatcctatttattctgttatgtcgcttctttcatttctggtgttatttatttcttttcttttttcttcttagttagtctagctgagaagtttcccattttgtttattttttcaaataaccaattatagtttgattgatttttttctatagtttaaaaattctcaatttatctctgctctgatatttattatcttcttccttctgctaacttttggtttagtttcttctttttttattcctttgaggtataaaggtaggttgtttatataagctcattctttttttgtttgttttgttttgttttttccttttatagagacagatcttgctctgtcactcaggctggagtgcatgagcatgattatagctcactgcagcgttgatctcctgggctcaagcaatcctcctaccttagccccatgaatagctgagactgcaggcacacataaccactcttggctaactttttaatttttgatagagacaaggtctcactgtgttgcacaggctagtctcaaacttctggctttaagcgatcctcttgcctctgcttcctacagtgctggaattacggtctttctctctctcttttttaatgtaactgtttattgttataaacatccattttattattgcttttgttgcatcccatgagttttttctagacggtgtcttaatttttgtctctagatatttttaaaattctcttttgatttcctctttgacccagtggctgttcaagagtgtgttatttagtttttacatgttgattaattttcccatgttcttgctgttattgatttctacttttattcaattgattaaagacataaatataagacccaaaactgtaaaactattaaaagaaaacaaaagggaaattgtccttgatattggccctggcaatgactatttggatattacagccaaagctcggataacaaaagtaaaaacaaacatgtgggattgaatcaaactaaaagcttctgcacagtaaaggaaacaaaccacaaaattaaaaaggcagccttagctagccacatgcaaaacattgaaactggacccttacctttcaccatatatgaaaattaactcaagatgaattaaatatctaaatgtaagacctaaaactataaaattcttagaagaaaactagaaaaatctcttctggacgttggcctaggcaaataatttaagactaaaacctcaaaagcaaatgcaacagaaacaaaaattgacaattgggacctaatttaaataaaaagcttctgcacagcaaaataaactatcaacagcataaacacagcctatagaatgggagaaaatatttgcaaactacacatctgacaaaggactaatattcaaaatctataagaaacttaaacaaagcaacaagaaaaatcaaataaccccattaaaaagtgggcaaagaacatgaacagacacttctcaaaagaagacatacaagcagccaacaaacatatgaaataatgcccaacggcactaataatcagagaaatgaaaattgaaactgcaatgagataccacctcacaccagtcagaatggatatattaaaaagtaaaaaataacagtgaacatgtagagaaaaaggaacatttgtacactattgatgggaaagtaaatgagttcaatccccgtggatagtagtttggagatttcttaaataactaaaactagaactattatttgacccaggaatcccattactgggtatttgcccaaaggaaaagaaatcattctaccaaaaagacacctgcactcatatgtttatcacaatagtattcagaatagcagagtcatagaaccaacctaggtgtgcatcaatagtggattagataaagaaaatgtggtacatatacatcatggaatactacacagccaacaaaaagaaacaaaaccatgtcctttgcagcaacatagatgcagcaggaggccattatcctaagtgaattaatgcagaaacagaaaataaaatactgcatattttcacttataagtggaagctaaacaaggagaacacatggacataaagatggaaacaattgacactggggactccaaactgggagagggagagaggggacaagagttgaaaacctacttattgggtactgtgttccctatgtggtggtgatgagttcaacagaagcccaaatcccaacattatgcaaaacatccatgtaacaaccctgtacatgtatcccttgaacctaaaaattaaaaagaggcagcctttggattaggagaaaatattttcaaaccatatatcttataaggggttaatatccaaaatgtataagtagctcacacaactcaagagtaaaaaaccaaataaactgattttaaaaatgcaaagagtctgaatagacatttcttaaaagaagaaatccgtatgaccaataggtatatgaaaaggtgctcagcgtaattaatcatcagggaaatgaaaattaaaaccacaatgagaaattatctagtaccatttaagatagctgctgtctaaaagacaaaaaataaatattggcaaggaagtaaagagaagaaaacccttaggtatttttggtggaaatgtaaattggtataggcagtatggagatttctcgaaaaattacaagtaaaactgcctgatgacccaggaatccctctgttgcctgtatgtccaaaggaaatgaaattagcaccttatagagatatctgcactctcatgtttattgcagtgttattcacaattgccaaggtatagaaataatctgtgcctatcaacaaatgactggattaaaaacatatgttatatacatttatgcaacagaatattgtttagccttaaaaaagagataccaccatttacaacaacatggttgaacccagaggacattatgctaagtgaaataagccagccacagaaagaaaaatactatatgatctcacccatatgtggaatctaacaaagtggtgttggataaatagaaacagagagtagaaatgtagttaccaggggcagggaggggaaaaaatggtgagaagtaggttactactattaccattattgccttatttattctacctaagtacaaaaatctattgtatagcatgaggacaatagttaataatattgtattgcatacggaaaatttgctaagagaatagattttaaatgttcttaccacagataaaatggtactatggaaggtgatggatatattaatttgttttacatgcaatgacaatttataaactatgtatataaactatataaaaccattaaaacatcatgtggataccttctatatatacaataaaataaatttttaaaagaagaataagacacaatcactcaactcactggaggtggtgagatgattcataattcagaacaatgtaagacttaaaaaaaagtaagtccttacaaaggacatggacagacatttctcaaaagaagacatccatgcagccaacaaatatatgaagaaaagctcaacatcacttatcagtagaaaaatgcaaatcaaaaccacgatgagataccatttcattgataatccccaatacacacacaagaagatacatgaataaaaatatgctcactggagcctcacagccaacttgaaagcaactgcagaagcctagaggctttgcaaactccaaaagcgagtgactgctaggggttggtttaagccctaaaggagatgaatgctctgagtcaaacgacctctccaagtcagtcattcaaagtgtcctttcattaaaatctccacactgaggagtggtacaatctagacaaaagaaagtctaagataaaaagtgaaagacagaaacacgattaggagccatcaggaaataaggaagcatagtttgaacatcacaccaaaacaacagaaaaggatactctagagccacaaagcatacaaaaatgaatttcttatataatgaataacaaaagaattttgaaaatcatataaaagttcttataagaaaaagagaataagtagtagaataatatttctacctcagtgaaaacatgccagaaaaagatgagaattatatatcaatgaaagataaattatgtaaagataatgacacaatgtatataagtcataattagaaactcttggacatgtcttagatcttagtaaagaattatcaataaaatgtaaacaatcattttacaatcaaaattaactatgaaggaatggagagtgaataataatgcaaaaacaaagatgaagaaacataaaaaggatttgagaggaagtagtaaatttaaggatatgcaagaagattcagcatgatatattaggtatctcagaagaatgacaaaaattatagaaacagattcaagagtaaaaattataattctaagtatttttttctgaaaagaaaaaaacaggtttaaaattatgtgttaaataggctagttttatacttaaggaaaattgaccctgaatgaccaatactgagatatatttagtaaaatttctaaactttaaagaagaagaaaaagaaaaacaaacaaaaacacttctgagtatcccagcaaagttgccacaacacttataagtgaaggaaaatcagtttatcatcagtcttttctacaacaacagttgaagaagtgttgtttctagaagaaaatatagtgatacttttaatattcccaaggaaagaaaatggaatcaaaagatattttaatccagacaaattgacttccaaatataaagatggaaaataaattattatgtataacaaataactcagggaatattgtttctatgagttcttctagggatttcttctggaaaacaaactatagagcatcaaaaacaaatatataaagagacaataacataaggacacgaatatagaaaataaaataattttgatcatttttataaataagcactctgtgtgtgtgtgtgtgtgtgtgtgtgtgtgtgtgtgtgtgtgtggtgtgactatgcttgattcctgataggaaagttgggaggacttagaggattgccttagtgggagtaaataaaagatggaagtgagttgtgatggatgtgagcctggaaggtaaagagggatagcagggatggtactcaattcgaacggaacaaaacagtcaggtaaaataaccagagtagtcatgaaggaacatattcccaaatattgggagaagacagagtagagatgggggtcaaaattagagatttcttgtagaaaggctccagagatagttcttcccctgagctggagtgccccttagttagaggttgagatccaagaggctgactggagtggacaatcccaggctggaggcaggattccaaatggatgatggaacaaagaacaaagagtttaagaatcaagcaagacagcagcaaacagaaagtgatctcgaaatattttcacaaacagcattggagagtttttaactctcctttacttgtgagtgtatacgtaggccacagcaatatcaagttgttttaaagtttcagaattagcttcaaaactgtgggttgatggccatctaaaaagagggagaggcatctgtattagttacagttcttcagagaaaaagaattaatagaatgtgtacatagagagggagatctattttaaggaactggcacacacgattgtggaggctggcaagtccaaaatctgcagaatacaccatcaggctggagagagtctgaagacagttggctggcagaattcacgcttgcttgggagagttcagtctttttctattaaggcttttatgtgattggatgaggcccattcatattatagagggtaatgtgctttactcaaagtgcactgatttaaatgtcaatctcatctaaaaaataccttcatagaaacttctatactatgtttgactaagtatccaggcatcatagcctaaccaaattgacacataaaattagccattatagctaattcgcaattatagccaaaattagccattatatcatcctagattataacaacacctcaccttagtcaagaattgagattggaaatatactggacatgtatatcctgaaatggtggtttctgactcctgaattacattcaatgaccactgcttcctgtccttccatatcactgggaggaattagcaaaatgccacttccactttgccaattatacaactcattgtggtcgtcaattttttgatgttattttttcactttctttactcttcttatgtcctacacaccacttttaccctgtcagtatggtctattttttatattgtgtcataaaaacatgaagtatccaacccctctctctttgttgtttttgaatggaaaaattcaaacctggttagacctctctatatgtcaattactgccaaatatctatttccagctctgacttttactaacaattttacctgattccttagcattttcacatggaaaaaaggcactggaaacgtaaaatggccaaaatataacaactgattccctccataaactgtccttcttccatcttctccatgtcagtaaagccactatttgctatccgattgctccacctaaaaatcttaattttttgatttttcttttcccctcaaccaccacaacaaaatatcacgcatattaccaaattcattgactttttttacaacaaatatattgaatttatctactcctctgtacctctactaccatcattctgtacatgccataatcatctcttacctggattactacaatagtctcctaactagtctcccttatcctagtattgcccctaactcttccttacccatttttcactgggtagctaatgggatcattagaagtataaatcaatgtggttgtcatacttaaaactctccaattcaatgtttcatgcattgatggtgcaaatgtaaaatagaatagccattttggaatgtggtttagtagtttctcataaagttagacatatatttctcataaaacaagcaattgcactcctaggtaattatcgtagaaaagtgaaaacttatattcacataaaaacatttatacaaatgctcataaaagctatgtttgtaatagccaaaagctagaaacaaccaaacatcttttagtgggtaagtggataaacacaccatgaagtaaccataaaatggaaaactatccagcaacaaaatgaactattaatacatgcaacgactagggtggatttaaaggtgtaaataaagtatgtaacatcacttttgatgcttggctgctgactctttcaaactccactactccctcttcctctcttgccccatatgtgggccagctgataaaaaggcttgaagtctttcttttaatgctggtggaaagttaaaaccacacaaggtctggactgcacatgggaacctacatcccagtccatctttctatccaatcaacaaagccagtagctccttttttgtttgctcaagatagttccagacccatttggaagcatgccctgctctcccccaaagcctcatgatgtgagcattaaatgttttcatagccctttggttgatgtgtggcatttaaaccaaatttcaggtcaattgttcttttcgtctctgtaagatgagcataacaaaaggacatgatgctgagtgaaaaaaagccaactgcaaaatgttatatgttgtgtgaatccgtgtatatgactttgcagaaatgaaaaacagtaatgaataacagatcagtacttgtgactgtaaaggggtagcaggaaggagtttctttgtagtgatagaacagttctataccctgattgtggtgtgagttatataaatccatacatgtgatgtgatttcacagtaatacacacacacacacacacatacactctacatgtaaaactgatgaaatcttgtctgcagtttagttactagtgttttagtagtgttgtatcaatggacatttcttggttttcacagtgcgtaggtagtatagttatggaaagctgcttggaaggcatgctggagcactgtctgtattactttggcgacttcttgtaggccaaattatttgaaaataaaaagtaagataaaacaaacatttaaaaatcctcttcaatgttttctcatcttcctagagtccaatccagaactagaccttgaatttttgacaccctcagtccctgactccctccttaatctcatctcctgctatttctctcctttgcccactgaacagccacatcagccctcttctgttacccggagcatgccaggctcagtcttagcttaggacctttagaagagcttttgtctctgtcaggattattctccttctggattttcatgcggttctgggagaacactaaagacaaaataaaatcacagaaatttctagcatcatgtcatttacagtgcaggggaagagatgactattgatcaaatgatgctaataaaaaacacttgataaacactacaggcaagtagcacatggttctgtgagcatcaatagtaaggaggccagatctagtctgaagatgcagtgaaagcctctgtgaaggagtgacacttgagccgagatgtgaaggctacgctgaatttatctgcgtgaagagcagcagcagagagctccatgtagaaagaagagcatgtcctcacttataaatgggaactgaatgatgagaacacatggacacaatgtgggttggggggagggtacaacacacactggggcctgtctatgggagggagtgcatcaggaaaaatagctaatggatgctgggcttagtacccaggtgcagtaaactgcccaagttcacctatgtaacaaacctgcacatcctgcacatgtaaccccgaacttaagagttgaagagaaagaaagaaatagagagagagagaaagaaagaaaaaagaaagaaagaaggaagaaagaaagaaagaaagaaagaaagaaagaaagaaagaaagaaagaaagagaaagaaaagaaagaaaggaaggaaagaaaaaagcaagcaagcagacaggaaggaaagagagagagagaggtaaggaaggaaggaaggaagatgtaccaaggtcctgtgactgatgggatggtgggtggagaggaaagaggagtgtcacaagttgcaggataaaatttagggacctaggaagaagccataacacttagaatcttaaagaccatatcaaggatgattttgctatgatccagatgacaaaagactcctcataaggctggctagaaactaaaattccccacttagcaattcattcttttcaacttagagtctaaacacatatgggagggaattattctgatgacttgatgtaaatgatttctctgaaaacagattttattcggggaggagtgaatgctttctcttactaaaatcctgagcgaaggaaaggaaaatactgggtggttacttcacacttcagtccatagaggcccttatagcaatgcctcagtgggagcaggagagtgacatatctcctagttgttcctagtggccaaaacctttcttctctgtgaatggtaaggatcacatctaggacctggaggtcagaaagcagcagccctagagctatctatgtgttcagaaaaaccagcaagagctcaggccagtgtgatgtggtgtgtctgcagagcagctgtggagcctgtgtttttatactttcataaattatgtgatacagggaacagctattgcttggagctcctgagtatttgaaaataagagtgacacaagatttggctcaagttagccaggttgctaagcaattatgggcatattgtgattctagatttcaccttcctctgtctcttcgggttccttgaagtgttacagtttcttttatctttcgtttctcctgcccttcttcttgatttttctgtttcctcctatcttccttttgtcttttccccttattttgaaaaggaaagtcacaggtgtttgacaacccagtgctccctgtatatcttatagtccgcagtttgatcatcaacaaccagtttccaaattttacagatggtcactgtccacaggcataagagtcagttataccttcaggaatacctagaagcttttttcttccagttagtcccagaaaatataaacctcctctcacttcatatatcaccccacgcacctgtttttcaaacccctgctcttttagattttaaggcctctgatgcaatgacaaaattcatgagggtgccttgaaaaccaatggcaggccaggcgtggtggctcacgcctgtaatcccagcactttgggaggccaaggcaggcagatcacgaggtcaggagatagagaccatcctggctaacacagtgaaaccccgtctctactaaaaatacaaaaaattagccgggcgtggtggtgggtgcccgtagtcccagctacttgggaggctgaggcaggagaatggcgtgaacctgggaggcagagctaacagtgagtcgagatcgtgccactgcattccagcctgggtgacagagcgagactccgtctcaaaaaagaaaaacaaaaaacaaacaaaaaaaatcccaatggcagagagaggctgccccacatgccctggctgagaccatccagttcagcgggacggaccttgtaggagtatcacttcaatgggtaggatgtattttctagtgcagtgattgattacttcctctataaattaaggaaaacctccttagctgaggagtgtcttattaagaagtctttcaagcactaaatgctttcagcattctctgggcagtaatggcattgctaaagtcatggaaaaatacagcgcttccctttgtgacattaacaccttcctaaaaatcaaaagtttacttgctaaggccacagcagaaaggatttaaggcagtgtctgcaactccaatcagtagccatatcttccttggttctcacttagcatggaatctttgagttcttggaatgggatccaaagtttagctgtttgaaaagccaaatatggagaaattactctttgggtacccaactgcatacattgaaatgcataggttttctcttgtgtttttatgtgggcaggaggatatttaattgttgattgatgcaggagggatggggaaagaggggatggagcagagagaaatgaggggagcatatctctgcccagctgcttggctcagttttggttcctgaagagggagtggttaggggagactgtgaagaagctattttaattggagttctgtgagtccgtggtcaaagtagcataaattgtgagtagcagctcagaagacacaatgctgtgtggagcttggaaagaaccatttcccagtgctgcaggaactttgggactgatggattttggagcatggagcctggttccccagatacaggcattagtgttctcacaagaacagtaaatggaaaggaatgagacagagaaggagagacagatcagaatagactaactggctgatagatggggcaatccctggagactcttacagattcttgggagggttctgatgaggtattttgtctactttattctcctggaattaagcatcattgaggacttaagtaacattaagcaaagtttggggcccttatgtagaaagagcataggccaagatactaaagttctgagtttgggtcctgctttgactagtaatggaatgtaagcttttgaataaattagttcctttttttgtggctgcagttgttttttcattttaaaattaagaatttggggctaaagacctattagcttctttcagatctagtaatctaaaccttttttcacttctaagctaaagagattcttgaaaatattagaagcattcagatcaaggtgtttccatgcttacacctgttcagtcagtccccgttgcatagggaatgagacctgagcctggctcatggtctcagggtgcttctgccctagcccttttttccctctctggtctctctactatttcttctaaagtctccttgctccagctgcatgggccttctttgtattcttttaatcttctaagttcattcttacctctagacctttgaagattttctctcctctggttggaagactcttctcagaggttgtcacaagctggattcttctcattatattgagaaatagttcaaatgtttgtcagaaggatctataagtaaaatcataacccccacccagacgttgtctctcacattttcctgttttagtttattcatagcgctcttgatattctgtaattatcttgcttgtttgcttatttgttctaactcttcgtcactgaaaattaagccttttgagaacaggaaacttgtttgtcttattcagcacttagaatagtggccaacctataaaaagtgtcaaaaatccttcatttaatgcatgaaataaacgaataataaaaaactcagcatcctcattattgactggtcacaagagtgtctcagaagcaatagcgtctatagaaaagggatccttttaaactttagcttagatttgaggatatcgtttactctttctatgtttttgagtacttacacataaaataggtgacttattcacctagatttcagccaaagtgaagtctgaaaacaacaaaggaatgttttcaaatcatgtgaataagagtaacatttacggattacttagtctgatctgggccttgtgcaaggaacactggtactgtttatctcctttcatcctcacagcaaaattgttatacagatgttttaattctcatttttttcaggtgaagaagcagtaagtcacttttccaagcctcatagctagtgaataacaggttgagaattgcaggtcagagaaactcagattttgtgtctctgccagatggcttcccacatactttataatgttactgctatgcctgaaaagaattagttttatgacattttaggtccaattgatgctggacgtaactccatgtggagcctaaccttgtcttctatttctggcagacaacggagaaaagagaggtgttgtcatttagaggatatataaaaccaaggtctttgccacttatagtcaataaaatcttcacaatgcattttccatgactgttctggataaattccagtgggagcaattagctttaacacctttaaatgtctgcaatactttcagttgtttagtgtattctgagtgtccacctaatttgtagtacattaaccacgaactgtgaatgtcaatttcctccaaactccagaagagaatgcatcccaaggaggaagaaataaggcaaccaatatattgcaggatatatgatggatacatatgaaggatagaaactcatgagagtgaaaagaagggagaagaagagggaagaagatacaagggaaaggtagaagagctaaaaaaggaataaaatatgatcataattataaccataatcatagtaacaaacatttattgagcttgaatgattattatgttctagttcatattctatgagttttcaattattaattcatgcacccctcaaaacaattctatgaagttggcaatattatccacattttgcagatacgcaaactgaggcacagaaaatgtaagtaatttggtcaaggtcactgatatatgcaagaaacagatgccatatgcactggatgtagagtctgcatttttaagcaaaatgatataaaatctgatggcatggctaaccttaaatatgtttctttgaggtggagttatggagagatcgttgtttgcctgtgtgtatggtgcattaaacaagtctcctcacctcaaatatctttctctttaggccatcaatgataaatgaaacatcttaaaagatgtatttcattgtaataactactgtataacatactgttttaatgagaacacggtatagtttgctatgcatattgagtagctctgagtatctctcctctcttctgggttaaaaaaatcaaagagaaatagggagaggcaccattactagtaaacctagaatggagaacccatcttagaccagaggattgagaaagcctttctctttctttccctattgaaatgaactgaactctcacctagtgacaaggtgagaacatggaggatggtagatttactcttgcaggtctagcctggtcctctcaccaaatgggagatgcagccaaaccatttccagggcttttctctccataaagcatgcagcacaggcaagaaattaaaggtcaggagattgggcttacataatcagataaatcactcctcttattaaaaagaaagagtgaagggtggagccatagaggatgggaagcacaccttcaatacccttttttttattattggaatgaaagaaagcaaataaacagcactcctcatgaagtaaaacaatcctttccaactgacaccatccaagaggagatagcaatgaacaggcacagaactagaagttgaaatgccttggtgtggaggaactggaggatcctgcacatgggtatcagttgaagaggcctgaactgtgaatggatcctcttgagtgcccggaacacagcatgaaggctggatttgactgtggtgtgactgactgtgataccacatagaggtagaaagttgaaaggagaactggagaaatgctaaagataacctgttctcctctttttcttaattttactgttggcatctgacgctagtgtaaaaagtagactgaaaagatcatattatattattaagaataacaactgcagctgccatgatttcatacatttttctaagcagcaacttatatttagttacttctgtatatggatactaaatatatctgtcataacaaagtaatgggtggttactctgatcattaataattcttaaggtagtcaatgcaatattgttaatatattggccactttgaatgacagggtacccaggaaataacatgtcattccctagttttccattgccagttggtgataattgcaattcagtaaaaaacatagaatgaagtattctggtgttttttataataatgtcagtggaaacaagataagttggtattatagatgccattaaacattattcagataggaaaactgttgtgaatgtaggaggtccagtttgccttgttgaaaatgtattgagcttctcttctcagataagattttttgtttgaatgcatgtgttcctccaaaattcatatgttgcatttaaacctgccggtcatggtattaagtggggcctttgggaggtgattaggacatgagggcagagccctcataggtgggattgatgccttacaaaaaaagcttgaggaagagaattagtcccttttaccctttcacctctcaccatgagaggacacagtgtttgtcctctttggaggatacagcaacaaggtgccatcttagaagcagagagaaagtcctcaccagacattgaatctgcaggcaccttaatcttggatttcccaacctccagaactgtggaaaataaatttctattatttataaattacccaatctctactattttcttatagctgcagaatggactgagacaattttgtcatctcaactggtgaatcatttcactaaagatttttaactatcaagtgtttttcagagatttttcttttaggaatttatatgcattgattattttgaaattatacatacaattggggcaggtggtatctttttacaaattaacattttcacaaaaacattagtgtgtatacatcttgaactctttcggcaggaataataatttcagatgacaatgtatggatggactaaagtggccactccacaaatttataatagtgtatgctggtgtttacaagctaacaggcattgagacctgttagcttttcattttcttttctttgatttatatggacaacataaattaatccatacatggcatcacagttaatgggaatgtgtactctacttgttcaattaaataaagagatatggggacacttttgtttcttccctatgtaactattaaatgttcatggaataaaaacgcatggttgaaactattttatctttacaggttctgtacattagtgagttttgaatcatttatctctttttctgtttttatttatctgtgacttctcatgcagacaaattagagggttggtaaacaaacaggtccacagattgtcagagttttaggaaacttccttaaagatcagctgggtctcaggttgcaaaacctgtctgctacaagctcatgcagtaagttggaggcagagtagaaatgacaactcagtttctctggactccaagatattttcattatataatccttgttggtatatttaccacagtgcaaagtaggtaaacatagctttatttatatgactagcccctattatgtaccagggactgtgctatggcactggaacacagctagctgcgagcagaatagacacaatccctgaccttggggtaagaggtgagatgttaagacatcaaacattactgtaaaagcaatagaaatctattgaagaatctgacgcaaaagtttgacagggtcagagttatgtactactagactcttactacctgtctgcagaatggaatagataaacaaggctataatcagagagtatgacaacagatgaacaagaattatgatgccgaagatgaaaaaatgtttgggaaatacattttggagagtgaaaccttaatttggtgtttacttaaagacaggagagatacaaaaagaggagccaaaagtaacttcttattttctgaattgagtgactttgttgatgttgttgattttcactgcagggggaaagaatgttttcagttctggtgatatactcagagagagacgtcctgttagcagtgggacattcaagttttgccataagctgtggtatctagattatgggtagttaactaagctgtattagtggaggtgttcagcaatagatcaactatagaatgcaaaggaaagaagcttacagaataacaagtgaaggatgaaaaaaggggaaaaaaggataaaatgctgtacaggacactgggtattggtcacagattaaaggaaaaaattaaaggagtcagtttatgaaagagggaactgtccgcagtgttaagtaatgtcagagaataataaagataagggctgaaaacagttcacgatgttttagaaaaaataacttatttttgacaacggagtgagaaattattatgatattatgaggaaaataagctgaattatagtgggttgaaaaatacatgactacaacaggcatatatcaatttctcaggaacttcctttttggatagtgaagaactagggctatagaggggtctatgtgatcctagaaaggctttctaattatttaaaaaaatatttagagaagtggccaggcatggtggctcatgcctgtaatcccagggctttgagaggccaaggcaggtggatcacttgaggccaggtgttcaagaccagcctggacaatatggtgaagcctcatctctactaaaaatacaaaaattagctgggcgtggtggtgcatgcctgtaatcccagctcctctggaggctgagacaggagaatcgcttgaacccaggaggcagaagttccagtgagccgagattgtgccacggcactccagcctgggagtgagattctgtctcaaaacaaactctatcatctatctatctatctatctatctatctatctatctatctatctaatctatctatctttctatcgagagagaaagagagagagagagagagacatataagcaaggataaaaggtggaaaattaacgaagaaaacaaagtcccagaagggcaggtagagaagattttcaaaatataagtggaatgattagtcttggagggagaatggacacatttcttactgaaataagagagaaagagaaagaggtgtgtgctgatggaagccatcttatgggtgctgggccagtatgttgggactttttaaaaaggcttctatttttttctgggatttggagctagcagttactgatggaggaccacaatttgtataagggatttcctgtgcaaagatgcagggttccacctgtattacccctcagtcctttccttgcgtgtaattttacacaccaacaaaaatgaattctgtgaaagcaacctggaagacagatgtcacagccagcaataggtgccagacctgttgtgaagcaatccttctgactggttggatagcaaatttttagaaatctttagaaattgcaagctgaatccataaacataatttcatccacttcttgcgcagttttatgcttaagaccatgttgaagggaggccttctgctccaaagttatgtgattgtatactcctcacttagtttcttattcagaattcttatccataatatggaggaaatatatacctcacagagatattgtgaagatcaaaatagaacatatatggacatttctagtaagtattcttcacttaacaagcaaataaatcccaacaccaactaccttaaataataaatgtaaaatacaagtaggagatgaggctgtctcatggaattcaaggataggaaacctgccaggctttgcaaacaactagaaccagggacttcaacgtcttgtccttcaacaaggatttgttccttgtctcttgtctctgatcacctctccatagctacttcatttccaccccaccttttaatgcaaaatttccccttccatctctctggtcattggacataaaatatgttcatcgatttccagatctttattatttctcccatggacatggaaaccatgagcaaacaatctcttttttagtccaaaaaatgatgggaagaaacttgcatagtttggtcttagtgtctcatctgaatcaatcaaatgttagcaggaattcagaacaacatgcggcaaaattgtgcttctttatggcaaccgtgaggttgatggtgggggtgtgggtggggtgggggctagtcccacaaaagtgccaatgtgaacagaagaaacaaaacatcaatacataaatcacgatgcgccacatctgtggatgatattggtgcaatcataaataattggctattataagactatacattataatctattatccactagtccctgtattcttctggattgtttttttttttttttttcaccttacagttacattaaatggacccaccccaagtcttttttctactttattgttctattttatattttatcatagggtactgaaagtgtcctttcctgccatctaatggaactatttccacaatcacacacacatacacacatgcccacatatgcacacatacacacatatgcacacatacaccagacacacaccaaatgtgggacgggagactcccatctacgtttctatattctcctctgattagcatcttctccctctggctgaggtgctcttggagcttcttgctaaggagtattgttctgatgaacatcaaagtattcatagtggcaaagattccactgactccctatcctgcaggaaattccaatttttgtcacttgcttctttaattaaaaataaataatataaataaagtatgattcagaagaaacaagaacaaattataaagcatttgtgcaaacatagccttaattaaacatactgtttcttaagtatactaattcccttctacaagtctctgaaatttgtgttgactttcaactgaaatagtctctccccaaagcttagtaggggctggtcacagtggctcacgcctgtaatctcagcacgttgggaggcctaggtgggtggatcacttgtggtcaggagtttgagaccagcctgggcaacatggcgaaaccccttctctactaaaaaaagcaattaagaaaaaaaaagtagcggggcatggcaggagcctgtagtcccagctactcgggaagctgaggcaggggaatggtctgaacctgggagacagaagttgcagtgagcccagatcccaccactgcactccaacctgggtgacagagcgagactccatctcaaaaaaataaaatgaaataaaaaataaaaaaacttagtagggcttcttccctcacgcttgtagatctctctctattcaaatgtcaccttttcagagagacagttcttaaggggcacttctgggaattgcctgtcacattaattcttctttattggacttcctcactgagactacatgttccatgagggcaatggtcttgtctgtttatcattgtatccccagcacttagaacaattcctgacatatagaaacactcagatattttttttgaagaaatataaaaataactgacaaagagaatctggacctttcagaaacaatgtaaagaagggattaaacaatgtaaagaagggattaaaatcctgattatatagcaaaataacctaaatccaaagcagctttatgatagacctgatattacaccactgataaggactgagaaagactagaacaaatagtgattataccttgtttttccctttaagcagcacctattgcggacaggatcttgatgaaacttcactgaaatgctacagtcagcgtgtacaggaagttggattggcatatggacctttgagtcacagaaatatggtttccaatacaagttaactattgcattattatgcaatagttatttttctctgggtcttctcctgaaatgggagtaatactatccacctcatagaccagtcgtaggacctaggtaaatgtatggatgtaaagtgattagcccagaatgtagtctacagaaagacttcaaaaatattgactattactgttatcataggatgtgaatgagagaaacaaggcttctatttggagttcagtgaatgatctgataggcctctgaaaaaaacatatgcaaagtcccaggtctggtccttgacaagaaaatgccgttgtaaagtgatagtggatgggaaaagtcactttcaacctggccgtgaccagaaaaataaaatggtaaaggacttgtcatgctgtctcaaagacagggatcccttctgatcaagtatcagccagaaagtgctcctatttggaatggtttacagttctctttatggggcctttatgcagactggaaaaaggcactttttccaggataacaataattagaaaaccctgatccttcagtgtcaagggatcccatggggaccaccctgcggagcgagtgaggcagaggttcctggtttggcaagaagagaggtcctggattaagtttcagctttatgatctttatgcccagggaagctttctgcaatatcctgatcctgcagcagttcccagagctggtgtcacccagtgagcctagcctacacgacacagtaccataatttgggaaaccattacccattgcttctgaaaaatcagaatatggcagagaaaggataaaagcaggaattgtgaggttattcagctgtagactgcaacttcactagcctcctcttagagggaggctctggaatttgttcgagagagaagttgagcttcgtttagacagttttgttgcaaacaaacacccgcagggatcgaggccattcttccctcccagattatgtggacacttatttatctgtttttattatttctttttctataaaaattgggaggctcttgttgagatacagtgtttgccctctggatgtgttttctttttcctgtaaacactcctgtctccatagttttgcacttgttggtcaagggaatgattgggagcatagaaactgaagttccattttactcattctgccaggaaattgtgaataaattgggacgacaagaagaactacaatttctgcccatgtacactattttctgatattgttggggaatttggaaaatattttgtctaattttctgcactttaactcaaattggcataatgtgtcatgtttctgcgcctgctcaaggaactttgtggctgttgtcaattgtatccaatgtaagctctctggctggatgtcgaagtttctgtttgttggcttattctacccaattcaccattatttttccctttttcagaaaactcttttccaggcagcttagtctcttcattgccagacatctttgccaaaagtatttaatttattttttattttaaaaatccaatttagttatagcaaataatacatgaattttgctgtggaaaaatgctaaaactttagagagcttgtgtggcagagattggctggttttcaaacaaatctgtgttttcttaatggtccatgacctaacatctaatttactccacataaagcatcttccagatagtggtgttgagaagagggtgtgcttcccccatttcctctctctttccccatcagtcagccgaggatgacaggataatttccaaattacatgttgaacatggtgaagccataacttggttagccatgatttcttagccaccactttaagaagagccactcaagagagctatacagtccagaacatctacattgaaactttcttgtaagacgtagaaaaaataaacctttcttctcataggactctgaaatttgtggactgtttgctatagagatatctgattctacaggttgcaagaacttccaaggttgagagagtgaattgatactgtgtcccttaattaactgaaaaaaatttaaccccatctccataaaagtaattagtaatagccatcaaataagaagagacttatagaataatggaagagccctcaaacttgtctggctattagaatttcccaggtaacttcaaaaaataagaatgcctggattcatcccccagatccattaaaccagattcactgatttagacctagcgcataggtctaaatcagtgttagcattaaaaaaaataaactctccaaatgaatctaacatacatgtaggattgagaactgaatttgatggactttgaaaacaggtggcacatgaaagaaacagatgagtgtagagggaggtaggagccacagtgagattgcgcttctcacctagatcccaccagccctgtgtgtcaacaacaatttgaggattcttactaatgcactcaattggggaaaaaagcatgattaacatatataagtttcagcttttttgttttacttaagaggattggaacctggtgaaaaaggtagtgaacagactgcctctaatgaaggctgagacttcagggtgatacactgaaatatggacccaacagtcccattactgggcatatatccaaaggaatataaatccttctattataaagacacatgcaaacatatgttcattgcaatgctattcacaatagcaaagacatggaatcaacctaaatgcctatcaatgatgaactggataaagaaaatgcactacatatacaccatggaatgctatgaagccattaaaaagtatgagatcatgttctttgccaggatatggatggagctggaggccattatccttagcaaactaatgagggaacagaaaaccaagtaccacgtgttctcacttacaagtgggatctaaatgatgagaacacatagaggagaacaacacacagtggggcctatcagagggcagagggtaggaggaggttgaggatcaggaaaaaataactaatgggtattaggtttgatacctgggagatgaaataatctgcataacaaacccctatgacacaaatttacctatgtaacaaagctgcacatgtacccatcacctaaaaataattttttaaaaagaaatgtggaactgacgtcatttctctgggttccctctaccaaggtgacataggtggtgggggataagatgggtaggtggggagaaagaaaataaagaaagaaaattaaaaaatcatgaaaaaataaaaatagatctaaaagaaaaatatatttcaaggaagagaggaaagttattcacaacttctcaactattacttcaaagaaataatttacttcataaaaataattttcctttaataaaataactgaaagacaagataaaagggtgacagaaggagatggcagagaacaccgcaggtttgggtagcaaattcaaaacaacgtcaaaagtaacacatgaatggaaacaaggaatgacattgacatcattttgaattgaattactgatggaaaggaaatgtttacaagagcatataaaataaattgataaacatctttcaatgtaaggataactggagtacttaatatgaaatataattcaatcaaatatataataaaacaagtccagaattttttttttttttttttttgaggtggaatctcactctgtagccaggctggagtacagtggcgtgatctcggctcactgcaacctctgccttccgggttcaagcgattcttctgcctcagcctcccgagtagctgggactacaggcatgctccatcacacctggctaatttttgtatttttagtagagacggggtttcaccatgttggccaggatgaaatgtttagaatttttaaaaactgtatcctaatattgaaagctcatgaaatattccatgacaatttgatataaaatattcaagctgctagttaaactactgagcatcaagaatacaggcagacatttcatacatcaaaaataaaaaagcacttataaggcaaaaataaatcagatgagcctcagatttctctacagcaacaatgttctgcaggtaggaaattatggtccaaaaatattataaccacccaaggtattcaaatataaaggcaacaggtaggccctcaaaaacatgaaatatctcagggaatgaagcatccacgaatctctctaattaaaagaaatccaatgatcaaatcttgtgatttaagatattatgaaaaggaatcttacaaaaaatggataaactgcacattcaggatagatggcgggcagtaaataaatgtatacataagacaatgtcaaattttgcttacagaagagactattaaaagaaagtttttggtgtaaaataaagcatcaggagggaagaggtaagggagaagaagcaagtctgagcaaactattatccttgtctttcacagtaggagtgaactgttattacattaaactgaaacacgaggttaagaaaacactttctcatgattttttttcccttagtttttttcaacctttaagctataatttaggtaataatatgtctatggtaatgcatcatacattttaaattcaagaactcctttactcttttgataagttaaataaaattgaaattaatacttttctttttaaaaaagcatctctctacagtataaagtcatatttaataatacctgtataactgtctattcataattttggaattgtgtgtacctaatataaaagatggttactttctgagtggcgtgatgtggaatgttatattaaatgtgtagtgtggagcactgaaatacttaaacatgcatcattttcacaaaggaaaaagtagaagcaaaatgcaatagctaatggtagtaaactgtaggtataaggatgtttattgttttttcttgtttctgtattttgatgtacatgtaaaatatcctttcatgacattcaaaatcttgttcctacactggagatacctgtttttataatactacttttgtgggtctcctttcagacccttttatctatgtatgtcctaacatacttacatatggagtctcatttttatttatctttatgtaatattctcataactgtatattttgttccactgctttttcttttgaattgctaagttatgaatagctttacataaaagataaagatctatcttatttaactctgtgaagtattttataatatagacaatcacaatttctttagctattctcccactttttttggttatttgtttccaaatctttgcaatttaattagatgctaaaataagcaactaattaaagtgaatatttttggggtcacaagtgaatttttctaaggtagatgctgagaagtgaaaatgatggattgttaggaacacagattatttttgctatccaaaatgtctttacaaatttacattctcatcagaattatacatttctaaacaaagttcttctccaattctaatccatgtaccaactccctacctacctcaactcacattttacaaatcttaccttcagagtgaattgatgatcccagtaaatgcttgagtcagtctctctttttctttgagtgtgtatcatgatttcatgtgggataaatattaataaataattgagccattatgtgatgaatgttctatggataagtagagaggaaaaccagggaacaatcaacccaagctttagaatgtgtcaatgtcaaaggaagtttgaattgtcttaaaaggtaagattatggtctctgagtatagcaggagggtgaatgttcctggaaaatacataaaaataaaatatttgaaaaaccagggttatagttacaaaaacttatgtaccaggcaggtaacacactgatgaaattggtcaaggattaaaaaaaagagcataagagagaagataatgtcgtgacctcattgttggtagacaatagtaaaggcgagaatagtgaccaactgaagagcttaggccccatctccaaagcaaacggttactatgcccatcttcactgctgtgagcctttgatgatccaatgttgtcaggtatgatttttgcaagagaaattaaaattctgaataactgtgtggaactttttgatttttacatgcaggttattgattcaaaaatacacatatttaaatattgtgaaattcaaagaaaaattttagagtaacaaactcattctgatttgcctgggactatcccagttttaaaattaaaagtcatgtatcccaggcaaactaggacaattggtcgccttcattataggatcactccttctgtggcccatatctagctcaagggctgccatttgtaacttcagaataactcctcatttcgaggaagtgtaaggggttccatttccactgtgaagttttaagggaaggtattgcagactagggtgggagaattggtagaggtaatgtcatgtgtatgtattatttgacattaaagaaacaataaccgtgcttatgaagaactaactagtctgaaagttcattgcagctttgaagcttgttggtatcttccaaaagccaaaacttactacctagttaattggtttattgctgaaattaagcgagagataaattcctccacagtcacatagaatccctgatcctctgtacaatgttactttccaattattaaggatgctactaccttgaaattcttcttctatgcctctatttcccctgctgcagaagatttcagcattcagattcagattctcaagtaccttcagcaaccagctcttaggtttctctgctcctcaaaagatgcagcaggaacaataagtattatttttgatgagagaaaaattcagcactcctatctaaggatttgagttgcactgatcaccatagtaactagacaaaaatataatttgaataatacatttgaaaatgatgtggtacagaggccatgcctgggaggaagggaagaaagagggagggagcaaaaaacacacatctcagtcctttatagaataatgcaaatatttgaattagaaaatgccaatgttgaatcattaagagttcattttatagtgaaagaaaatgagatgtagagaggttatgtgacttttccaagttcacccagtaactatagctggggcgttagttcctgtctccttaaggcaatgtatttttgttaaaaaataactattttccccaaaaggtaagataagctattttactggcaaatagtcttttcttgttctcaaaatggataatgaggaatattgcatattgcactgtttagtgttctttcaaaagccaatgttgacatagggattttatttggggggtgattctaagacatactagaggaaaaaatggggagaaatattgattagtaagaggagggagtcaatagaggatgcattgtcaagtaaagcactgttcggtgtacaaggcttaatccttctggagaactcttgaagccagaatgatatatgtttcagagttatttcacccaaagaatgaaaaaggatatgcatttgtatattagtactaattagtcctttattgaaggttattcccaggtggtactgactctctagagcggccagcatactgaacatgtagcagaccaagcagaagtgatcaaagaacacttcagataaagagaagcgtgtgattgtagttggaagacagtggggtatagacagcgtatatgctaggcatcacagactctattacagtccacctcctaggccatgtatctcagggatgtgttaggtttactttgtcctgtcaccgatgagacagaatgagagagacagaggtagaactatagtttttaccgctgccattgttactaaaacatctactgctgtacaagatctttcttttttaccaaccattctaaaacccccttcaaacttgcacagcactttggctactctagattgattagcctgtagcctaaaccagacctgtatccctatgaggtatggtctatttattatgaccttgttaggttaaggttgttgtagttgcccatttgtggttattactgaggacagaagtaaaaaatatacccaagtgaataccttaaattacagacttgaatcttccttctcattgtgtagcagcaaccaggtctcctcatgataattaggaggattacccttaccagaatagaaactcctttctttgccagctaatataatggcaataagagaccaaatggccagtaacatctatattcttaggtttaatagaacttttattttgtctctcagcagaagcattctcaccttggaaaaacagatttttttttttaaatttttttttgagacagagtctcgctctgttgcgcaggctggagtgcagtggtgcaatctcggctcaccacaacctccacctcccaggttcaagcgattctcctgcctcagcctcccatgtagctgggactacaggcacacaccaccagatttttaatacagcagaacgaagtccccaagtgtatcactgggcatgatggtgaatccattcctaattccacattcaggtttctcactcacatgttttccctactagacaaattacctcatacagtggctgttgtttcaaggtataaaacaagtttttaaagagcagcaccttaacacctcagagaacgattccctctagtgccttagatatgctttacaaggtcatttctagattctcgtaactggtaatgtctgagagatacagtatatgggagtatgagtagattccctggtcatttgcattatcttgcacctccttcacagtgaaatggatgtcataatatttagcacgtgatggacagctccaataatgtattcacgtgacatgctatggtcaggtgcttaacatatacaagaccaggtagcacggcagatgttgctttattcattcacttaattaagtataagtgaatttataccacatgaatcttatatgcacagcttgttgaattcttcacatgtaatcacctagttaaatctaaaacatcaagatataccctatatccagaaccctggaaaatcccctcgtattcatttcaagtcaatattcccacagaggtggtcttgaattaaaccttctaacatgtagattattttaacctgtttctgagtatcatgtaagcacattggtatgttgtactatttttgtttctggcatcttttactaaagtttgtgaatgtcattcatgttatgtgtatcaataatttgtttgttataatttgtttttttaatgaatatacaatgatttactcattctgctgttaatagacatttgtaatatttctagattctggctattgtagataatgttatactcatattttgtgggatttatgtagagtttctcttgggtatgttcctaagactggaactcaaacacaggtatatatttaccttttataaattacaaaatagctttcccaagtaattgaagtaattcacactcccagcaataattgaaggttccagttgctattatttctcctagcattggcactatgttctttattttacttacctgatggtttgtggtgttatcacattatgctaatatttgcatttccatgatgagtaatgacgttgagcaaattttgatatggttattagtcatttggttattctctatgttttacttatttttttctgttgttgatatttgacaattatttttctattctgaatatagacgaatcaaattctgttgtcaaatataagtatttgacaagtatttggcctagagaatgttgtactttgatagacagatgttcttaataggctttattgaatttcagaactttcatttatctaagtacattattcagaaattgaaaaggcaaaacgtagactttatagaccatatagttgttctagttacctatttctctgtctctctctctctctcttcccctttcccccaattttttcttgatcaggatttatagttttttttaaattactttaatcccttcaaagaactaatctttagctttagctattgaatctccctttaaaattaattttattatatctattatatctcttttatttatttctatttcaatttttttctactttctttggttttaatttgcatttcttttgctcctgttcataattggaacctgaggtcttcagtattcttttttttaaatttgaattttgactgtaaatttctcttctaattgccgttgtaattttccaacattttaatataattattttgaaacatatagcaatgatcagaaaattttatggtaaaaaacactactcaccctctatattttactattaatatttcactatatttatctgataatattccttccttccccactccatcttttttcttccctttcttttttccatccttcctccctatatatcatctttatcccaataactaataaatcttatttttcatacatttaaaaacacactgtagacatctgtacccctataaatgttatgttacttatgaaattaactagtatttaattttcaattttttttcctttgatgtaacattacataaaggaaagtacacaaaccttcagtctatatttaactgagctttggtgaatgcatatagatatgtaacccaaattcctaccaaattgtagaacattaccacctgagttgtttccagtttgaggcttttgtaattaaaggtaaaatgaagattctttcacaattctttacaattatttctatgaacatatgtttctattgattgtaagtaatcatctaggaatcacacaggaaatatatgttgagtcttattttaaaaacgactaggaaaattttgaaagtggtagtaccattttacattttcttttacaatgtatgaagatttagttgttccacatccttgctgacacttggtattgtcagatttttacattttagtcattctgaggtgggagggggcatgtagtgtcagcttgttgtagctttaatttgtagtgtcctaatgactaatgatatagaccacattttaatgtgcttattggccattacataacttattttatgaagtgtttgattcttttgcccatataatagattggtattaatgtaatattggcttgaacttattttatggatgtttaaataatttttatatcttggacactagtcctttgtcatacatgctttgcaaatattttctctaaataattagcttagctatttattatctttaggttgtattttaattgtgtgtaacataattttattttatagttatttatttttgtaaccagtctcaaaagcctattattaaacctcaagtcatagagatttttgtttgtttgtttgttgttttaaatgcttatgatgttacctttaggtctgatgattttttatatcatgtgaaacagggatgagtttcatgttttttcatgtagatatattgcaccatttctaaaaatgcttttcattccatttctatttggcaactttgtaaaaaaggaaagtgctctattaagtgtaggtccatttctggactatatattctgttctatttatctattatcaatttatattccagtattcagcatatcttgattatggtagttgtatatcaagtgttgacgtcctcacactttgctatttctccaagtttactttacacaatctgggctctatgtatttccttatacaattttgagtttgccaaattctataaaacttctgctaacatcatgattgggatttttttgtttatagatcaatttagggataattaaaaccttaaaatattgactcttctaatccatgaacacagtctatctcttcatttatttagaccttttaaattttcaatcagcaatcttttatagtttcctgtgtaaaaacctattgaaaactttaaatttattcttaagctttttgttttatacactatcatacattgaattttagttttttgacttgcagttccaatcaatcattaaagtcaggaaacaacaggtgctggagaggatgtggagaaataggaacacttttacactgttggtgggactgtaaactagttcaagccttgtggaagtcagtgtggcgattcctcagggatctagaactagaaataccatttgacccagccatcccattactgggtatataaccaaaggactataaatcatgctgctataaaggcacatgtgcacgtatgtttattgcggcactattcacaatagcaaagacttggaaccaacccaaatgtccaacaatgatagactggattaagaaaatgtggcacatgtacaccatggaatactatgcagccataaaaaatgatgagttcatgtcctttgtagggacatggatgaaattggaaatcatcattctcagtaaactatcgcaagaacaaaaaaccaaacaccgcatattctcactcataggtgggaactgaacaatgagatcacatggacacaggaaggggaacatcacactctggggactgttgtggggtggggggaggggggagggatagcactgggagatatacctaatgctagatgacgagttagtgggtgcagcacaacagcatggcacatgtatacatatgtaactaacctgcacattgtgcacatgtaccctaaaacttaaagtataataataataaataaaaaaataaatttttaatcattaacttatatattacaaatgctaaatcaatagattttgtatattcattagtattatctatgtaaacactcaagttacctgcaggtagagaaatatttattttttccattccaaattattatgcttttattcctttttcttgctttattctaatgcctgggaccttcagaatagaagtgatagtggagtgcattcttgctatgttcataaagttatgaaaacaatattcagtctttcattatgcgctatagggtaagctttagaattttattgattgtcattgccagaattttatagaaatctgattataaaacatgtactctttttttgtcttatttttctacagagcatcattattttgagattcatcaatgttgctgtgtataattaattcatttatttatatttctctgtatgttgctcatttccttatattgttcactgtgttgcacagatataacagaacatttcacctgttcacctcttgatagatattagtttacttccagtttgggctactacaaataaagtggctataaatattggtgtattagtctttttatggacatattctttaatttttcaagagtaaatatacaggttgaatagctttattgtatgatagatgcatgtgtaagtttttaataatctttcaaagttgttcaagttatttatatcattttattttccttctggaaatgtatgagggatccagtttcataacgtcattgacaacactcggtatattaagtctttgattttagctatcataataattatgtgatagaaatatgttatggttttcatttgcattttactagtgactaatgaaattgtggctttttcttgtgtgtgtttgctatgcatatagcatatttggcaaagtgtctgttcaaatttttgtattttttaatttagttctccgtagtcttattatttattaagtttcgagttgtttgtatagtctgattacaatttatttatataatcgtgtgtacatatatgttatgtgcaaatatcttcccacagtctgtgggcatctttatattcattcattcattcattcattcattcatttattgagacagagtttcactctgctcttgttgcccagctggagtgcagtggtgcagtcttggctcactgtagcctctgcctcctgggttcaagcaattctcctccctcagcctcccaagtagctgaaataacaggcacccaccaccacgcccagctagtttttcgtatttttagtagagatgggatttcaccatattggccaggctggtctcaaactcctgacctcaggtaatccacccacctcagcctcccaaatgctgggatgaggcaccacacccagccaaatttatttaacagtatattttatggagtttaattttttaaattcagtctaataggtatagatatagtgttattatgtgcatacaaatttataattgtaatatcttcttgttagagtgaccttttctctcatgaatctccctgtttttggcttttaacacatctttttataaaaacattttttgcctgagattagtataattacaccgtatttcttttttgttgacttttgattggtatctgatttttccattcttttaatttctgttttcttaatttttaagtttgtttacttatacaatgcatagatgtttttccagtctgaaaacctttttcttaaagttcttatttcattcacatgtaaggtaaaggatgacatgtttgttattgtgtatgtcatcttgctatttttaaaatattttattttgctattaatttgtcaccttcttttgcactgatcattaatttgtaatttttattgtcttgtatagtatttattccctatttactagttctggagtggtttacctggaaattttttaaaaggtcatctttaatgtagtctatattttatatttttgccatgtcccgattttagaaccttaccaagttacaaatatattagccctcttgcatttttctatcattatgcattctacttatgtttattagactaaagattttgctattgtcatggctgtagatcattttatatttacatttatattttctaatatgttaatctgctattgctctctcattcttccagactggaaagaaaggagcattgatataaatcctacaggcataaaaaaattaaaattttgtgaaaaaattataaaaattacaattgtgaaaatattatgccaatattttaaaaatattgagtgtagcaaacaaaatactttaaaaatagaactggccaaatctgacagtaaaataaatagaactttgaagatttttatatctgttaatgaattgaagagtattattaaaaagtaaacttgcagcagaaaaaaaccaaacccatatgaattcactcgttattttttccccaaaatatttaagaaaaggctgtcatcaatcttaacaaacacttccaaggaataaaaaaggcagggcaagttctgtctttttctgaagccagcataattttgattccgaaatctgacgaggacattacaggaaaggaaattacagactgtactggatgtcctaaccaatgtcatatgacaaacaaattaaagagaagtcatatgaatgggaatagagaaaatacaagtatcatcctcaaatgatcttatttttgtaccaagaaatccaaaaacaaatcttaaaaaaaaaagattgtacttaataagtgaattaaatgaggtccctggattcaaggtcattatagaaacatagaatgtattttatttagtattctataaacaaagaaaaacaaagaaaaatgatacaaataaacaataaaaagatgctgatcttcattttgaaataaaatttttattttagaacgcttttagatttataaaaaaaagtgaggataacacggatagttctcatatacctctccccaccctctagctttctctattgttattgacaacttgttagtatggcacatttgtgttttttttttttggtgttggttttttttttgagacggagtctctctcgtcgcccaggctggagtgcagtggcgcgatctcggctcactgcaagctctgactcccgggttcacgccattctcctgcctcagcttcccaagtagctgggactccaggcgccctccaccacgcccagctaatttttcgtatttttttagtagagatggggtttcaccatgttagccaggatggtctttatctcccgacttcatgatccgcccgcctcagcctcccaaagtgctgggattacaggtgtgaaccacctcgcctggccagcacatttgttacaattaatgagcaaatattgaaataatttcattaacttaagttcacaccttattaagatttactttttttgatccactttactttttctgtcgtagaatcccacccagcatacctctttatactacatttgcttgtcacttcttttttttctcaacttttgtctttaaactttaactatttccttaggatgatgcccagtcatggcctttgcagatgcattactcatacttttaaaaaacttttatttcactttcaggggtacatgtgcaggtgtgttataggggtagtttgtgtattggtgaggattctagtgtgcttattacctaaataatgaacattgtacaccataggtaattttttaaaccctcatccccatcccacccttttcccttttggagtcctcagttgtctataatttccatctttacatccatgtgtacccattgtttagctcccacttacaagttagaatatgtggtatttgattttctatttctgaattaggattctttgggctgcaacagtttcttggacttctcttgtttttggggactttgaaaatttcgagaaatactggtcaggtattctgtagaatatctcctaattgagaattgcatgatacttttctcatatttagactgggattatgggtttggggaatacaaagaacctagagataaaatgataccttcatcacattatatcaaagagatatattattaatatagcttattactgttgatgttgaccttgatcatcaggctgaggttttgcttgtcagacgtctccactgtaagtttctctccctttctcctcccctctttccatgctgattctttggaagaaggtcaatatgcacaaaccacacttaaagagtggggcgttgtgctccgcctctttgagaacagaatatgtatataaattatttggaattctgcataggagatttgtctcttctctgtcatttacttattacaagagatttgcttaatttttatgtttgtgttaattttttaattaaaaaattattattattattattttttgagatggagttttgctcttgttacccaggctggagtgcaatggtgcgatctcagctcactgcaacctctgcctcccaggttcaagtgattctcctgcctcaacctccctagtagctggaattacaggcatgtaccaccacgcctggctaattttattttttagtagagatggggttcctccatgttggtcaggttggtcttgaattcctgacctcaggtgatctgcctgcctcagcctcccaaagtgctaggattataggtgtgagccaccacgcctggcctaaaaaaattatttttaagtatgtagatatttgggggttacctgtgataactgaatacatttacctaatttgcaaagatcaaatgataataattggaatataggtcaccttaaatatttgtgttttctttatgctagaaacagtcatattattctcttttagttattttgaaatctacaatagattattgtaaactgttgtcattctactgatatatcaagtgctaggtcttacttcttctatcaaactatatacttttaccattaatcaatctctctcccttcctccttcccttccccatgtctggtaactaccctccccactacttttcttggcctctagtaaccaccagtatgcatctctgtgagatctacctttttaaactcctacatatgagtgagaacaggcaacatttgtctttctgtgcttgatgtattttacttaatataatgacctccagttccaactgtgttgctgcaaatgacaagatttcactctttttttatagcagaataatattaaattgtgtatatatacaacattcatcttatccattcattgactgctagacactgtggttgatttgttgtcttggctattgtaactaatgctgcaataaacataggacgcagatatcccttcaatatattgattttatttcttttgaatatatactcagttgtagaattgctggattatatggtagtctcatttttactgttttgaagaatctccatactgttttctacagtggctgtactaattttacatttccatcaacagtgtattgtacaagtcttccccttcctctgcatcttcaccagcatccttatccactgtcttcttgataaaggccattttaacttgggtgagatgatatctcattgagggtttgatttgattttttctgatgattagtgatgttgagcattttttcatatatctcttgaccatttgaccatttgtatgttttctttttttttcatttttattttattttatttttattatactttaagttttagggtacatgggcacattgtgcaggttagttacatatgtatacatgtgccatgctggtgcgctgaacccactaacttttgagaaacagctactcaaggctttttttttttttttttttttttgagacagagtctggcactgttgcccaggctggagtgcagtggtacagtcttggctcactgcaacctctgcctcctgggttcaagcgattctcctgcctcagcctccctagtagttgggattacaggcgtgcaccaccatgcacagctaatttttctatttttagtagagactgggtttcctcatgttggtcaggctggtctcaaactcctgaccacaggtgatccacctgcctcggcctcccaaagtgctgggattacaggcatgaaccactgcaccttggccatctattcaagccttttgcccattttttaaatcaaattatttgtggatttttttttttttttttttttgccattaagtcgtttgagctccttatgtattctggtcaattctttacaatagattgcaaatattttctcccattctgtgggttgttgattgtcttcactttgttgactgtttactttactgtacagaagatgtttagcttgacataatcctagttgtctattttttgcttttgttgcctgtgcttttgagatcttacgcaaaaatatctatacccagaccaatatacgggagtatttccccaatgttttcttttagtggttttataatttcaggtcttagatttaagtctttaatccatttttatttgtttttttctatatgctaagaggcagaggccttgtttcattcttccgcatatggttatccaattttcccagcaccatttattgaagagatttccctttccctagtatatgttcttaccatctctgtcaaagatgaattggctgtaaatgtgtggacttacatctgggttctctatatggttgcattggtctttgtgtctgtttttatgccagtatcatgctgatttgattactatttctttgcaatatattttgaagtgagttagtgtgatgcctccagctttgttcttttagctcaggattattttggccattcagggtcttttgtggttccatgtaaattttagggtattttttctacttctatgaagaatgtcattggtattttactattcaattacactgaatcttgtaaattgctttgggtagtattgccattttaacaatattgattcttccagtccataagcatagaatatcttttccatttgttcgtgtcttcttcaatttctttaatgagtgtttatagttttctgtgtatatatctttcccttttctgagtagaacatcacgacatctgtgaacaaggttaatttgatttattcctttccagtttagatgttgtttatttctttctcttgcctaatggtcctggtcaggaattcaacttttatgttaaataatagtggtgaaagtgggaatccttttaatattccagattctaagaactgggaaaaaaaaaaagggtttcagtttttccccattcagtaccatgtttcttgttatatatggtcttaattattttgaggtatgttccttctatagccagtttgctaagtctttttatcatggactgatgttggattttactgaatgctgtttcagcatctattgaaatgatcgtatggtttttgtttttggttctgttaatgtgatgtaccacatttattgatttgcatatgttgaaccatctttgtgtccttgggatgaatctcacttgattatggtgaatgactttttaaatgtgttgttgaattcagtttgctagcattttgttaaggatttttgcatttatgttcatcagtgatattggtctgtagtttttttgttgttgtgttctgtctggttttgtgttagggtacatttggattcatagaatgagattggaagtattttctgctcttcattttttttttttgaagtgtttggctagaattgatattagcttcttaaatatgtggtagaattcagcagcgaagtcaacaggtcctgggcttttctttgatgggagactttttattatggttgcaatctctttactcattgttggtttgttgatattttctatttcttcatggcttaaacttggtaggttgcatatgtccaataatttatctatttcttctgaatttttaaatttgttggtgtaaagttgcacataatagactctaatgattctttgtatttatataatcatagttgttgtctctccttttttatttttgattttattcatttagatcttcttctttgtctagctaagatgtgcagattttatcttttctaaaaaacaacttttcttttggttgattttctgtacttatttttagtctcaatttcatatatttctgcattgatttttattatttccttctgctaatttggggtttggtttgttcttatttttctagtttcttgaaaaccacgtttcaagaaactcttacgttgtttacttaagaactctacttttttgatataatcattagtatgtgcttcttagcatttaacagtatctcttaatactgctttggttgtaaccccaaaatttggatatgttgtattttcattttcatttgtttcaagaaatttttaaattttctttttaatttctttattgacccattgattattcaggagtacatgcatcagtgtagtttctgaggttcttcctcttattgatttctagatttattccagaaaagatacttgatatgactgctacttttttgtattttttgaaacttcttttgtggtctaagatatggtctattctggagaatgttccaggtctgtgcctgggcattgtagagttaggtattgtagtcttcaaagtctgggcttgtttgtgcctatcctccttgagaaggatttccagggacttttgaagggacctgagctccaagtccaatatcactgggtttttacagactcatagaggtatcaccttggtgatcttggataagatctggaataattctctttacaaggcagagactcttcttttcccttactttcttccaaacagtctctctctctctctctctgtgctaagccacctggaactgggggtgtggtcgtgcaagcactcctgtggccacaactactgggactacactgggtcagacctgaagccagtacagcactgggtcttgttcattgtaaccgctacctggctactacctatgttcactcaaggccctagggctctacaaccagcaggtggcaaaaccagccaggtttgtgtccttcgcttcagggcagcaagttctttcaggctccaggtgggtccagagatgctgtctgggagccagagatcggagtgaaaaaatcttggaaatgtgcttaatgttctagtctactgtgcctcagctggcacccaaaccacaacatgaagtccttcctgctcttccctctcctgtgcacaggcagacgatcctctctctccctgtgggtcccatcaccactggcccatggtgggtttctgctagtctactgcagattttcacttaaagcccaagggctcttcagtcagcttggttgaattctgccaggcctggaactcacccttcagggcagtgggctcccctctggtccatggcaggtccagaaatgctgacccagaggctaggcctggaatcggggacccaagagcctgcttgttgctctaccctgttctggatgtgctagaaccaaaggtgcaagacaaagtcccctttactttcttgtctgcttttcttaaacagaaggagtcttttactgtagccaccgcagctaggaatgtgctgggccacacagatagtcagcacatctcagagccccaggcccacggcataccacctgaacatcactgctggttattcagggcccaagggctctttagtcagcaggtgataaatcctgtcaggactggtttcctccttcaaggcagtgggttccccttcaggccagggtgtttctagaaatgtctgggagctagagcctggaaagggggcctcataactttggcgccctatcctactgtggctgagctgatttccaagatgcaagagaaagtcctctttattctttgctctccaccacttacgcagaaggtaagagacattttccagaccgcaagctgcactctctgggtttgggggaggcacgatgcaagcacttctttagctgccctggcttgtgtctacctagctcatgtgccaccttagtcctctggctctgaggatctgcagtctttatgtgttctagactgcctttcaagtttacctgggacttcagagcactttggcctgtggtgccgaggcttgctgagaagctatagttataactgataggatgggtgattcccctctggataggtctgatccaaatgctccctgtctgtaccggcactgactgagcccagcacagctttgctctctgctgtgacagggcagcactgaattcaatgtaatgtcccccagtcactgtgatctccctcctccaagtgcacagattctctctggctgctgggaggtgggggcagagactgtgttgttcagggaaagagtggcatctgctatccaagactgtctctgaccctcctcaatgtatctctcaaggagatgaagtcaaaaccaggtattgtgattgctcatctgatttttgcttcttgtgatggtgctttcctgtgtgcagatatttgttaaaatttgacattccttcgtgggtaagaacactgtaggcttctattccaccatctggcttcactctcaagatggtcttttgtataattaggctatacaagttagatatccctatcggagaaaagtgaatctgaatttctacctcatatcatgtataaatataattgccagatgattggttgtagacctgaatcagaaagacaaatgaaaccgttaaaggaaagtaaaggagaaaaacttcattaccttggagttgactagattttcttgtagagtgacaagcaaagcactacattaagaaatgaaagaagtaatacattttgctatattaaaattcagaactttggctaattaaaacacatattggagatggaaatgcaaggagtaagaagatatttgtggtacattggacagagtaatcatgtttattgttaacccctaaaattcaataataaaaatggagaaatatttcagtagaaaagtggacacaaaagatgtttacacacttgacaaaataggatattcaaatggccagtgaaattgaaaagtgctcaacttcatttatcatggagaaatccaaattaaaattataagatagcattacaaaaccattagaaacagtaaattattaaagatgggaaatataaagttctaatcagaatattaaaactctcatattataatagtgagagaaagggtaatttggtacaactattttgaaaattggcactactattcaagctggacatatttacaccctctgaactaacaagacaactcttagttctctatctaagagaaatatgtacaaacattttaaaaaggacattgactagaaggttttttaataagcaaaactggaagctatataaattctaaccaacagtagaatggataaaaaaaattgtgttctagtcacacaatggaatacactatggcaatgagaatataaaattcatgaatgatcttacaatagggacaaatcgtatcttacaaacacaatgttgagtgaaagaaaccagacacaaaaagtaatagaattccacttgcataaagtacaaagcaggcactactaatgtatactgttagaagtcagagtggtgcatttccttgggggatagtgactagaagacagcatgagcagaacttctgggtattactaatgttctatattttgtctggatgggtttagtttataaaaattcactaaactgtatatttacgaatggtgctctgtccttcaatcatattatatatcaaaattaaaaaacacacatgcacaaactatcattttgggttgagctgacctcacagttgtgtacttctctggcataggtactctggattcttcctacattaaatccaacagatgctccctttcccagtacaactagctgtcctctaaggagctagtgcctgcttttctgtaccacggctttcagttttcttctctgcctctcgtgtacctcatttcctagttctgcaaatattgaaagaaggtgcattctctttacttcctattattttgtttcttacccacatatcactccattctcatcttttctgtgttgttcatctctacctggagatataagattttgcacatagcaggtatccagacatagccctaatgaagccatgatgtttatagcgaatcccagagccaaaagaattttcctatgggcagagaactaatttatccaccacaggatctttcggacaggacttctttgaaggtgcaggatggtagatacttgcaacacctggttttacatcccacttgtagtctggtggttatccttctcttgagtcaaagttcacttgaatttgagagtgggtgtggttccaactcaccctctctacagatcttctgagtccttctcaatgcctcttctctaatctctctaggattcatttggtgacagatgaaaaatgttcaatactcttccccaggaagacatttcctcacattgtgaaatatgcatttaacttgtgttgcctctggtaacacaattcatcttacccaaaccattattaataatacaatgtttaacccccaaatgctttggatgacactgatgtgactgaatgttatttaaaagcatgcttctaaaatgccatcaattatgcttccttggttattttaattttcttttattgcatcttggcaatgcataataagcctatattgaaaaaacgagacattatacagcatgaattaattaaacaattttaacagatcctgtggcagtgcttttagagctaacaatggcaaactcagataaattttgaaaaaaaattacctgtttttttctcccaaacacaacagaaattataaatatgttggaaataattttttcccttttattttttatgtatttttttaagttcttctaaaaagagcaactcttgttctaggcaagagaaaagacaggaactgattaccttttactggtggatcaggttattctagaacagagaagctgttcaagtgtctgctacactaagtgtcacttatacatgtgatttatttcttggctgatgttcttttattttttggcaggagaagagaataagtgaatggtgttttcagtccactcttgacttcacattgtgacatatgcattttatttttaaatctgcatagtctttcttcaaatgtcatctcgagttatgtattatttcctggagtttgtgagtctccatctagcctgatgtagcaacagattgggatgcatttgcatagtagtgtagttacttgcactctggaatcaaacaactattttaactttcagttttgttatttactagctgtgtgacctcaggcaatttactttgtttttctgaactttaatttcttaatctgcagaagagccaatggtgtaactctcagtccaaggtcaaaagccgcagcatttggagggctgttgtgcaagtcttgaggtctgaaggctgaagaatctggagatctgatgtccaaaagcagaagatgggtgtctcagctccagaagagacagcatgtatgaatttacatttcctctgctttttttgatcttaccaggccctccaccaattggatggtgcctgcccacattgggtgaggggagatcgtccttagtctactgatttaaatgccagtctgaacatcacaaacataccccaaaataatgatttactagatatctcggtatcctttaatctagtgaagttgacacttgaaattaaccatcaggaccatcctaaggctatttttaagttagtgtgtgacaattacttacttatgactgtctctttcttatttattcttgtaatccagatgcccagagggcctcatggtcaccaaatatccaggttaaactaatttaaaacaaattgaaactaatttaaaaattaatctgggccgggcacggtggctcacactacaatcccagcactttgggaggttgaggtgggtggatcacttgaggtcaggagttcaagaccagcctggccaacatggtgaaaccctatctctactaaaaatacaaaaaaattagctgggcgttgtggcgtgtgcctgtaatcccagctattcaggaggctgagacaggagagttgcttgaacctgggaggtggaggttgcagtgaactgagatcgcaccactgcactccagcctgagcagcagagcgaaactccatctcaaaaaaaaaaaattaatttagttctaccaccaccatcagttagataatatatgaggcatttttcaagattttagcaaagcgccatgtgacttctgactcagcgttacttctgattctgcattctgaatcactacattgctgcttctctgtgtgtaccctctccctaacaattatcaacttgaatgaatcccagtgctttcttgtaaccctagtagatctttcagaggatttttagatttcctgaggagatctgacagggacagagttgacattatggcttgcaaagcattctgctaccttttgggctgtgctgtcctctgcttatcaatttgctttctttccactttgttatggattattcccaagaattcaaaatttttctctgcttataatgcaattcatcttctttctgattcttgatactttggcacccactattcccttctatccaacacaatgatcaagatattcctttacaaataaaagagagctttttccctgagagaatttcaagcatcagctgttatgataatccaatttttctttttgaaaacctaaatcaggaaaactacaaaatacatccctatagattaaaatgtaaacttgaaaaatgaaaaggcactgactttgtgttgcttagcactctcaaagtcatcaaaagtttagttctccccaagcaatttataaattttgagtgattccaaaggaaataccaacaaaggttttatggagctggaaaagttggttttaaaatctgtatggaaaaataaacacataaaaatagggaaatactgaaaaggaagaactgtgaaaggaattagctctatcagactcgaaaacattacaaagcttctgtatgaaaactgcgttactcacaaatgaataggcaggcagtgaaatacagtgaaatagaacagaaattcaagtagacacaacaacctatggaaatctatgtaataaatgtggtatctctaattaataaatcaaagatagactttaaagtgaataattacaaaactattgaaaaattcacagtattagatctaatcatcacaccatacacaaatacaaaaattaactatacaattctaatccaattcctctataacccgaaaataaggaaaagctctgtaagtatgactcaaaaatctagagttcataaaagtaaagactgataaatttgactataaataattaaaagaaaaataactttttcatggtacaagccttataagcaaaaattaagagaaaaaattagaaaaatacttgtaacgtatgtcatagacaaaggttgatatccttaacataaaaataacttacaaaaattgagaaaggtactaaacattccatggaaaactaggcaatagatgcaaaaagtaagctgtagatgtgaacagagaattcaccagggagatattaaaatggaccttaaatttacgagatattcaaatgcaaattaaagctaaattaagataccatttctcacccaccacattggcaacaatttgaaagtaagtgcagcttggggaaggaaatttggcactatctaacaaaactatgtgtgaatttgtgttttgtcccagaaattactcttctaggaattcactctgaagatacactctcaacgatacaaaatctgtatgcaaacattttagcattattttaattgccaaatattggatgcctaaatatctagacagagaagacaagctgaataaactatgttgtatttatgaggcttcaacagagaataaagaaaatacgaactaaaatgatgtgatttccagtatgaagaaatctgaacacaggaaaggatatatactgtgtacgaaacttgtggagagaagaatatcgcatctctttacaaagtgaaatagagggaggataatgcgataaacaatgaagctaatagttacaaggacttcaggaaatgagaaaaaatagagaaaggacttcaggaaataagaaaaaatagagaaaggagtgacattatataatataaaatggatacatttatacaaagagatattgtagttatctattttgagttatggaaatacaaaaaattaaatccacaaaggagaaagagctaaaattaaaattatacacaaaccaggatatttatgattgtacctctgtctattctgatatattataatttgatacatataaagctcacaatattttatttcttttttcttgttcttttattttagattcgaggatacacgtgcttgtttgttacatgtgtttattgcatactggtggggatgaggcttctagcgtaccggatatccaagtagtgaacattgtacctataggtaatttttgaatccttgccctccccagtgtccccagtgtctattatttccgtcttcatgaccatatgtacccatcgtttagctcccacttataagagaagatgcagtatttggttttctgtttctgggttaatttacttaggataatggcctccagttccatcgatgttgctgcataaaacataatttcattcatttttatggctgcataatattccatggtatatatgtaccacattttctttacctagtcaactgtggatagacacataggttggttccatgaatttgctcttgagaatagtgatgcccatggtgaaaaacatccaagtgcaggtgtctttttaatataataatttgttttcctttgagtggacatccattagtgggattgctgggtcgaattatcgttctattttaagttatttgagaaatctccacactgttctctatagagaatgaactaatttacattcccatcaacaatgaataaatattcccttttctccacatccatgccaacatctgttatttgttgactttttaatagccattctgactggtgtaagatgatctctcattgcagttttaattttcatttctctgatgattagtgattttgagcattttttttctcattacagcatttgttggctgcttgtatttcttcttttgagaaatgtctgttcatgtcctttgcccagcttttaatagggtagtttattttttgttttgtttttatgtcttattgagttccttatacattctggatatcagtcctttgtcagaggcataatttgtaaatattttctcccattctgtagtttctttgtttactctgttgcttatttcttttgctgtgaagaaactttttagtttaattaaatatcatttgtctatttttgttgcatttgcttttgggcccttcatcataaattctttgcataggccattgtctgaaagagattttcctaggttttcttctaggatttttatagtttcaggtcttatgtttaagtctttaaatgatcttgatttaattaatttatttatatggttagatatagagggtccagtttcattcttctgcatatggctaactgattttcccagcccaatttattgaatagggtgtcctttccccagtatttatttgtgttgactttgtcaaagatgagttggttgagacacatggctttatatctgggttctctattctgttccattaatctatgtgccaatttttgtaccagtaccatgctgggtttttgttttttgtttgtttgttttttgttttttgttttttttttttttgagacagagtctcactctgttgcccaggctggagtgcaggggcatgatctcggctcactgcaagctccgcctcctgggttcacgccattctcccgcctcagcttccccagtagctgggactacaggcgcccgccaccacgcctggctgattttgtttttctttgtatttttagtagagatggggtttcactgtgttagctaggatggtctcgatctcctgacctcgtgatccacccaccttggcctcccaaagtgctgggtgagccaccatgcccaggctgctgttttagttactgtagctttatactaataatataatttgaagtcaggcaatgtgatgtgtctggatttgttcttttgtttaggattgctttgcctattcagggtcttgttttgttccatttgaactttaggatctctttttctaattctgtggaaaatgatgttgctaattttatatggattgcactgaatctgtagattgctttgggggatcatttaagcgatattgattcttccaatccatgagtgtgagatgttttcccatttgttcgtgtctttcatgagcgtttggtagttctccctgtagagatctttcacctgcttggccagatgtattcccaggtattttattttttaaatgttgctattgtaaaagggattgagttcttcatttggttcttagcttgaatattattattggtgtgtagaaatgctgctgagttttgtacattgtctacagctataccaccctgaatgcacctgatctattagatttttctttaacttttaagttcagcagtacatgtgcatgtttgttttataggtaaacttatgtcatggggtttttttgtacagattatttcatcacccaggtattaaacctagtacccattagttgctttttgcgatccaaagctgaaactgtatcagtctagactaaaaagcacagagacagctctgaaggaaaagggacctctgaatatccagtcttctacagcaaggaacaaggccactcagctgcaaacacaagccatgtttcttagaaaaggaaaagtaactttgagggggaagaaaagaacccagagtctggataaaaagacacaggcgcccattgtgtgtgtgtctgtacacccatattgggaagtgggggaaaaataacttttctgtgttttcttctgacattttgattgtttgtttgctttgccttcttcctggcacagtcatattcttacctaatatcaacggaaatgatagaaatagccattgctctgtgtcactaaaacaccgtactatttaatccttcagccttaaaattttgccagtaattattcttgaaaaaatccaatggattccataaaattatatcaaatttctatacattttcaacaacaaaacagtaaatttttcttttaaaagttagttcagaaatatgttaattctgtaattatgtgaattagaatattggaaatttttttttctactaaattgaaaaatgtttaaaaaatttttttttaaatcattaggccttccagtccatggacatgagatgtgtttacatttatttatatcttctttagtaatgttttatagtttgtattgtacaaaacgttaacatccttggttaagttaatccctgtgttatattccttttgctgctattgtaaatggaattgcttttataaattcctttgcagatttagtctatagacatacaaataattttttgtgtgctggctttgtatcctgttattttgttgaattcatgtattagttctaacagttttgttggtggaatatttaaggttttatatatataagatcatatcatctgtaaacagagataattttacttctttctttccaacagggatgtcctttatttctttttctttatgaattgctctggctaggatattgaaaaaaggtggtgcaatcaggcatcattgccttgcacctgatcttagagaaaatgctttcagtcttccaccattgagtttaatatctgctgtggtttttatatatgacttttattattttgaggtaatttcctcctattcctggtttgctgaaggtttttgtgataaacatgtattaaattttatcaaatgctttttctgtatcaattagataatcatgttttatttctcttcgattttttaatatcagagtaaaaaggcaacccacagaatgagagaaaatacttgcaaattatatacttgagaatgaattaatatctagaatacagagaatttctaaaactaaccacaacaacaaaatgattgaaaaatgggcagactttaatagacatttctccaaagacgatatacaaatgactgataaacacatgaaaagacgttcaatatcactaattcttagagaaatgcaaatcaaaaccaaaatcagataccatctcatacccattaggatgggtattatattgaaagagaaaaaaaacccagaaaatgacaagtgttggtaaggatgtggcatagagtaactggaacttctgtgcactgttggtagaatgtaaaatggcacagctactgtgaaaaacagtatggcagatcctcaaataattaaaaataaaattaggatatgatctagtaatccacctttgggtatatacacaaaataattgaaaatagactcttgaagaaatatttgtgcatccatgttcataggagcattattcacaatagcaacaacgtgaaagaaacccaagtttttgttttgttttgtttttgtttttttttggaacggagtctcactgtcgcccaggctggagtgcagtggcgcgatctcggctcactgcgagctccgcctcccaggttcacgccattctcctgcctcagcctcccgagtagctgggactacaggcgcccgccacctcgcccagctaatttagtagagacggggtttcaccatgttagccaggatggtctcgagctcctgacctcgtgatccgcccgcctcggcctcccaaagtgctgggattacaggcgtgagctaccgcgcctggccaagaaacccatgtttatcagtgcatgaatggataaacaagatatggtgtatgcatacaatgaaataccatttagtctgaaaaggaagggaattgtgactcatgctacaaaataaatgaaccttgaaaacattatgctaagtaaaataagccagtcacaataatgcaaatactgtttggagccacttatatgaggtacttggatagtcaaaatcggagagatagaaagtaaatggtgggttcctagtgctggagttaggaggaaaggaggaataattgtttaatgggtacagagtttcagttttacgagatgaagtgttctagagctagatggtggttatggttgcacgatgttctaaatgtgatacaactgaactgtacatttaaagtggttaagatggcaaattatattttgtgtgtattttactgcaattatgaaaaattgagaaaaaataattaggatggggcattctctttcttttcctcatacatgtaaatattatcttctagacgcttaataatatgacccaatgtgtatttcatatacattaccttaataattttacacatatcattttatttagtttacaaaactttattattaggtattattaactcaaatttacaggttgtgattatacgtctccaaggtccatttatctgtatggaatcactggtctatggacaaagttgagatttgattgtctaattgaccggaagattcattctcacaggagaggcaggaatgctttggaacatttgccaggttcccatccctaaaattcaacatcattagagcccctgctccatcttagtgtatgggagccataaaatcaaacgttcccttcgatggtagctcacataatggcagagtgtgaaaaaacaaagaaattggctcaggcttaccacccaatgctagttgacctttgtagtggttgtaatgattataaatagtctctaaggttttgcctctcagatttatagaaataggagactgttcattattccatggtatatatgtgccttttctctccccttcctttcctttatgtgactttaagaagaccattttaaaaaagaaaataaaatatgcatttatttgaaatctatgagtgtctctgtttcattagagttaattgtagatttaatcagcaactattgggttgaaataggatgccgtagttctcacaggattttctgagcccctgattctacctacccaagtcctttaacatagtgctaaacaagggtctgtgtttaatactttttggttcttctttcactttatcctaatctctgagtttctactagaattcacttctgcctttatattctcaaaataaacactcatgtctatccattgccatcctagttttccatcaacccatggtctaaaaacttgagttatctgtggggaagcagacactgaattttactgcattattcaactctactgtcatatatagggagagggggcaggtgacatggatacataaattataaaggcagattcaagttgtgcagagatggaaatagtggtcctgttttctgattcccaaccaaagaagctgttagaaaacagtctcccaagaatgcctggaaaactaagtttactttatcatgcaacagcacataaaataataaagcgttgggatgtctcctgggaattttactgagataacatagcagtattttataatcgtagctactttaaagattgtacagaaactacttttaaattgtattctgaactactagaagtatcttcaaactttcaggatttttttccatgtatgaattatcattgtagattgctgtggagaggtttcaaggataggagagactcagttattttttctgaggataagttgaattttaacatctaattttcaataacgtgctctacaaaaaaattcattagcatttctgggagagaattagctaattaaagattctaatgtctatgatcaattcaaattcattccgaggaacactccacagctcctctcaatattaaacatcgttgctaaacgtttgaacacattacaactccataaaataccatgctctacacaaacatagtacttaaaaatctaggggtattcaaactgtaagtaacaatacataccaccactaatgaaaataacaatggcctcaactataatggcatttatagttaaattggaaagttgaacacttgtaggtatattatagtttttacaacaatgtcataaagaacctaaattctttctactcttacgttgtctctaagctggtgatttgactcttacacttgcaacatcatgccttcctccaggaaacaatttttcacataataaaagtccaaaataggaaaatgaaggcagaaagaaaatatggttttccctatgactgtcattttatcatggagtattttctagaagccctcagatcagatagatctatatattttattgatcagatctatgtcatatagactcctctaacttcaaagaagagtgatacaatacctgtttgttttttcagccctttatcaatatccagcacacaaaaagtaaaattcacgaagtatgacatctaatttaaaaattatcaggcatgaaaagaaccagtaaaaaagacccataataatcagaaaattaatcaataggaacacataaagaaataatgaaaaaaattatagacttggtagacgatggcattgcaacagctattataactattattactgctattataagaatacttcttatttttaagaagctatagtaaaagttgtacctcttaagtaaaagcagagacgaatttttttttaaatctagaatctctagagaagaaaactacattttgagattaaaaaatataattgaggggatttaaggtaaagtatgattagtaaactgaatgccataacaatggaaactatctaaagtaaaacgcactgaggaatataaagattgaaaaatgttgaggtcgttagtgagctttaagataacatcaagcagctcgacatacatgtcattgaaatctctaagaataaatgaacagaaggggatgaacaagcagaaaatgtttgaagaaacaatagatgaaaaatttccaaatttgatgaaaactatcattcgaaaaatccacaaagctcaatataaccaaagtacaggaaatacaaagaaacctacacaaagtcccctcattgaaatttctcaaaaccaatatgatgagaaaaccttaaaatcagccagtggaaaaaaaaaatacatgcaaaggaactaagaaaaaaatcagaaccaacttctccttggaaacaatgcatcccaggagatagcagagcaacatttttaagtactgaaaaaaatctgttaaaatagcattctataaatagtagaaatatatttcagtaatgatgggggaaaagttttgatacatccaacctgaaagaattcatgaacaggaaatattacagaaaatatatcaggcagaagaaaaactctatcagatggaaatttggatcaatataaaatactcataatagcaaagattgattaaaaatattatttgaacagccttttatctattaaagaagttgaatttatagtttaaaaatttctcagaagattctgggccatatggcttcactggtgaatactatcaaacatttagggaagactaatataagttctatttttaaaattcctgataaaaagagaggagatactactcccgatattattcaatgaggcaagcaataagcattattttgatactaagacaacattagaagacaataagtttttaaagtccctcatgaacagagataaaaaacattcttaacaaaatattagcaaatagaatctaacaatatttatttaaaaatggtaacaccataatcaagtgtagtttatctcaggaattcaatgctgtcttgaaataaaaacgaacaaacaaaaccaatgtaatatactattttaatttttttaaaaaatcaatcaaggctgaaaattatctaacaaaatcaaatatctaattttaatctgtgtaaaaactctgagttctaagtaggaatagaaaggaagtttcttaacctggtaatgaacatctttgaccaagctcttatgagacttcatggtgaaagacgtaatgctctctttacttttattactggaatttccagctagtacaataaaataataaaatgaaagaaggcaacagaagtccagattgcaaattaagaattaaaactgactttattggctgtgcatggtggctcatgcctgtaatccagcactttgtaatcacagcctaggtgggattatcacttgaggtgagtagttcaagaccagtctgggcaacatggcaggaggtcgtctctacaaaaagacaaaaaaattagctgggcatgatggcatgtgcctgtagtcccagctactcaggaggctggggcaggaggattgcctgagccctaaaggtcgaggctgtagtgacccatgattgcaccactgcattccaccctgggtagcagagtgagactttatctctaaataaaaaaagtaaaaaataaaataaaataaaataaaataaaattggctctattaacaggacatatgattgcctatgtcgaaaaatttattaaatttaaaaaaggcctactataactaaaaggagagtttagtagatggttgaatatgaaattagtataccaaaagaaaccaaatgtgtttcatataataaaaaataaaagtttataattaaaaatatcatttacaatgtctcaaaatatgaaatacttaggggtaaatctgataaagaaggtgcaaattttgtatagtgaaaactagaaaatacagaggactgaaattacagtagatgtaaataaatgaaaagatataacatgtacatggattggtatattcaattttattaagatgtcaattctctgcagggcgcagtggctcacgcctgtaatcccagcacattgggaggccgaggcgggcggatcacgaggtcaggagatggagaccatcctggctaacacggtgaaaccctgtctctactaaaaatgcagaaaattagccgggcatggtggcgggcacctgtagttctagctactccggaggctgaggcaggagaatggcgtgaacccgggaggcggagcttgcagtgagcagagatcccgccactgcgctccagcctgggcgacagaatgaaactctgtctcaaaaaaaaaaaaaaaaaaaaaaaaaaaagtcaattctctacaaacccagcaggcaataattggtagaaattgacaaattgttctaaaattcataagaaatgcaacggatctagaattgcctgtataactttgaaagagaataaatttggtgacttcacattaccttatatcaagactttgtaaataaagctaaatcatcaagataatgtacaattagcctaaagtttgacagatagataaataaaacaaagtagtaacaaagtatagagtttagaagttgattttactcatatggtcaattgatttttgataaatatacaaggacaattagagaagaaagaataatcaggtcaataaatgcttctggaaaaactggatatccacatttagaaaacagtaaaagatccttataccatacgaaaatgaactccaaatagattatagacttcagtgtaaaaaacctaaaactataaaattgctaggtgaaaacataggaacagtgctttatatcaggcacattttctagatatagcaacaatagtaaaatccataaaaagaaaaaaattgataaatagtatttcaaaagacacagttaagaaaaagaacatacaagccactctgggataaagtatttgcaaatgatacatttgacaaatggcttgtatccagaatatataaagttttcattattaaaacagatatgtcacatttgtacatatttatgggatacatttgaaattttgtcacatgtatagactgtgtaatgatcaagccagcatatttgggtgtccatcactgcaagcatttatcattttcattttgttgatcctttgtattctctttaatctctattttgtttaatttttctatgatctttattatttctttccttctattaatcttgacttttgtttgttcttgcttctctaattccttgaagttcatcgttagattgttcgtttaaatttttctattttgagaaaggtatttactgttaagacttcccttttagcaatgcttttgctgtatcccatagctttcgatacgttgctttgattttcatttgttttaagaaatttttggttacttccttaatttcttccttgaaccagtgttcattcaggagcattttgtttaatttccgtgtgtttttacagtttgcaaatttcctccaatttctcctatttactaatttctagaattactcatttgtggtttgagaagatacttgatataactttgaatttataaatttgttgagacttgtttcatgtcctaatatatggtctatcctggagaaatttccatgtgctgagaatgtatattctgtatttctaccccctgcaatcccagtgccaaagcatgctgtccagaagcctagggattatccagcccactccaccaccatttgcatctaagcattcctccttgggcttcaagatggatccacccaacctgccactaccacagcagcttacatgcacctacacataccacctgtggacctagggactgcctcacccagcctgtcacagccacgaacaacaactacatgaactgcttgggagtgaaaggtttgtcttaccactactattgccattgccaatgccacatccactgcctagaggcccaagaaggcactgacctacctggcccactgctgcaactactagcattccagcaatctacctggaagcccgagaataagcctactgggacacactaacactggcaccagtgcatacgaccctagggcttaaaacaggcacactcagcccaccactaccaccactggggcctgagaaccgacccacctggcatccctgtccccattcaaacttcagcaaagcctttactaaaaactgaaccctaggccacataggaaagcaccctaaaagacaaactttaaatgttaaatagtattgccatagtctaaagaagaaaaacaaccactatctccctgtagaaaaataaacatatcttacaggaaatgcaaagcaaacaaataatcaaaagtaagatacttttgtttatttgaatcaaaaactgacacaatattcaatgatttttttttcaatattcattcatttgcttttagcttttagggggtatttatttatttagattttgtttacttgcttcttttagacatttagtgttcccccatgaggaataacaaaatagcatgttatgtaggcataattttcccatcatttatttcccccaatgttttaatgtttcctttaaagtattagtccattttcacactgctgataaagacatacctgggcaatttacaaaaaaaaagaggtttaatggacttaccacgtggctgggcgggcctcacaatcatggtggaagggaaaaggcacatctcacatagcaacagacaagagaagagagcttgtgcagggaaactcccgtgtataaaatcatcggatgtcgtgagacttactcactatcacaagaacagcatgggaaggacccacccccatgattcaaatatccccaaccaggttcctcccaccacacatgggaattgtgggagttacaattcaagatgagatttgggtgacacaaccaaaccacatcactttatgaatatgattttccatttcttacctattagaaaaataatttcagaggagtaacttgaatgccatatagattttggagaagtagctcagattccatatggaactcagaaacccagttgtcatatccaggtgatgaatcacagagcaactttcaagaaaatttttcttgaaaaactttttcttatgtcattatactcagacctggcattgtgtgtctaatagaggatttaatacggggaattaaatcttgtgacatataggagagcattgactcttctcaggcttattcatccaattggttaaaaaggaaaaaagatctctgaaattttaatttcaacaacatgaaaatagttagatgctttgtccaaaatattttttccaactaaaacatgttttaaaattatattgacaagaaaacaattacaaaagttttaaactaatgacacaatcccatggataatttcctctacatagctcagagagataaatgaatgaatcatatatcatagcaggaagcaatttccctcaatgagttctacctgctggaatctcaattcattacagattgagtaaaagcttttatttaaaataagactcttaaactggatctggaacaaaacccaaaccctgagggggtcggctatgaatatatttagaactttccactttctggaagcacttgtgatccaaatgtctctcttctgtgcacagtagcttggtaaagtattccaatgacacaagtgacttccaagtttgttcatgttcatgtctccttaacgtggtttagcatttttctgatgggttgccatcatgcagatgtcttaacaatattcccctctcattttatctctgtcttttcttcagtgtggcacaaatatatgaatgtgtgtcagttaaacaaggagccttaacaaaccaaatgtcagtccctggaaatttgaaatggaaagttaaatgcagcccaaatccagagagcctttggtatttttggattgtttaaaacttactttgtaaggattcatacagaaaaagttgcttttataccatcattaagaagtaataatgtaaatctctccccccaggttaaaacagaaattaagcaggtaatactgctcatctttcttttcctaacagctctttttgcttggcttggtattccttctaaggaataaacgaacaaaatagcttctatgaaggacttaagattcagaaagggtgaatgatttacaaaaagttaaaaaatggacctcatggaatcaagattccaaaacaattcttctaatgttcctttttttacactgggctcacatgtataattagccttatgttgaatcttgtcatgtgtgttattcttgactctttacataaaacatgtgttagttttccagtgctgccataacaaaatgcctcaaactgggaagcttaaaacaacagacatttatcatctcacacttttggagactagatgtctgaaattaagttgttggcagggccatgattcctttgaaagcctatagggaagagtcctctttacctcttagcaccagcaaaggccatcaatcctagcattcattgacttgcagtggcatctctgcgtttgccatcacatggaattctccctgctttcctatctttccatagttgtcttcttaaagcaacaccagtcatactggattgaggtccaccctggtgatctcatctcaagttgactaaatttgcgaagactctatttccaattaaagtcacattcacaggtattagtgattaggatttcaacatatctttttctgaggacacaattcaatccataacatacaagtcctttatagaaaaagaaggtgttcctggtcctcttcaggatcacctgggtcttccagcataatgttgatcacattaatatttgatgtttggtacagaacattgattttgtagaatattgaacgtaaaaagactcatagatgagaaaacatctttagacagatgaataacaaatctgggagatgctcaagtatattaagacccatccattaatggaagaacaagattcttgtacaaagagttaagcaatctgggctttggccctatctgtgggataacttaactattttgaagaccttgtaacaatgtttcttcatcaatcataaaacatatctcttctgcctatttaattgaatattgtgattacaaaaatataatagacctgaaaaatgtttaatgccatgcaaattcctaggtatcagtattaatccgatcctgtgttgccacagtgctctcttatgtcttggaaaaattacgaaggcatagcagatggttggtgttctttctaggttcacttggatctattttattttctgggcctctaaaccatattttagcttcagtgagctttgcacttatgggtttccacccacgactttcttcagagtatgcccttgggtatagagacactttactttcgtgaacatccagaaagtcctgggggttataccatgccctctgttctacagaagctcacagccaataaatacttggttagggaatacaagagcccagctttcttttatcaatgtgggatgaactgaaaaatttaaaccctagagcttctcatgtgatcagactgaggatggagcttcagttgaaattagtcttagtttggtttcttccttttcattaatgtacttttcaccattcacttactggtttaatcttgtggtattcccttaacaaaatatttgaacatgtattctaactctctaactctgatggcttctttagacaatatgacttaagatacttttttctgtgtgtgtggcacagcctcactctgtcacccaggctggatggagtacaggctggatggtacgattatggctcactgtagcctcaacttcctaggctcaagcaatcctcccacctcagcctactgagtagctgggactataggcatgcatcaccatgcctggctaatttttctttctttctttttttttttctcactatgttgcccaggtttttctcaaactcctggcctcaagtgatcctcctgcttcaacctcccaaagtgctgggtgggattacgggcatgagccactattcccagtcagccaacagttggtacttctaagaataggattctggagttggtgcactcgtcgactaactggcaatgaaaaatccaacatgggtggagagtggaacggtgatagccactggcatgctgcagcattacaattgctgaggcttttatctctgtttgactgggatgggatactgatggaagaggtagtgcagtatctctgggacttgtgagatatgaggaaaatagtaattataaggacactggggttgagtgactgctgctgagcaccactgaagctctgagagagaaaatggcaaatgtgaccagttaacaacatgaggcaatatatcaaatcctggtggtttacatggcagcatttaaagtgtcctttaccagtaaccagagagaaaaatgtagtgaccaccaagatgggacttaattgtagaaattgcagaacctgaaaaaaggctgaatttgcagggttggtagctctgccaaatcaggcccctgaaaggaaataagtggaacccttaaacgcaggatgagaatatttggttgggcttgtgaatgttgaccctccagattccccagaagactttggacctggagaagaagtttgcttcccctgtttgagactgtagtccatattttagctaaagagtatgcagcgacctcaaacgaggcagatacctacaaggtccatcctctggatgtcagaacaacaaccaaggtcaagtcttaacatggccttattggagaagtactgtgcccgctaaggagagaggggtttatatttagagattatacactgaagaagacctgcataatatatccaggtgggagctgaataataataccttgacagtagatcttgtctatatagggaccctctcctaaaatttaggacttgatacccaacccagcacccctggaactggttctaacatgcttctaggatggctactagaaggttggaaaaactagtggctcacattaaatgaaatagatatgccagaattactttggcagggtagctaggtagagatcaaggattcagataagttgaaatgctaaaatacctattaatattacataagacttaaagtgtcatcatcaagtcatgttatcgaagagggtgcaaaagatattcctctgctaaaatggtaagaagcatgctggaggagaatgcattgacaccggtgagcagtccagctatggactgctctttttaagccagagatgatagtaggagatgctgttaaaaaactgggctccctagtttcactggcatagataggattctagaatggcagaagccagggttagaacataaatatcagaggaacggtgggcataattatcatagacattcagtgggccttgatttgtggagatggctgacaaatcatgtattcttcagttcaaaaaagatgggcagttgaatatctgacaagaaattgccatatatatatatatgaaatgaaatattctaaaattatatataataaaatattcttatatataaaataaattatatatataataaaaataaataaataatagattaacagaaggtttgtgtcagatgtgccaatgaaacgcattataccttgcctggtttccagatctgagctaattctcagacacaaaacaaaccacttgaaagagaggtgaatacatcttgagaaacaaacaaacaaaacctgtagtagcttagcaagcgcaatggcagtgattctaaaagtcgatattccttgaattaccaaattaactgtacataagaggaagcaggaaagcaggatacttcgatctctacagagccagttagatgcaagggctagcctgaaacatggagaaataaaattttataaggctcaacagtggcgtcaactttgcaggaaaatgatgcggaaatatgtgatcaaacattattctggatatttctgccaggatcattttgaataagattaatatttaaactggtagacatagagtaaaacacattgcttttcatgatgtgggtaagtttcatcccatgagtttaggcctgaatagaaaaaaaagactgatttccctggagcaagaatggctggcagaggctttcacagtggaactgcaacactgtttcttccgaggtctccagcctgctggctcaccttgcagattttggactttctattcctatcctatttcttctctttcttgggagactcctgactaatacaggctccttccaataaagtgaagtgtatggggttcaagtaatgagtagaatccaggcctgggtcagtgtcataggtagttcttagatgtctaattttaatgctggaaaatctgaaatcattcaagagatgctctatggtaacactgagtttgtaagacaagttcagacactaggagaaaaaagcactttcagggacccctgataaagtaagagcacctgagggtcaagtaactagtggatacctggcttagactgtagcacagtaatcacttctttgcttcccatatacataattttaatggacataattaaaacttggcacaaaactcacattagttctttgacatgttgaaggaagagctattgttgtaggaaaggtgaaagcctctgaaaatatgtcttggccatattaaatcaaaggcaactgaattagaaaggcagagattagtacgatcttaaaggacctggataacacaggaatggtggtccccattatttctctctttaattcaccagtatgactcctcaaaaatccagatgagtagcaattgacattattagactactgtaaactgaactaatgagcagcttcaaatgcagctctatgccagatagatagatagatagatagatagatagatagatagatagatagattagtactgatcagcctggtctctggttcataaaatttggctcttgaaatgcttcatatgttgtttccaacaatcatcattacaggggaattacaagagtttcacatttgcctggaatgaacaacagtaaacattcactctcttgcctcagggttgtgctatccccttactttgtaacagtagagcctgaaaggtcccagatcatctggatatcccaaagactttcatgatgatcaactgtattaataaccttaaacctattgaacaagaagtatgaagtgctttgggagcactgataacacatgtgtacaccaaatggtaggagataaactgtacaactatttagggttctgacacattagaaaagttttgattttttaacctttttttagagatgggggcctcaatatgttgttcagattgtccttgaactccttactgtgcttaaacaatcttcctacctcaacctccctagtagctgggactacaggcatacataaccatgtgcccagctcagaaaagcttttagggctcaagtggtttggggcattgatgagacagcactccaaagtaagtgacaagttactgcatttgaatctttgtatcacaagaaaaggaacacagaagttgttagaccaattcaagttcaaatactgcacttagaaatactgctatgtctcatttacacagtgaggctgatagcagccagctgtgcatgagggccaggggaagaaagggattggcattaggtataggctgtgataaaagcagccctgtttctaggactatatgacccagtgaatattatagtaattgatcttcattggataaataaaggcactgtatagatctcctgaaagacccaataagaaaggcagaagcctagggttcgggaaaaaaagcatatattctgtaacagataattgttaaccatttaaatagcagcttctgatgacctactgggctatggtagagaaaaagtaactggccatgatatagcaagtgatatggtttggctttgtgtccccacccaaatctcctcttcaattttaatctcataatccccatgtgtcatgggagggacctgatgggaggtaattgaattatgctggtggttttctctgtactgttctcttgatagagagtgaattctcatgagatttgatggttttttaagcatctggcatttccctgctggcactcattccctcttctcatccctgtgaagagatgccttccaccatagtttaaagtgtcctgaggccttcccagccatgtggaactgtgtgtcaattaaacttctttgctttataaaataccctgtctctggtatttcttcatagcagcatgagaacggactaatacctcaagtgaacataaccagtgttgtccatcacgagctgagagctttcatatccacaatcataagaatcaggcaggaccaataataatttattatacagttaaagcagcatatcaggaatcagccctcagtaggatgaaatggccctagtaagctgcgtgaaaaaagaggaacagattcccatgtgacccaccattgttgcaccagtgctgctcctataaacttccattggcttctgaaagattctgcatgacagtctgaaagaggaggaaaaatatgtccaggctttgttcactaatgggctatgtgggtaaattattctaaggcaacaataatagattaatggtgagctacatcttgcctatgggtgtccttgaaagacagtgaagaagagaaatcctctcagtaggtaaagcctaaggtattgcactttgtgtgggggaaaaaggaaacagcccaagggaattctagagagtagcaaatgactgggttgttttctcagaggcttgaaggactgttactagaaaatcaataggaaaaaggttctggaaagaagtatagggatgatatatggggaattcacaaagtataaggatctttgcatcacattttaatttcccccaaaaataatgcatttcagaagaggaatatggacagatttatatagaaacatgacagatttatcatatgcaacttgtatacctaaaccctggttacattctttgtaaaggcctagaagacacttccttcaattggaaggttgataaatatatcaatgagaggaatacaatgaaacttgaatcactgtattttctcttctttgtaggctagatatgaccatgggtaatttctccaattagataaacgttctcattttactggtaatgacacagggcaggtcaacccccaaattgggcttaacccaggagagttgttggcttcacccaggaaagaattcaagggtgagttggtggtattaaaacagcaacttttatggaagcagcttgtttacagcagcagcagaggtactactctttgtggagcagggcaaccccacaggtgtgtgcctacagtagctgtttagttctgcagtcatatttgtacaaacttttaattataaataaattaagtaatggattacgcagaaatttatagaaaaagttggtaacttctgggtcactgtgtcattgccatggaaaagggtggtaacttccaggtgttgccattgtcctggcatctcgtatggggagatgctttcacctcttccctgtcttctctagtcctgaatctggtccactgtctgagccctgcctccagagttgagtcccaccttctacagtggatggtattctggagtagcagaggcaaggtggcacagacaaaatggacacatttattattttaaaaaggaagcaaaaaggtatagataatcaggattgttttaagcttcagagacctgtgggtatggttatttgaaaacaattttcttaggaattatatagataggaaatcaaccagaatatatttctcaaatctatataatacaaatattccaggtctagtagcccaaatcctgatttaacttatcacaattgaaagtcataatatctctcctagttttcagactcaagctaattgatatatacatcgctttccatacatttttttatgatgagacatctaaaatttactgttattttgaaatgaatgttattattgactccaatgaccctactgtgcaacagatctcaaaatctatttctcttttctacctgaatctttgtatctattgactgacaattctccattccttcgctccctatccctccaacctctagtaaccatcattatgatctatttgtctgtaagttaaactttattggattttatatatacatgacgtaatgtggtatttgtctttctgtgcttggcttatttcacttagcataatgtcctctgattcattcatgttgtcacaaatgacaggatttaccccttcttaaggctgagcagtatttcattgtgaatatataccacatctttaatctgttcatccgtggataaacagttaggttgactccatatcttggctattgtgaatactgctacaatgaacatgagagtgcagatatgcctctgaaatactgagttcagttcctttggatatatacctagaagtgggattagtggataatatgttagctctctttttagttttttgaagaacctccatacagttttcataatggttgtactaattttcattcccacaaacaacaatgtataagagttccctttgctctgtattctctccaacactatctttcatctttttgctaaaagtcattctagcatgtgaggtgatatcttactgtggttttaatttgcatttttctaatgattagtgttgctaaacatgtttttaaaaatgtacctgtttgccatttgtatgtcttcttttgagaaatacatgctcaggccttttgcccatttttaaagtcaggttgttttcttactattgagttgtttcagttccatgtatattttggatattaaccgtttatcagatacacagtttgcaaatatttgctgctattctgtgggccagctcttcactttcttaattcctccctttgatgtacagaagctttttagtttgatgccatcccattttctgtttttgctttttttgtctgtgcttttggggttatatcctaaaaattattgcacagaccaaagtcttgagggttttctcctgttttcttctagtagttttaccagtttcaggtgttgtatttaaatctttaatatattttgaggtttgttttttgtaaatggtgtaaaataagcgtctaattttattctcctgcatgtggatatccagttttcccaacatcatttattgaagactgtgtcttttccccattttgtgttctcggcatctttgccaaaagtcaattgattataaatgcatgggtttatttgtaggttttctcttctcttccattggtcagtgtacctgtttctgtgccagtaccatgctgttgtgattataattgctttataatatttgtttgaaactgaggaatgtgatgcctccagctttgctctttttgcttaagattgttttgactcttgaagtcttatgtggttccatatgaatttaggtatagtttttttttctgtgaaaaatgacgttagaattttaatatggattacattgaatctgtagaccacttgggtagtatggattttttcacaacattattttttctaatccatgaacacagtatatctttccattaatttgtgttttcttcaatttatttaattagtgtttaatagttttcagtatataggtcttttatcatcttgtttaaattgacatgtaagtatttattttgttcctattgtaaatggaattgttttcttaatttcccctttggatagtttgtatttattatacagaatgctactgatttttgtaggttgattttgtatcctgtaagtttgctgaatttatcagttttaatagttgtgtgtgtgtgtgtgtgtgtgtgtgtatggagcctttgtgtttttctctatataagatcatgttgtcagaaaatagaaagagcttcatataagtatatactttaagtcttcctttgtaccttccccaaagggaactatgacactactccaggaaccgtgtactgtaccaaagggattatccagacatgtttgatattaccacacactggctctgaaataacattaatttctcataccccaaaatgccaccatagataaatgccaccatagataaccaaagtcgtgactgtggtggtcttagttcacattcaatttacagtcagctcaattgttctacagacctatcctgtggctatttccctaattcctgaatgtatgattagaatagatatacttgacaattggtggaattctcacatgggatctctcacccatgggataagagccattataatagaagggctgagcagaagcccctggaattttctctccattacaaaatagcaaacaaggaacaatggtatatcccttggagaataacagattagtgccaccactaaagacttgagagacacagtgttgatgtaatcatcaacacttctttaacttactgttttccctgtgaataaatcagatggatcttgggaaatgactgtgggctatgttgagcctaattaggtagtaactccagatttagatttactagggtatatcagcacagattttgacagttgatagtgagtcattgatccagctaattattttttcttcattctaatttgtaagaatcaccaagaagcaattttattttactgggatagatgggtagaaatcacgcactcaaatacattgtatgttgccttcacaatctaaaaaggccaatcacacagtgtgcttcttttatgtggtagataatgcgaggggtagtacctggtcttcagcttctgggatgcttcaggcgcctctgcatctatccattaccatgtctgatcattagtgacttactgttgattcacaatcaggcatctggtggtgggcctggaggtgctgttggtaagcaggggactcagtctaaaagacaaagtgggcctagaggagtaaggcactagagcaagcagggatctgcaggggtgtttctacatctgtccatcaccataccaacctgtgaaaaactcttgagagatatttactgcttcatctctgccttccaggtttcatgtaagttcttctattcatcatctttaatccagaacaatgcagaaaagaggggggtggggttcggagaaacatagatcccagacttagccaagttgtcatagcatagtccggtacacaatttttctttttcttggcttattcaattagttgtcagcagaggtttgtttaagttgcacactggtattatgattttttccattcttcctttttgttctgtcaatttctactttattccaaaactatgctattgggtaaattagaatttgatattgccttgttgcattagccatttattattatgagattgtcctctttgttgttagtaatcatgttcgcattaaagtatattttatctgatatttatttactggcttttcctgcaaaaactgatcccaggcctctagcagacagtagatccactgaggtgtcagctgcttctcacagatgcacagcttcccacagacctcttcatgagccccctatatgtgatcccatgttggtgggtgaaaatgcttggcttttaaaaatttccctgtaggttccaacttgtccacctacaacagtacttcaggcagactgagtagtgagtgattctttctctgatactgaatttcccttccagatgttcagttccttggctcctcccaccttattcctttatgtccataatacttttgatggctgtttcttccacagaaactgaactgatacaatcagtaaagatacagaagatgtaaaagtaacaagcttgaactaatttgtatatgtgtgtgtgtgtgtgtgtgtgtgtgtgtgtgtatacatgaagtataaagtatatactttaagtcttcctttgtaccttccccaaagggagccatgacactactccagcaactgttgcatatgtgtgtgtaacaatgtatgatgcaaagctgtactccataatgacaaacttcacataatgtgatcatctcaacagacggagccaacacttttggcaaaatgcagcacttttgaatgataaaactcttagtaaactaataatagaacttctctatctaatcagatatgtctaaaatcatgaatagtaataaaatgatgaaaattttgtatctatgagaagaagaaaatatagaaatctgatttcaattattctatttaatattttgctaaagggccacccagtggaataaggcagggaaaacaaaataaaataagaatgggaagatagaaaataaagcagttattacttacagaatcaataattgtgtattgtcaatccaaaagaatctataaacaaatttaagatgaataaatgatgttaataagatgtcagagcaccaggctaataaaaatccattttacttctatgactttttcaacaaaaaatgaaaaacacacatgtataataccacacaaaaaagaatatgtctagaaaataaaacaaaatatgtacatgatttctactctgaaaaattacagatcttcactgaaagtaattaaaaaagactgcaataaatacaggggaatatcctgtttgaggactgaaagactcaatagtgtaaaaatgctaattcacccaaactcaatctgaatcaaagttatatattttatgttgcatttccttgtattgaggacattccaaatctttcttctagctattttgaaatatacaataaatgattgttaaccatagtaaccctactgtgctgttgaacactacaactttttccttctatctaactgtgtatttgtacccattaaccaacctctctgtgttcttccttttccctacctttctgaacctctggtaacgactattctactctctacatccatgacatcaactttaaaattctgcatatgagtgagaacttgtgatatttgtctttctgtgcctgacatatttcatttaatataatatcctccagttccatctgtgataaatgtttcaggtgatggaaattccatttaccttgatttgatcactatacattgtttgcatgtatcaaaacatcacatacaccccagaactaggtataatttttacatattaaaaaatcaaaaataaaagtaactataaaaatgatacaaaaattttcttacatcaaaccaagtatcaaattcatatagaagtgcacatattcaaaagtagttaaggcaatcttgacaaagacagccagaggacttatactaccaaatagaaaggctcatcatagggagtgcatgaggtaatgtcctactgacacaaggctagacaactgagcagggaacagaatataacccagtaacagttctgcagaattacagttaaacaatttatgacagaagtgagactttagtgaggaaaggatgctgtttttctttaactaatgcatggtgctgcttcaatagatagacaaaaagaatatggaaaaaatgtatttcatctgttcttcacaccatttacaaacattagccttttagaggaaaatagagaatgtcttgatgacatcaacgtgggtaaatctatgagacagtacacagagtttgctatccaaagaagaaaaaaatgacaaatttaagaaatcctctttatgaaaaggtaccaataagagagtgaaagttcaatccagaaagatagagaatacatttataatacatatacctgctaaaggacttgtattcattacatatatatatatatatacacacacacacacacacacgtacatatatgtatacacacacttgcatatatatgtagacaaacatatatatatgtacataacttttacaaatcaataaaaaatgagaaaaaagttgaagattgggcaaaaaacactagcaggcatgtcacaaaggacacgttttaataacaaatccatgagaagatgcagctttagtaattagtagtaaatacaaattaaaaatataagaaatttttaatactttacttacaccaaaataagcaaaatgataaagctaaaaaatatcaagcgttctagaagctgtgaagcccccagaactctcatgtactatagtgggagtataaattggttcattcacatcagaaaactttttgtcagtatccagcaaagttagacatatatatgtatgagtattcacatacgtatatattttagatacattccattcttatctatgttattctaaataatgtgtatacatataaattatgagatatgtactagaatgttcacagcagcattacttgtaaaggccaagaactggaaacaaccggaaagctaatcaacagttgaatgcatgatgatgaaatactttaaagcaaggagaatgaacagtctataattatatacaatattgataaattacatgcacaaactgttgaacaaaagaaactaaactatatcctatggtttgtacaaaaagtttacactcatataaagttcaatagtagtcaaaactaatccagaggtgagggtagtattcatccaagtgaacccagtggctagaagtaaacataagaagagtatgttggtgccagtaatggtctgttccttgatcagggtgacacattacgtttgtgaaaatccacgagctttgcacttatgtatccatgtagttttccaaatctgcattacatgtctaatttttatgccacagagtacgtgccacctaaaaacaaaagctaacttgctaagctctaagaggtagaattaatctttggtgaggtaaatccaatgcatgctgcattatattacctagctttccctgaacgtaaaactacagcgtgacaagatagtgcagtctgttatcgtgaagcagataaggtaaatgtggtccttcctcttacagtatgagccttcatgatgacaccaaatctatccagagacaaatgttcaagtggccgaggagcaacattcctagatctttctacctcctatagtcaaaaatcagaatagcaaaatgcatctcagtatttccctctactgtataaggaggagctaaatctgccatctgctcttcttttgttctgagctagatcatattcttatttcttttgattattgctcctatttatgctctgcaacacagatgaacttatagatgagaaagaagggctattattcccctagaaaggggaaaagcaaaatccatttagaaatatttcttaaatagtggtctgtggttgatgaattatgcatgcagtaagcagcgacactccagctctcataaccagaggggaaagctgcagtcctcactttccggctcaactgaacaggggccctggctgccagggaatgacaagtcatctcatttaaaaatcgtactctttcctgaaaaaccaaatggaagtttaaatcaggtaaaacgtggcaccctaggagctatctccagtaatttggcattgttacacacactcatacaatgagattgaaagcactttgctgtgaaaatgtggaaacctggggtcttagcccagtgctgtcacaaattagtcatttgaccttgctgtttacccagacagggcctcagtttccatatctgaaactaaccaaaatttagattaaaagatctctaggtctcatcttcctttaacaatctttaataagggaagcatacttttatagcaacatgtatattattaaataatttccatgtgagaggataattaagctagtaatattaagcttctcctctgtgttccagatgtgtaatagacgtttaacacaaaagtagtattatcgttgccataatccgttccagggttttctgtctagcatttaatgatgatggacatctttgaaaatatgaaaaaagtcatatgttttgcatattactccatattttgtttcacagatggatatattttttctcattagcattacattggctgtagaaaaggactgcgtggtttttagacacatgcaaatgctacttaatgagcacaccttattctccttccttgttttctggtattactaactagtgcggtaaccgtggacaaatcattcccttttcctatgcattgttttcccatttcacatattaatagaacttgtttagatccatgtttctcagagtgtgcttggcaaaatacgtcaatccccaaaatagttctgtgatcaaacaaattgggaagatcacatatttcatatcccctatattttcacctgggaagtaaccataaatattctaaaggccttaaagagttctgtgatgcagaaacctgctttatttcagagttgatctcaggttaatttattgagataattttttatccttggctgacagccattaataatgatccctcagatgaaatgatctaatcaactttcttggggatccttcaaacttgataatctctgatatggtttggctgtgaccccacccaaatcttatcttgaattatagttcccataatccccatgtttcgtggaagggaccaggtagagacaattgaattatgggagcactttcccccatcctgttctcatgatagtgagttagttcttaccagatctgatggttttataaggggccttccctttcactgggcactaattctctctcctgccaccctgtgaggagttgccttccgccacgcttttaagtttcctgaggcctccccagccatgtggaactgtgagtcaatgaaacctcttttctttataaatttcccagtcttgggaatttcttcatagcagcataagaatggactaatacaatctcctaggtttcttttggttcacatttcaatgtaatatggaaaggtggatatttctccaggtatattatttgtctattaaagtgggcttgatgtcaatgtttctggttctaaattcagttttgcaatggccattgtgtgacctgaggcaaaatcataatttctctgcgcctcagtttcctcatcaaaacactataaggatgttataaaataaaaaataaaaacataaaacatgtaaagtgtaactcaaaatcagatagcttctcatgatgtaaaaatgaaaacagagtgaagaactgagtttgaagccataataagtatgggaagtcttaaccccatatacatctaaggtaacctcagatgtgttcagtgatttttgaaatattagaaagttgaagtctgctttgaatctcaaatgagatagttttagggcaaaaaaaaaaaaagaacaaaactaaactattaagccctctgctccccttcacataaatggaagtctttttgttttttttttttgaaattgttactttcaagaatatgcatgccattcctacataaacaaccaaacaactatcatactataatggatcatagggattagagatatccatagaagaggaaggcacaagaattctcaaaggcagccagtgatgtttaaaacacagctctgacttctgagagctgaaactaatggatatcagaactgacagggcctccttggtgttctagacactctctttagtagaaactaaatcccacctataaaatccttcaaacatggttgtcaaagacaggaaatccttccacaataaatcacttttttctcttctaaagaggaggatatgctcttgtatgacccaatatgttcttatagaaaaagttacttgggtagaaaaacagctacagatactatctaacagaagacatcataatgactgattaaaacaatgcctgtctctgacacacctctgagaggagagctgtgatacttagacaaagcatatgctgctgcctgaaaatcactcctggtgtaggacttcaggtcattgtaagaaattttgatataacagaggctcaaatgggagcacttgtcaagttaatggattcctctgtatcccagaaagaacagtgaaggattcaataaaggttttatttttcccgtgctcttgcttcacacccatgatctctctcatctttagcggggtttggagagagagcctatacgtatatatatatcatggccctaaagctgcatctttgctttccacacaggttcccctttataaatctcacgttgctattttaatttccctgtgtgtctcatatttttatgagactaaagccccttgaaagcaaggggctttacttctctagttattctctcagcatttaggaggctggtctcaaagtttgagctgagttaaaaaaatacgtattatctaactccttatatacatatttagaaagagaacaaatgaatgaacaaacgatatgtgaatttatggagaaatcctagtttcattttttcagattaaatatctaacattttttaatgagatgtcaaactgtattggtcagggtttcccagaaaagcagaaaaaaatatatactttaatatatatatgatttattagaggaattgactcatgtgtttaccgaagctgagaagttccaggaactgccatccgcaggctggagaacagaaaagctggtggtgtaatgaagccccaggaaccaggagctccaatgctcagggcaggaaaagatggatgtcccagctcaaacagagagagggagtgcatttaacttttctccaccactttgttctatttatgccctcaatagaatggatgacgcctgcccacactggtgaaggtaatcttctttactagggctaccaatttaaatgcgaatctatttcagaaacaccatcacaggtacacttggaagcaatgctttgccagttatctgagcaacccttaacctagtcaagttgacataaattaatcatcacaagcccaccctttctcaaactggcacccatacacatctccttaaactctacttcacctccaaataaagatagtaacagtcataattttgcttgacataatacaactatcctacattcaacccaaaccacactaatcccttcctcagaaagggtaaagtccttgggtcatgtttactattttcctgataatgtataaattaaatattatgctgtaagattaacaatgcctaaataacaatatatagtcaatacatcttatatgataagtaaataagaggaaggaatacacagatatttgcttaataattgtatatctctcaaaacaaggaagaaatattcatgacaattacagtcctcatgtctgtaactactcacatggttgtaactggtctttaaaactaccttcatttactacccattctgaattccctttgccttcagcaagtactgtagctcactgtttgtttgtttgtttacctggtggggtgaaaaaaacctttattcttgaagaatctgggtcatttgtagtcctgcctaggttgtggtggtggtgttttccattgaccttaaccacagagcatggatagtaacagacacgctaagatatctcctgtattccagacacaccctttcttacttccattgtggaacagtagtatgattttccaatggtagtttagatcaattaccctagccaacaccatagttctcttctcggcctgttgactcagaggcatgaggaacccaaagtggccaggtggcagtcttaactttaagttcaatgaactcgttattgttcgtcctcgtggaaacatttcccccccccggaattaagacccttagagcataaagccttgagaacacagagtgtaaattgtgttattgagtcactaggggtaatagtgtgttgccacccccattatcaccccttgattcctggactcatgaatcctggacatggaagaaacagcaccataaattggatgctgattcagagcatatacagccttctgcagaactttgccccagccctgaaatatgttgccaactagctagtgctgtaactgaagctccaaaaggccattccactgtactatcaaaccagctgcttcaggatggtgaagaacatggtaagacatgaatttcattagcatgagattaccatgcctcttttgtggtgaagtgagttccttcatcagaaacaatatgtgtggaatatcacaatggttagaagggcattatatatgttcactgatggtagtttttgcagaaacgttgcatgcagtgaaggcaagtctataactagagtgtctatttcagcaagaacaaaacactgttgctttcatgatggaagtggtccaatgtaatcagcctgccaccaggtagctggctcatcacccaagggactgttaccatattagggctcagtgttggtttctgctactagcagtcttggcactcagtagtggctgtaaccaggttggctttggtgagtggaagtccattttgctgagcccatgcattaccttcatccctgccaccagggccatttttttaataagccaactgggtgatgacagggttgtctggggaaagagaccaactggtatccatggaatgggtcattctgtccatttgattattgaagtcctcttctactgagctcacccttggtgagcattcacatgggatacaactttcacattttttgttcacttggtgatatctctctacctaaaccttccccaaatttgtcaccaatatttcaatcatgttttcccaaatatctgaccattcagctaaaccattggccacaattcatacttcaaaatataatcacaaatctggccatttctccttccaagaaaagtatgaagccagtgaactgttgaaagttttgcctacttggaagattctcctttcccaatgtcctcaaggatgtcccagagagggactctagtgctgcaactgtccacatttaggtagtgcctgtgtatcgtgaggaccatgaatactaccatctgtaaaccaggccttagtcttatcttcctctgttaactgatcatagagagttacccataaggccataagtgtaggttgggagagagaagacagtatggcaggagcaagaaccatgggcattagagacacttcttcatgtaacttacttcaacttcagggtctgctttgggctgaatgtgtatatattatttccatctaataatgaagtgttgctatgcaagctcagatttatgacttggtgggttagataacacccagtttatgatgggcagcttgggtcgtatagtagtttagtggactatggtcaaacatttagtttccactaaggcccagtaataggccaagaactgtctctcaaaaagagagcagttatctgtagatgatggcagggccttgctctaatatcctaaaggatcatgctgtgattcatctataggggcaggccaaatgctccaattggtgtctttctctgcctctgacacttcaggcaccactgaatttgctgaatcacatggctcaagaggcagagcacattgcagagcagcctgaagctattgcagagccttattttgttcttgggcccacttataatgagcagcttttcaggtcacttagtaaagagtccaaagtaatacacccaaatgagaatatgttgtctccaaaatccaaaaggcccagtaggtactgtgcctctttcttgattgagggaaaagcccgatggaacaacatatttttcaccttgaaagggatgtcatgacattcctcacaccactggaccgttagaggttttgctgaggtagaaggcccctggatttcaattgaatttattttctaccctctgacatgcaactatcttaccaataagtctagagtagttgttacttctctcttactgggttcaatcagcatatcattcatgctacatcttgtaggaaaaaaggatgatcaagaaccctgcaaaagaaattctgacatagacctggagaatttatagatccctgaggtaggacagtaaaggtgtattgtgggtcttgccagctgaatgcagactgcttgtagtgtaccttatggacagggtaggaaaatggaattttccagatcaatagctgtatacaaggtgctagaatatgtgataatttgtgcaagcaatgaaaccacatctagtacagcagttgcaattggagtcaccacttaattaagcttgtaacaatccactgtcattctccaaaatccatctgttctttgtacaggcaaaataggaaattgagcacggatgtggtgggatcaccaaccctgcatctttcaaattctgcaccagtctctacagtccccccaggaatgcatcactgcttctgatttactattttcttaggtagaggaagttctaatggctcccacttggcctttgtcactacaatagcccttactttgcagttcagggaaccaatacagggtttctaccagctgctaaatatgtctattctagttatgccttaaagactggggaaataaccacaggatgcatttgggaactcactgggcccacggtgagatggtcctgatcaaaaattgtattgatcatatgacctctataagctccagctctggatgaagggtcatggtgatgttttagatgttccggagtcatgtcagagccagtgtccagtagtccttaaaagttatgtttacttcctttactccaattcctagttaccctgtttaaaaggctgtaggtacctttggggaaggttgggagaaatattaacagtttaaaataagtttttgttagtgtaccagcgttcttccttgagagagaatagccttgctttcactcaaggggttctgggtctgtaaatgccttagggcttagaattgactgagaggctttgactttgtttatatgatttgagttagacttttgttcacttgaacaagaacttttctgcttacaggtcaagtaaaaattgagtgggcttcctatctatttcacttcgagaaacaccaggattaactagccaacaccataggtctgcatgagtcagattattctgattgctgcattgaatctgctgtccggtaaggaaactatgcccaactttcttttgctggttgggtgcctctgcttggcccctgtcactctgggatccaattatgcctattgtatttaggttttccagttgagtggctgcagttcttactgtgaggtctcatacagagaagaacattcatggactacttcaaggatgctagggctcctttcacaaatttatatctcaaaatttcagtgaaagccatgtcttctggaacctcctagtgtgggagagtaggtcttatatgacaaatctactctaattttccaatctctctaagccttagtatcccttcctctacattaaaccaagaaaggttaagtgtctttaattcattcactgtgagccatattttgatccatgtttcagccaactaaccagccaaactgttagagccctttttaactctctgagctgtaatgctaaatgaaaaatctttgtttagtgggcccatgtcaataaacttggtttgatccaactttaggctccttctactattattatatacccttaatattatccccatgcatgttccctagatttctgcttgtataagttagaaaattcaagttgttattttggattatggcatacctcattagaggtcatacattgtacctcacctttaggggcctgctagggtctagatataggtctagatgcaaagatgggtgttgggagtgggccaggagtataatcagcattgccttgcatggaaactgctttaggggaggccattaccattttttcagtcaatgaagggttaatcccctcaaataaatgtggaaagaccagtgtgggtggccacttcctctggcaaaaaaaaaaaaagactatgtccttctgttttcctattttcttccttagattatatcctactagaaagcacaactatatctgcctcactcacccctgaattccagtaggaattggcttgcatgattatgaaagccagaaagttccacaatttgctgcctgtaatctggagaaccagaaaggttaatggtgttactcactctgagtcccaaggcccaggaaacagaagcaaggatgtctgaggacagaagaagatgaatatctcacttcaagcagaaaaagaatgaattaacccttcctctaccattttgttctattcaggccctcaatagatggcctctgcattgttgagggtgacttttttacccagtctaccaattcaaatgctcttcttttccagaaacatccttatagacacacccataaataatgtattaccagctttctgggaaaatcttagtccagtcaagttcacacataaaattaaccatcacacaaacatataaagaatacctttgtaaagaatagaaggcattactaaacttaccactttgacacttagattgagaatatctgtatatgcctttctgtgtactcagaagtaactattatagtgatcttggcattttcattaccttctattgtttccttacagatgtctaaggaaataaattattgttttggcatatttttaaaatgatatgataatgaatgttatacattcattaaattgcatttttctgtattcatatgcaacttgccttttgcagtcaacattatgttaggaaataaaatcatgttgatatatatgtctattctggatgctgtggtacgctgttcagatttccttttcaggatcctcagaacggagctactcattccttcagcagctggctgttttggctgctgatcactctctgctgagaccctttccaggcctttccttccagattcccttagctaaagggatctgccttgttccacgttacacctccccagtagcaactgtccaatgactggtgggtgaaattacaaatatataaccccctttcctgattttggatgactttgaaaagttatccctatttcagagctccacgtaggatgagctgagctctttgctctgactgcatcgccgtaaacatctcctgcccagtcctacctcctttattccttcataggtgttgttcccaaaagcaatcactcataaattttcttggtacaatgtccgagtcagagactgttttctgggaacttggcctcagacaatgctttctacataagttgtttttactgctgaatagcattctattgtataaccatattacaatttatttatccattcaactattgatgggaatcaagattgcttttaagatatttaatacttatagatctttctgtgtgcatatttgagcagaattagttaagagtaaccctacaaacgtatttgttgagttataacttttctatcctaactttgaaaggaactatgaggaaactccaaaattataaaatttgcattactctgaatcttcatatcaaaaacttccgttttccaaagtagctcttgatattttgggcactgacttctatcagaggatattctttcctgtcaaacttgccttagcattgcttctcaatgctcttaaaaaatctttgatgtctactcaaggacaagggccctgttcctcctggatccaataggattcctattcttttactacagttgtgtgatctgaagttattatagtttcccagtgtccaacatgtaagaattcctgtttcttaactttcaactgttcagagctttttcattttacacacaagttctaacataattgaattctgcctttaagataaaaatagattgtgtttatctaaatactatctatgttaacataacttttggggatctaattcatatgctcctattcctcctgtgttttgacatctgtaatatcctgttcgggggatcataacacctcaagcaataacattgctgtttagattatctgattcatgtaacaagctgggcttcaacttaggtatgcttatctttgagttattcatattctaatgtttacaatacagtttattaaaaacaatttgaactccatagtagtcaggttatccttgaaagaaaaacatatgttaattgatcatttaagaatttactgcctaaaacagagccttctgtctcagagctgacattattactgacatttttttctttattaacagttaattttgtctccagcattcttgtacgaatgggtaattcctacaaataaagtaggaatttatagagtttgaaaaaatgtttattgtacatttacatttctatgtatttatgctagctttcgaataagactttaactttgcttgtaattttgtgtgaaatttaaatcaatgtaaatgtgaattaaacaagccatttcctttatatatgacttcactgagacccagagtgtagaaacctcttttcctgtttcactagggatgtagtagatgtaggaataggactcaattccactttcttgtgtcccatagtaactcttctgactttctcttccacttaaatataacaagaaatcctgtgatccctagaatgaaatcattttacttcataatatggaggccaagactatccagtttttgctcttgttgggttccttccttgcctgggatgtctctgctctgtatttgtgactgtctcacatgagatggaagctcttgcatacagaaatagctttttgtactatatggataaagagcaaaatgtaaaaaaaactctgcagttttcattaacttatattacggaaacacttatataacattttgttaaatatgctttttctaaggagaaataatcagacatatcgattatggaataagaaaaacaaaaataaaaaagctttcaacaactcatgatcaggaaataggacatacagaatacacttcatttttctgactccagggaaagctcttactgtgacatcaacctctaaatattttgattgagctgtcagtgtagagtgttgtagtaaagttaacatttcagaaacagataatctagagtctttatgccaattttaccatggatgagctacgtgatcttagacaagtcaccttagctctctaattattaggttcttttactggaaaacagggaaacataccatttactttaaaatgcctggttaggattaatgacaatatataaaaataagttagcccaatgcctggctcataaaaatgcattgataaatgagaaatatacctaaaatgaattatgtgaatataattattttaattatttctatgcatattataattcttgaaactcaagtacaagcaaatattctctcttcattttttttttttagatagagtctcgctcatgtcacccaggctggagtgcagtggcgcaatcttggatgactgcaactcctctcttgggttcaagtgattctcctgcctcagcctcccaagtagctgggattacaagtgtgcaccaccatgcccggtaatttttttgtatttttagtagagatgaggtttcaccatgttggtcaggctggtcttgaactcctgacctcaggtgatccactcacctcggtctcccaaagtgctgggattacaggcgtgagccaccatgcccagcctaatattctctactcttaaaacctgtagtgcaaggggccatttctcaccttgagaaaagggattcaatggactgaaagagagacatatcccatgtaagcaagaaataatgaatgtgcagtccccctgggaacactgaagggaagcactcacatggtattgtcaacagaagccagtgtttgactagggagagttcagaagcagtatccaacttcctctcagggtgactcctacctttcctgaatcaaagcagcaacctgacctgctaggaccaccaacacttctcctgtaatcacactgatgcccacagggctccacagaaacatcttccacacattcctccctgcttcagtgtctatataaatacctggatcctctcactggccacacttaagagtctttgtacatggatgcttttcctgtttttcctcttttttcacttcattgcctttgcctcacctttccccgccttcacaattgcacctagggtatacatactatgtagagacatagcaggaaatcaggaaaccccgaagtgaacataaactcagccaagaaaatcactagggactgacagcagtgacaaggcagaatttgctcacattcaggaatgatatattcatttcccaccttgcctgcccctgctgtgatttttctggggcacaattcacagccctgagaagggagatgctgttttcaacttacaggaacccacggactgctctcttccacagactccttggctgtctcctggccctcagtttggagcagatggagagcctggggtatttctgcatatttgctatgtgaggtcctcacctactgagagcttctctcccatccccaccatttcctcccactctttagaaacaagacaactgccttaagacccaatcattttgttttcagaaaattttgccgcttcacacactactgcctaattaatgtttccgtaaagggcactgaacttggtttagggtatctgggatggaactaggctgtcgctcacttgctccataatgttgggaaagttattcagcctctctgatcctccatcttctgactgttgaaacacagataagctctcacccaaatggtagttgggaggggtatgaatgatgtatatgaagatgccttatatataagaattgcttcctgaaaattagccaaagttaatatcatgtcattcttctgctcaagagccaatagtggctccttattccttaaaggtatgggcccaaattcatttgccttctgtcttcttacacaggtatctgcaaccccagattgttcttatgtggctgtggctctgtttcccctttcatgtttctcaagtgtatataaataatatacatattactttccattggctgatcacctttttctgtcttgcatgcacaatgagctccctttcccctcattacgttgactgagattctccctacaggtctcaccttcccatatgtttattgataaaaaatgttacacagccacagaatctgatcacttccgtaggtggatgttttgcagatttaatcaccaactttgcatttactcatctactcgttcagtaaataaccccaagaacgctgtgccagacacactgtttggaattcagggatgaataaggcagatagagttgtgctctcaagtagtacataatcagaggaagaaaatagaaaaaatggacatagagaaaattgcttaccttgacagcaagcactggcttctctcttgatgagagactgatttgttgagtcatttaagttaaaacctatgtgtagaaggcaatgctctgagtatctgatgctaaatgttggtaacctaaatttataaaggaaacagatttgagtttccagggcagccttgaagggagaggatgaggagcagacatggtacagagatgcagacacccttttctgtacatgcagtccccttcctctgatttctcccaaaatatgtagggaagtatattttactgtaaaatgtgggtagtgaatgctattaccttggatgcttatgctgctggtctgaggaccatactttgagaagcactattttctgaaggagcacaagactgtttctaaaagggtgagccataataagacttgggaagaccatcaagataggagacagagctggcttcagcaaatttgtgaaattagctgagttttttttttggttccctaaggtttctataatcattattgcactaataattgttcagtaccctatatttgttcgctgaagttccagaagtagcataggaccaaaatttatgatttcaacatggcatcttccaaagtttccatggcccctgtgatttgcttttcaccattggcaagtgcaaaatatctcataattatgttcccatccagtctttaagatttgatccaaatttccatgacacctctctaaggattatttgtgtttaacacaaatacatctgagatattgagatagagattggagagagatatttcaaggaatgggatctaggtggcaaaggattcaggccatacagacaaccacttactaacaacttctgtccactgagactcacgcatgttattactcagcacgaggtccacctgttagtgaaatatacttttcttttatgacaagccatacctgatatgcttgcatacacacagactcataccacatacactcacacaaattaacacacacatagtcacgcacattcatactccgcaagaaacaaagccaaaaattaatcctgcttcttcttttggttgattctgcccgatttgtgccaggggagatcaggtctaaatatatataaacaccagagcttctcagttcaattaaatgtcccttgcacaccttaatttgagaggaaattactgtaaatattttatttaaaatttaataattttattttgttttatttttattaatattttgttaaataaaaacatatttgttagatcttggattgtaagcatgttaaagctagaaagttagcaatatttaataaagtaattgtaggttaagaaactattgtccagtaaataactgttttaattaaaacagttaaaagatgtaaaagataactttttaagtaggaatacaaaaagggtttattaaaaattttactggaccaaatggatgtttcaagttttaggagacagaaatacagaaaccctaagtatatttcattttatatgccaaaagtttattttaaatagcagcaaatagtgaagttggggaaaagtctgctatgactggattatcgctaacatccttggtgtagcactaacttgggtgtcagtgcacacaaggctggtgtctgtactttttcactaccttcttctacaatatcaccctcagctttagctggggattaatatgtttttatatctatcctcattgctgccaccctaggtaaagccatcatccacttccgttggcactagtctcatttccttctagctggtgtcctgtagctattcttgcaccctgtagctcattctcctcactggatttagagtaactgtttccaaacccaaatacaactgtaggagaatgagctctttaaaaaaacaaacaaacaaacaaacaacactcaatgacttcccataattccttaggacaaaagtctatatctttaataagcaataacctctccaatattcaatattgttttatccctgtctccttttgtattttgaaattgcacaaaacccttggggatccaaaaactggtctttttttcagtgtctaagagaccttgttccagcctcctgtgcaatgcttgacctttgtaaacacctcacctgtgccatgaatgcttttcacatatcatccccatctacccctttatctattatttcctctttattctttagatctttgttcagtcattccttcccaggagaagctttctctgagtctcttacccaggtcatatccccaatggcacactctcagaacacatgtaaaatactgaatacaactttaatttgacatctttatcctctgttagactgtagtcactatcaatgcaagcacatgtctgtcctcaccattgaatcccatttgcttcaaggacgggacacagaaggaattgaataaagtcatggaaaatgaaactcaggttggtcttctcactggcttcttaaaggaatgagcacattgtgatcctgctctgtatcgtggagaaagacccaaggaaagttcccatttccagttaagctcagcctaacctctcttaatagctattcctagttctgccattcattaactcaacttatactttccataaacatgtgtaacaagtatctgtactcctgttctatgtgtaggagacttcccacctcataagtattgaaagaaggcagaatttacttcccagtatgaagtgaagatgctagctactcccttttccaacttctcctatagctaggatgcagggatgtgatctagactctgcaaaacaagtgcactcatgtctactttgatttcaaagctagtgaggcaaaaaaaggtaaaacacaagaggtggtggagctcatgttggtgaagatggcggcaggaaaaaaaaaagcatatccgagatccagaagcagtagtggtaacagttcactcactcttaggtacctgggtacagtggtaacatcatgggacatgtggcatgactttggctatttttttttctgtgtggtgtgcaagcatggcttttcagttctctacgaaatgcattgaactactcaatgtcttagtaaattcactttctgctcaaattaggcagagtcagtgtcttgtaatttcagcagaaaaatctaactcactagcctcatacatatagtctgaaaagaaagatatgcaagtaaatagtcaattactatgtaatgttactcaagggtttattaaaacctatttacaaatggtccatatgtcttgcctataccaggtcctaggacattctagattccctacttgcttgccaacaatatttatgggaagcagtagttccctgaaaaagcactctcaacatgaaataagatttccttttatttgcaacgccttgcctcagaaggcacctgctgtttcctagaggtgagaattcagtggaaaaacatatatgtagtcatattgtttgtcataaaacctctgtgctacaagggactctaaaaatcaccccaactaaacccagttttgaatttcctttccttttctgcaatgcccaagtagccattgcgctttggctttgaatatctatagtgacaaggaacttgcaataccacatcaaggaaactctttcatcgttgaacagtcctagatttgaaaagttagttctcaaattagctcaaaatacatttctatccactttgttgatacagaataaatctattcccttttcctcagtttgcaatttatatcatttgtcatgttattttcctacatcttccttttcagtccatgttaaaataacagtacaatgtagagctttgtttgctcccagttaggatgtagaaagttatcaaaagccatcactccttctttaacaatacaaaagcctgaataaacgaaaacaaaataacaccttcttttaaagccattaaagaatctcagacacaaggaacttaaataaactaaatttcaaagaggatcagtctattcctaggtgagcaaggtccattggctgcttttgtgcttggaattagttgcctattctttttatgggtaagtgggagagcaaacctacaatatgtgaagagagttttccggtacaaggagaaatcaggaaatttttaatgacattatgggttgttaagtactataacagtgcagacccttaaacataaaattatcgctcctcatgatttttatatcttgtagtgcttcgatctcaaaggcctgctatagagaagaatggaactcatcctcaaaacattcaaaagtgaagttgaattgaaactaaataaagcttcaggttgccctcttcagattagcaactgattaaaattaagtgattagcccttccccatagctgcctgacataggaaaaagcatgaggtctctggaaaaacaacatgtatattgtctacttcagtctctaatgttttataacagtatctgccatacaataaaaaataatataggataaacaacaaagcatagaaatacaacccataatcaagaggcaaatttcccaataaagaaaagaaaaatcaatagaaacactcaaaaacaacctatgtattaaagttacaggcaaggaccttaaatgtatcacatatctgttaaagagtctgaagtgaaaaatagacatgtgggagcatatgggaaattttgatgaaaaaatgaaaattctcggcaggaaacatatagacattcctgaatttgagttataaaaaaccccaacatctaaaattaaaaattcattagaaaagattagcagcagaatgacacacaagaggaaagatggttgaactccaggataggtcaatcaaaattatctaaactaaaaatcaaagacaaaaataaaataaaataaattaaaaacagaccattagatacctgcaggacaaaattaaatgatttaactccataaattagagttgcacatggagatacattgaagatataacgaaaaaaagcattccaaagtaaagaatgacatcagcccacagatctaagtactcagtaagccccaagctagagaaatacaaagaaggttacaccaaggtaaatcaaaaatttttttaaaaaattgtaaaagtggccatagaaacagaaatatattacatttcggggaacaaaaataaaaatgccatttgatactttattgggaacaaaagacaacaggattatttctttaaggtgattttaaaaacttgacaatctagaattctatatactgttgagagaaaacaaagctgaaataaaaataacttgatataaataacagcttaaagaattagatgccaggagacccatatgacaagaaatgcaaaaggatattctttaggtagaataaaatctgggtagatgaaagccaaacctttatgaagtaataaaaggaccacagtggcaaatatgtagtaaaacatcattttaaaaatttatactgacagagtgagtggctacttaaagccaaatgaaacttcaaagtattacagagttcacaacacataaagaaatacaaggattctgctttctccatatgctcaccaacatttgttattatttgtttttgatagcagtgatcctgacagatataaaatgctatctcatggtggctttgagttgcatttccctgatgtttgtacattgttggtgggaatgcaaaaatcatgcagcctatatttaaaatagtatggaggttcctaaaaaattaaaaaatagaaccaacatatgatccaacgttcgcaattctgggtatttatccaaaagaactgaaattaggaaactgaaaaattatggaagttttagtaaggtataattgacatccagagatctgcacatattgaatatatacaatttgacaagtttagacatctacaaacacctgtgataccatcaccaaaatcaaagtaaaagacatatccaagataaccaagtttatgctgtttaaatgaaacacatttggagccttatttatctcttgccttgatggtttcacctgtgtcctaccatgtctcagtagaactcctacactcctgttgctgccagattacttaatttagtcaattctttctcttattatttacttacaaatgcaaaaggtattgaccatctactatgtgccaagtactgtgctggtcatgggttatacaaagtgaaaacaaaaacagaagtccatacgttcaaggaacttagaatctgcttaaaggaaagccccaagactcattaggcagtgtggtgggaggctaagaacctgaactctgacatcgaaaaaatcttagttccacacacagcctattattagccgtgtgatgtgcccaacttatttgcacctctataagcgtcagcttgctcattgtaaagttatttacttcatgtgaggataaatgagatatttagtacagtgtgatcttgtaggaaatacttaataaatattagccattgttgttaagtcaaataatagaagagtattctgggtattgtgaaagtacagtggcggggaagatggtaagcaaggagagtcagtattcagcgcttggcaaaagtcagtttccacactgccgttttaatcttgtcttcttttttatttgaattttctattccagtcaggttgctcagcacacaacttgtgcactctccataagatatttattaaaacctagtttccttgtctggaaggtgaggaaggtgataaaaatgtctctctcaaaaggttgtcacaaggataaagtgagaggatataaaagttaaattaaaaaactatacaactctttattatcatttcttctactatgatcactttgctcaaatgatcggttttaactggaaatgactatctattcttgattattgaaattctaacaattactaaaataaacaaaccaaccaacccaagcaaccaaccaaacaaacaaaaataagacaaaactccattttgtgttttctaacatggttcgattcaagttcttctacccttaagaaacccttgtccacctcatctcctttttattaggtaaaaaatttaaaccattttattacattgacaatataataatttatgtgtgtatgtttcataccccttctataacaattaaattcacgggctgtaatgaaagactgggttcaaacctcaaagctttctcttaaaagccagttgatttgagcaaattatttcagctgtatttgtctcagctttctcataaggaaaacaagcatactaacagtgcctattccataggtataatacaaagactaaatgagttaaaacaaatggattgtctagaacaatacctcgcatatagttcacccaataagtaataagccacccatattattattgaaaaaaaagactgcctttttcctataaaatgccaactgctagtcagtttcaaaattataacccgtaagataatggtttctacagcccaaacaattctccagcctcttataacttatttcctcccctgttaatccagcaacagttctttaagttctgggaatttcactgtatcctcctagataattcccctcccccaccacttggtctaatgtggatcatctgagacatggtaggatcccgatgaagccatccaggcaggagatagatagagctccaagtgtgctttatttaagcagcataaacttggttatgctagatatgtctgttctcttgattttaatgctggtatcacaggtgtttgcatatgtctaaactcatcaaattgtatacattaaatatgtgccgttctttttatatcaattatatctcactaaaactctcacgatttttcagtttcttaatttcagttcttttgggtaaatatccagaagtcttatttctagatcattgttggtagtgatttttgaaggaagcaaaaataaataaataataaatggggttttgattagttcctatcctcagtaaaattattccactttggacaaatacatctagcagccaattgaaaaaataatactattctgtaatactttaaatagctatcatgatattgcttttgtatccccatggaaaccttcaaagatctttcaaatacccgccaaaagaaatgaagtgtaaattttaagctaactttccacctttagactttataatcgctacagattcctcaatcctgctaagagttagtatctaccttggcttcttcctgggagtcagaaggggctgtgctccagtcagtgaacattagcgggaattacctcaatttccaccgccgctggacctcaccaagatgctgtctgtcaggccagtaaacattcctggcaccttcttctggccctaagactccccagaggaaagcaaaacaaaacagtctttccctcctatcctgtctcttattctacagaaccagtaccttcattggttaagttcctacagactttgactaagaaaagtaattttctttaatgaccttcagccctttctctcagtctgggaggcaattttgatggggttactctggtagagtaattaagccagattttcatctgtcactaaaatgttgccttggtatttggactgatgtgtttggaatgggtttggtttcaagctgtgaacttaaaatgcccacaggttgcactacccaattctctaaaaataaatgtaccctatattagtcccacaacattttccattgtgttaaagttcccagagttacctttggtaggtgttgcaatcgtcactcaaaagggttttgaagcttctaacgttaaaaaagacagagactcaatggcaaagtcttttttaattggcctccctcttccccatcacttccaaagaaaagtaatagtgctgaaaggatttttacatcaatagaaaattcttcaaagatttcatactgattacactttactcctacctaattttgaggggtaaggtagcttatttgtctcctgcaaaccagcatattataacaagaagcaatttttcactttaaaaagtagtcatggtggcagtagtggtggagaaggaagaggagagcgaaggagaaacagatatcgctttaaatatctcctgtttagatttattattttttcctgggatagtaagaaaattatttttgagatttctgggcataattgaatgagttaagccttgaagatgccaaagaaaatagttcttatggtatctcatctctttgttttcatattgatttgttcattccttaatttagtcacaaaatattttaagtgctaactctgacccaaactctgtataggaccctaggaaagagtagtaaatgatttacctgtctttctcgttcatggtttaccatttaattatatatatataaacaaaacattaacaaaatgattacttgtgatctacattaaaaaggaaataaacaagatgctataagagaatattgagaagcttgggtaggaatatggcaaataccatccagtaggaatgttggttcatatcccttacttgtacatctctgaaataaaccatcccttcatgaaattaggaaataagtgttgttccctgtgaagaggtagtaacttagcagaatagaatgtgtagaggaatggccaataaaagagatgcagagcagaaaacttcctggccttcctatattcttgaatgtagttaataatgtccctgatcatgctgattcactggcaaggtttggagattcacattttaaaataccatatatatctagttgttgaactgattgcagcttctagtgcctgagagactttctgctcttctcttgcatcaagaggataggtaaaatgagaatttatctcatgcctttcttatgaaagcccatttgaagtaaaagttgtacatcaactctcagatcaaaatggctacttctgcttctgagtaatttaaataacctgtcaaaattgagatttcccaagtccattttgtgttcagaatttgcaggtaagctcctcaatatcctggcctcttatctcagtaaaaatatgcccagaatttctagtactttctttcttcattaaccccacaactttaattacaaccaattacctagcattcccttcctactcgcagtcatggctctgtatggtgtggcaaaacgctgttcaaaatatatagttctattaagcacctgacatgtgccaagaattgtgttttttgtatggaacggatagagacaaactagaaccagttcctattcttaaaaaattcaaatgcgagtgggaatatagactctctaaaatatattcttaatgttgtgtcgtatatttactatttttttctatttgattgtaaattctgtgtccctgaattgtcattcctaatagtactgaacccaggaaccctgtgctcaataatcgcatgtgtggcctatcctcctgtgaattatgctcttcccagacacatggaagtacacctttcagaggctgatggttatcattctttcctaaagaattgattgtgcaactgacattcactgagggcttgattctcctcgcctcagagctataacccagttacttgttggattcattccaattctcttccctcatccattttccactctagatttttatttaccaatgcagataaaggttatgctttacagagctcttctagctttacagttaacttctcaaatccattttcctgtcactgtttgttaattcaccaacgtattccttttaaaaagtagaataaaaaaatatgtttattttcatcttattttacaagaatctttgtagattgccctttgagacttgattcatggatccaagatcacctgagacgcaaaactttcctggactttctgctaataattctttgtggcctttatattattttatagcgactctatgtctgtggtgggacatattaaaataaaccaggacatattaaaataaaaacaaagttggatgaaggcgcataaacacatacagctggaagcatcctcagggactattccccaaatcactcattttatggagaaaaaacccctgaaactcagagatttaagacattgactacagctacacaaaaactcagggaaaagtttgaccagatctgccttcccctactgtgaatctctaatttgctttatacatcaccatatcaggatttaaatttcctttgtgccgtttatgaggtattgtgtatagaagaattgggaagaagaagaggcgatgtttagttttgattctgtggttaaaatagaagaatccaaggaggatctgcgaagtgtttgaagaatgagattctggatttgtatgttaaaaatagaaaccatgggccaggctcagtggctcacgcctgtaatcccagcactttggaaggccgaggcgggcggatcacgagattagaagatcgagaccatcctggctaacatggtgaaaccccgtctctactaaaaatacaaaaagttagccgggcgtggttgcgggtgcctgtagtcccagctactctggaggctgaggcgggagaatggcgtgaacccaggaggcggagcttgcagtgagccgagatcgtgccactgccctccagcctgggcgatagagcgagactccgtctcaaaaaaagaaaaaaaaaaaaaaaaaaagaaagaaaccatgatgaaaataacaacagtaaatattgtttatcaagaccttatttaagccagtcatagagctaagtatttaacacatattacttgactttcacaaagccctatgtggtaggaatctttattagtctcatttcactgaagaggaaaccaacactgacagaaaacgtgccaagaatttctcatcaagcaagtggcacgaccttgaacatgttctgagtctgagcacctggttgctcaatgagaggaaggggagaaagagagcatgcgcatgggctttctgttttcagccatacagaatctaaatgggtaatgaaatttgacatcttcccagttaatccttggttattctgatgtgtctcattaacgggagatttgctgcagaatgtcccattctgttaaaaaaaaatacaatagtttgactctcttctccttagatctcagaattaaagaatattttagagtcatataattagacaatcagcctctatacagcccctacttaactgtctctcagatgtgggtgtgttttcaagtctcaaaagaaagaatctatttttttttttttgtctagacttaagcaaatatccccatttaactaaggaaaaacttaaaacattaaattacttagtaacatctttaacaggttcagcatacattcagaaggtagaaaaatatatatttccttcaaatgtttaccataattgtgaattgtttgtataatattgatatattctcttaatttctaagatggtagaggtggtgtttgtactgggtaaatgtccagcattctcttctgttacataaatacctaagtacttttccatatgtcaagctctgtgttccaaacaacttttaaaaatgcttgcattgctaaaaatgaaaacaggaatgagggctacaggttactaaagccatttgaagcaaagacacaagtataggctatagtttccatctaggaacttgaaataccattggtgatgagtacaaactctgatatctgatatcaaatgtatctcattctgaatcccagtcaataattccattaaattgaaatgatctgaacattccaatcaaaggaaagagattatagaacttcataaatagtatttcccaaccatccattgtctataaaaatggagtttaaagataaagccatagaaaaaaagtaaaaggatggaatgaagatgtataacatgcaatttttaattataagaaaactggactggctatattagtatcagacaaagtagactttagaaaaagaaatgttactggagataaagaggaataatctcataattatgaaagggttaattcattaagaagatataatttttctaaatagtatgcaccaaatagagcttcaaaatacataaacacttgtatttaccaaaagtcttatgcaaaaatatttacagcacctttatttatgtatatactttttgctgagctgtaatcttttatttcatgcttgcaactataaatttattaaatcaatcactagtgctacaactacagatgtatagatatattaacaacttaaaatcggtttactttttttttcacctttttaggttcgggagtgcatatgcagttttgttatataggcaaagtttgtatcaaaggggcttagtgtacaggttgttttattacccaggaaataagcacagtactaataggtagtttttcaatcctcaccctcctcccaccctccaccctcaagtaggccccactgtctgttgttcccttctttgtgtccatatgtactcaatgtttagcttccacttataagtgagaacgtgtggtattaagttttctcttcctgtgttagtttgcttaggataatggcctccagctccacccatgtttttgcaacggacatgatctcattctttttttgtggctgcatagtattccattttctttatccagtgtaccattgatgggcatttaggttgattccatgtctttgctattgtgaatagtgcttcagtgaatgaatgcatgcatgagtctttatggtaaaatgatttatattcctttgggtatatacccaataacgcgatagctgggtcaaatggtaattctgttttgagttctttgggaaatcacccagctgctttccacaatggctgaactaatttacatttgcgccagcagtgtataaacattcccttcgctccacaatcttgccagcatctgtaattttttgtttttttaataaaaattattttaactggtgtgagatgtatgtcttcgtggttttgatttgcacttctgtaatgattagtgctgttgagtattttgtcatatgtttgttgggcacatgtatgtcttcttttgaaaagtgtctattcatgtcttttgtctgttttttacaatgaggttgtttgtttgttgcttgtaactctttttaattccttgtagattctgacctttgttggatttttgtctgtttttttttaacgaggttgtttgttttttgcttgtaactctttttaagttccttatagatactagacatttgttggatgcatagtttgcaaatattttctcccattctgtaggttttctgtttactacgttgaaaaagagtttcttaattaggtcctatttgtcaatttttggttttgttacaattgcttttggcatcttcatcatgaaatctttgctaggtcctatgtccagaatggtatttgctaggttatctttcagaatttttatagatttgggtttcacatttaagtatttaattcatcttgagttgatttctgaatatggtgtaaggaaggggtccagtttcaatcttctgcatacggagaatcagttatcccagcatcagcatctttatttatgataaaaagctgaaacagccaaatgtcaatagattaacatttgtgtatattcatacaatgaaatacatttgaggaataaaaaaggtatgaatcattgatataagcacaaatgtacatcaattttttttgcttcttcatatgtctagtaatttttattggatgtcagatgtttttaatgtcacattgttgagtgacattgttgagtgacattgcttttctcatcttctttgaaggtactttggggtttttttcaggtgtcagttaagttacttgttgaactacttgatactctttagattgtttttatgctatgttaagtcctaaagagtaatagtcatactaggtctagtttaatccacttcataagtgatgaaattgttggcatctatgaataacctgtattttgaataagtttcctttatctaatctggctgaatgtgagcatctcttagctttgtgtgagatttagaaagtttttttgagctgacagctctcaggtagttatcatttttaccccagaaattgttcttgttcatcctcattttctttaatcttacatacttgctgcttagtttttagacaaagactcaagaagtctcttatagtaccttcatttccagccacctcagtacctagaactgtaatttcaactcaatgagactactgcattctccttagcctttctacccatgcaattttgtctggaaagtgttcctaggtagatagcctggggttaccatagggctcagcttatttatttcttctttctcaaggaacagagccacacagtaatattgctcaatgccccaaaacagctgtttcatagattttgttcaattttctaacttaaaatcacaggatgatgagaagttctgcttttggaatagcggcatcaacagctacatggacctgcttctgggaaaaacaagtgtaactggtaaaatttctaatttaaaaagagttaaagttttggaattgtcttaagagcatacaacaaatgaagaagcatttttattttttatttttgtgagtacataataggtgtgtatatttatggggttcatttgataccttgaggcaggcatgcaatatgtaataatcatattatgggaaatgaggcatctatcacctcaagcatttatccttttgttaaaaacaatccaattatattcttttaattatttgtaaaagtacaattaaattattattgactatagtcaccctgttgtgctatcatatactaggtattattcattctttctaatgactttttatacccattaaccatccccatttcctttccaccctccctactactcttcccagcctctggtcaccttccttctattctctatctccatgggttcaattgtttgaatttttatctcccacaaataagtgagaacatgtgaagtttgtctttctgtgcctggcttatttcacttaatgcaatgatctccagttccatctatgttgttgcaaatgataggaccttactctttttatggctgaatagtacttcattatgtataagtatcatattttctttatccattcatctgttgatgaacattgaggctacttccaagttttggctattgtgaacaacatgagagtatagatatcttttaaatatactgatttcctttcttttgggtatttacgtagcaaagggattgctggcatctctatttttagtattttgagaaacctccaaactcttctccatagtggttgtatacatttacattcccaccaaccgtgcgtgagagttccctttttccccacatccttgccagcatttgttattgatttcctcttggataaaagccagtttaactggggtgagatgatatctgattgtagttttgatttgcatctctttgatgatcagtgatgtcgagcacctgttcatatgcctgtttgccacttgtatgtctccttttgagaagtgtctgttcagatcttttgcccatttttcgatctgattattagatttttctccaaaagtgttgtttgagctccttatattttctacccattaatcccttgtcagatgggtagtttacaaatattttctcatgttctgtaggttgtcttttcactttgttgtttgtttcctttgcttttcagaagcttttaaacttagtgtgattccatttgtccatttttattttggttgcctgtgcttgtggggtgaagaaacatttcttaaaagaaaatccattaaacctcagtgagaacagcaagagtctgtgtgatatgagttataacttgctcctctcatcctaatgtttccagatcagcatcatggatgcccccactttgggaggatgtgctcaagaaaaacagggttccttctattctgaactccaaaataaaggataaggtcaatatctccctcaagagagttggtcatttctcatccccatccctacaagctcactcacatcctccaagtaaattacagaggctcaaatccaagagagtgtggccaagagtgtggcccttcttccccttacaaatagagcagaagctctatactaggcacagcaggctaatgaaaatagggctccaattgcccttttacagctcactcacagagtgaagcttccaaatggggaaaggcaagccagaagactagaaggtacttccccaacatggctctcttctcatcaagcagaggtaccctataagaaaagtggaccactgttcctgaatctgcagcttcagatcagtaattgagagaatttcctcactggtagaactagtccacaagggcagagagctctgaagctgtccccaaataaacaaactttatttgaaaaagaacctggaatagctcaagcctaagggtgcttccccgctttcccccacttaagattggatggcaagcaaatgagaaaaggcatgtagctaaaccacagactagctagtttaccagagagaaaaatgaaaagagaccactaagaagagcttctccagggacagaacaaacctcaaagactagtctcaaaaactacctcagcaaaagagctccaatttaattggttcagattgtgtagtaatttatgccctagggcatagttggtaacactggcagaatcgagcatcaaatagaagaaactaaaaggtcgatgtgatgccaacagggacatagaacttagcaaagagatcagggagcgtctgagagagacctgctaaaaccgctgtcaactgaggttgacttagcgcattctgaaggctgtgctctctgatcagcaacttcagagacttagtagcttttgttttaagaaccaagttttcgatgtctgttgtacagtgtaagataaatgatagagtgtttgtgagatgaaatgaattgacatttataaagcatttagcacaatgctagtgtggagtatttggtctataatgtcaattgctccccagaataactgaaaataagacagtttataaactcaatattagacattaaaacttttatctatgcatatattcctagcattataatggttcccagagaaggcaagaagaaaagagcttagttcctatcctttaggagcttacattcaaaccagggtgacagtaagtggaatctaagacaaaatttagttactgtggcagaagtaagtatagaatgcaatggaaatacatcggagagtagaatgaatatggcctggaaatgggtgaattgtagggaggacttaatggagaaggctttgatttgtaccttgagttgtgcagagattgctgtcagacacaggttgaacatattgatttctttcatttttaatccttcaggaatagtatctaggtgattattgagatagactagagcaggcataaatcaataagaagaagggtttcataagaaaactggagggtgcaccctcatacctatagtacattttggctggtaaaattatttgtttccaatccactcgcagtagaccacggtattccaagcagacctcagtcgcagaaaaatccaccctccacatcattcttcccaggaattggccttagtaggacaaatgctcttcaaacctgcacagcattaattccatcgctgttattctattgctgtttcaccccacctcatcttatgatgatcagaagagaaaaagctgaggaaaaaaagagactgtcaaatacagcccttatatttgctaatagatatgaaaaaaaatgccccttgagctgtgattggttttgctcaggcctgttattctcaacctctgtgtagtgctgtatacatgtctatcattattcctctagaagaaaagatagggtactgataatggattatgaagcattcctcacactccatgatgagtataatataataaagataactgccaagaactatactaggtccatcaaatattcactccctaatttacactttaggtattatatctgaatgagtaagagtgaatagatatttgtcttattttggttttcccatagcagaccctgagacagggattccaggcaaggagttaatgtgagaagtgatcccagtgaagtgggtaagtaaaacagagaaaggaagagtctttctctgtagagggatgcttatcaagaaagttaccatatacctgcttagtatagcttattatatatgcaaattgaatcacatgtaattatcacatgtaatcagctgtatttctatctctctatatataactatagttatagttatatatatttatatggttaactatattatatatacttatataaattgtatcacagatgatcacgtatcatacgtgtatgatgtgtggaacaggttcaagtgcctgtttggttttaagatatgcattattattcttatttaatattttagaaaacttgcaaggagaggtgaagttgcttctacaaggtcaaacttatcattaggaacagaataataataatctgagccagaaaaactgtatggttctcagttcttaaatttctagttataaaagtttaacctatacctcacacccattaagatggctactacaaatagaaatgaacaaacgttaaagaggatgtggagaaagggaaaccttgtacactattggtgagaatgaaaaattatgcaggcactttaaaaaaatagtatgacaattctttaaaagaattaaaaatagaattgccgtaagatccagcaatccccattctgggtgcatatttcaaataatgaaaaacaggatctcaaattactatttgcatacctatattcatagcagcattattcacaatagccaagaagtggaagcgacacaaatgttcatctacagatgaatagattaacaaaatgtttatacaaacagtggaatattatttggccttaacaagaaagaaaatcttgccatatgctataacatggatgaaacttgaggacacgaggctaagcgaagtcagtaacaaaaagacaaatattgtatgcttccacatatgaggtatcaaaagtagtcaaatccataaaaacggaaagtagagtggttgttgcagggactgggaggaagtggaaatggggaatggttgtttagtgggtatagagttccagttttacaagatggaaatgttctggtgaattggtgtacgacaatgtgaatgtacttaacactactcaactgtacacataaaatgactaagatgttaaaaacaaacaacatttaaattgtatattacatatatatataaagattattctatgtgaattaaaccttaataaagctgttaaataaaagttcaaatcagttttccagttagttccttagaactggaggaagccttgctttgcatgtagttcaatcacccactcaacgcaggaatctcctcttcttaattcactcccttctagataagctcattcaccctggatgaccccaattatctgaaaaaaaaaatttccccttataattgagcttaaattcacaaataggtattacctaccattagtctgaagatccaaaaacaatatcaaatatcaaaatcccgttctgccctatctggtcttgtaactctgcctcagaacatgtctttttttcctgtggcatatctcttatgataacgagaatgtatgtaggactcaaaatcaaaggcatccaaatgtctaaccaggaattgtttgaaatttgaccagagtatttagggttgttcagaaaagagatgagccctccattcttcacaccttcccccatgtttgacatttacactctgttaataaatccagagaggacagtaggaaagaatactcaggatattcaggatgtttcttatattgagaaatttgtaatgcaaaggaccattggagcgtgcaagggtgcaacgctgctgacatgtcagaccacggagtttgctgggttgtttcctattctttcttttcacagatctgtctccaccatgaaacattattatcattaccagcatgccatgactttgaacctaaggccttaaatttgctctccatgtgctatgcattaataaaattgatatactgtctatgtactgagtacagtgagggttaattaaaatacgtaaagtacttcgaggccttttccttaaagatgtgagctgagtgcattattattactataaatacaaattgaaaaatacaatcacattctccctgtagacatctgtactggagatttttgcttccaattctacagtgctcatgataaggtgataacataagcaatctagcagcaaaatttatttttatctgcattctggaacaaagatttaacctcttgaggaacaacccaaagttaaaacgtatataaattttttccacatgtcactccgtggagtttaattcagatagcagattttttttcatcccttcaatttcacaaaggcagggataaatcaagatagatacaaggtctcttttgtaccaaatatattttattatctaatcttaaaccctggaagatgatttgtaccaatgcccaacaagttagtccaactccaaaagactctgtgcatgctgagacgaattggaaatgcaatgtcataggagaaaataataataaaaaaattgaaatccagaaactaatcaaaattaaatacctttaaaggtaataagacccagtttttatgatttggttaaaaattaggtaacattatcagagtgatttggagcaaattgcttagtctctgtaagtctcattttccacatcctaccttattcatgtgaaaatggatcaaggaaatgcttgccatggagcccaagggcagatgatcaataattggtagctattactggggaagcagtttatgatggtggttattatgttaggtcctgaagtcagactgcccatatttgaatataggctgtgacatttacaaattgtgtgatcctagggtggttacttaatactctttgcctcctttttctattctctaaactgaaataataatattgcctatttcatatgatgaggaaattttatgaggtagcatgttgacagagctggagcaatgcctgagtcacaataagcattcacataatgtcagatgtcactattattatcattgccatcatcacatcacaaatgcaagtttttaggatataaaagctatgatattccatacaatggaatactattcatcaataaaaattaacgaactagtatacaacagtgtggaaagcaaaactataggaacaaaaaatagatcagtagttgtcaggggctggggatggagagagagattgactataaaggggtagcacaaattttaggggtgacagaattgctctgtgttttgattgtggtggtggttacaagactgaaagcctttgtcaaaattcacagtaatctaccccaaacagagtgaattttatcttatgtaagtaaatttagaaaggcaactaaaaaaaagtgaaatatgcaatttctattgcccaagaacttcattcaactcaaaaagagtctttactagacaagtctttagatttaaatttctaaaaattagcatataataacatgtaaggttggtgctggagaagaaaactctctactaaatatagcttcagcactttcctaaatcatttgtaattgagttgttgactatttagcctttaaataccagaccatagctccttaatggagccctttgttctccccagcgtcttacagtgggactgaagtattcaatttttagaggcggtggatctatttattacttgggttgtggtgatggtaacaggagtaaaatttacatatgtctaaactcaccaaatgggatacattaattatgtgcagtgttttgtatgctaattatatcttaataaagcttggggagggggaaatcttttaggttagaaggcctctcagattatggcatttcatgtacttactgaattagccatttttaatataggagttcctaaattactaacatttccaaaagtgatatttgatggcaaaagtaatatccttgtgaagtattaagtgatttttatgaaaaagtcaaatgagctgacagagcataataattacattgtcaaagaatacaagattccgctttctcaaagccatctatattgcctggttttggatgcacaggctgtcatcaagatggtaagatttatttctcctctaattgcaccatggcagccggtattacacgcaagatatctagggtgcccattgttcagaagtgtgcaaaatccatggcattgcttatgtacgtggttatgtacacaattaagagaatggcttgcatgctgatggaactgaaaaatagagcttgtatgaagtcctggggtggtgctgttcaaatgttttaaaatatttttaaaaactgtgatttattcatcagcaggaagattaaaagcattttccttccacaatagtatgttccagactctaagctcagaggaactgctcaccagagatgtttgtccttttttgtggaatttctgtggtttactttcttatgcattaagtatggagtatgcattattaacccattatgggtatatcaaagtctgtttgtggcctattcatataaccttggaaatttcacacataaatcattagagaaacgcaatgatctaatgcttaggaccagggagcacagtcaatagttggcattgttctttcgagctgctatgtgtgtcattggaggacaacctggctgatctgcatttactctaacacctcaaatgctcatttcttttcaatatcatgtatttaatggaatttacgggacacctatggggactaccttgcttttggctaaaaacttgacgccaacacacagcaacatatatgtctcactcagttctgatgatgctttagaatagtgctggtgaactaatatttgtgcttatggaaaattagaggacaaaacaaaaccctaaactgtgaagtgacatgctgaattgaaattaattagatgcgtcagtgggtggcaccgtagagcttagttattcagagtgcagttttcagcatcggctttcctaagtctgaatctgagctttgctgataactagttgcatgtctgtgagtcagttagttaagctactgtttcttcatctgtaaaattaggattatattacctgcttcatcagctactgtataaattaaatgcaattatctgagtaaagtgtctggcattgctctaattaaggctgtgaatggcaccctaactgaagaatcctatcacttacgaaggcttcatcactttaacactcatttgcaccttgcagtgttgaatactttttctttcctcaatcatacttcggtaggctctcccaaatttttcacctatctcccattcatcgtcctcatcttgacttctaaatgtgtttctttctcatgctcttcttcttttccatcttaaatgctgttgctctccggagctcactctggattctcttctcttctacctactctccttgagggggtctcatttacagtgacacttcgtgtaatattaactcatatactactcagtcagaggtctatatctatagcccacagctctctccctagagaccagtgtcctcaactatctactgggcaccttcacctagggtcttgaagttatctccaccacaatgagtttgactaacccatcccaaaaacacaacagattgcactgtcttctatcttactttctttactgtctgccattttcacccagccagtgatggaagccattaacttgagaatcatactcaatttctctgctcatcgccctccacatctagtcagttatagagcagagctgatacaacctccagatagatctcaatcccgccctctccttctgaaaatcctctcccagctgcctccacatcacatcctcctaatatcagtgacccctgcagccacttctcagtctccactcaagtaattttgtggaatctctcattatttttatgttgcaagaaacttctaatggagtctctgtttcctaatattgcccttctctctcggtttccttctgcaggagaaccactgattcaaagatctttctgaagttcctacttaaaatacttcaaagacttccagtagtctttaggatgaagaggaaaaaaattcccttatattgtgggccctgcaatcccataaacttcctgactgaacagctaatgttttccttctatttgtagttacagtgcataatatagactgtaatttggtttggctctgtgtccccacacaaatctcatctcaagttgcaatcccccggtgtcaagggaagggtctggtgggagataaatggatcataaggacggttcccccatgctgttctcatgatagtgagtgggttctcacaagagctgatggttttaaaagtgtgtggcagtctccgctttgctctctctctctcctgccaccttgtgaagaaggtacttgcttctcctttgccctctgccatgattgtaagttccctgaggcttccccagccatatggaactgggagtcaattaaacctctttcctttataaattactaagtctcaggtagcatctttatagcagtgtgaaaatggactaacacagactgggtccaaaataaacattttgatgattcctagagaatgaatgtcaacctcttcaattaattccctgcctctcaaaattccacaataagagtcctttactccagttgtagaaaactgcttgcaagtctcttacactccttgctactttttcattccatgtctttgcatgttctatatcctcatttattcaactttgtactatatcttggggacttaaggagtgaaaaagataaacacggtttttgtccttggaaacataatagtttagtaggaaaaaaattaaacaggtatttaaaatataagtggaaatagtattgtaagtttcctgtagatctggttaaaaaaggagaaaaatgatcataaagaaataagtaactctcatgtttattccaagaactatgataaacccaacaaaaatgataaagatttttagcaactgacttagatgtctgtgaaatattattgggtaaaaaaactagcttactaaacacatgcttttctatcctttatccaccttatttaccactacttttttttttttttttttttagatggagtctcactctgtcactaagctagagtgcagtggcgtgatctcagctcactgcaaccttggcctcctgggttcaagtgattctcctgcctcagcctcccgattagctgggactacaggcacacaccaccacgcctgactagtttttgtatttttagtagggatggggtttcaccatgttggccaggatggtctcggtctcttgacctcgtgatctgcctgtcttagcctcccaaagtgctgggattacaggtgtgagccaatgcacccagcccttatttttttttttttaatttttagctcaagtactaccatctcttgaaaatactgcctgactacctcagtcatcctctgcattttcttgccacagtagcatgggaaatttgtcagaccttttaaaataaactttttatttttgaataattttaaatttacagaagtgttataaaaatagtgcagagatatcctatggactccttcatcaattatcatcttaattaccatggtatgtttgtcaaaataatgttccacactgagtgataaacactgttgtaaaacaacaaacaaaaaaacatagctctatgaattatttgtgtagcacagacctccccacctcacccccagtgcatggcctgccacgggttggttccctctagagactgttaaatggtcttccaccatttggataggttaatatggaactctttctttttcctttagcctcaattacatgtttctatgacaggattttgtgagcaagtacagctgctagtttctaggtttttgcctttttctaccacaacctgtatatacaggaaaaggacaaggtcttctcagtaggtggaccatatcttaagagagaatcacgagagcatctcaatcattcttgccccagtcaagggcctgggcatttttatcttttgtccagctgtctaagtacagtattgattaccagcccttttcagacatctcttaaaagtaacaaaaacaagtaaatgaaagtcatttgaggatatttgaagggtcagtggatacccaagaccttgtgattttaagcaatgctttcaagcagttcctacagtatctatatttaactagtcctttattttgtctgtacataaatgtttgaagaaagttgttaattcttattttgacgttaatatgcattgctattcttagcatagactcaattcggctcccgagtcaatatcttcctatggcccctatatatcatctatgtaaactttaccaatattgaccaaacacctgctgtgtgagcagtcctgaactaggcactggggagaataatcttaagcagaaaataccctgcccttgaacacagaggtaggtgctcaaaatcactagacttttgttagatttgttgtcttaatatgttcaaatgacactagtaaattggctttacctattcatagtatgttgttgcaagaattaaatgatctaacaaataatattcatagtcacatgaatactgaaaacagataacatttatatagcacttaatatgtgccaggcattctttcaagtgtgttctattaattggtttactaagaaaaaaatctgtgaactacaaaatattctaaaaatcaatgtgtgactgctattcttgagtatgaggctacatcaagcagaagttaactcttcaacgtggaatgagcttctgaaataaattttgtggtgtagcatttacatgctggcagagggtcaaagaaaatgaaggccaaagaggcctggagagactacccagggttcagagctatatttgggataaagagcttggagggcctgggtctgcatcccaaccaaagtcattcatggcatcatcattatcccctagtcattgtcattattaacatcatcattgctaccagttcttattatttcatgatcacttacttcatgcgaggcactttgcatgcgctatttatttaatcttcacacaaggaaatcctgggaagtaggtatcatcatcctcaatttatagacaaggaaagttaggctcagtaagaatatattacttataaatattataaaactagtaagttttataactggtaaaacaagaatttgaatctatacatggctgaattgagtcaaagttctttcttgtacctttcatgtcctttctgtagaagggaatcatgataattcccaccacccaattgtagctccgaaagcaaggtcatcattcattctacctttcctcaaggaagctaaaggatgccaggaataacaaggcctaatggacaggaggtggtctgtttttctaaaaaagaatgagatttgtcttaatgaagggtaattaacttcaggagagattacatagcttctgcttttacatcatcattatcacaagcttgtaagttttaaatatttccatttcctttctgtcattggctgttctcaaacagtaaagaatgcagaatcaaatcttgtctatttcatattttgtctgattcacataatctctttgagtgcagggataatgtcttcttttagatcctttttagtctcacaatatttgttactggtctggatgtatatcaggtatgacagttaatctattaattctgtgaacattgggggtagaatgtgtttctgaaagaaatagggtatttcaagttagagaacatcaggttaatcttgtctttgccatttattatatgtccttttataagaaggtactttagtaatcttattcttctcatttgaaaaactgggattatgttccacagagaatgggtgtaaaattaaaataatatacgtgatgcaaaaaagcaggtccattgctcacttgttcagagtagacattaatattcactctttttatgtttcctccagtaggattagtcaaacttcagaaatcttctcaacacagagtttcatacagtatctacccactaaaatgaagttggtgtgtagcttatgatttttatattgttccttgcctaataggagaaaacagcaagcaaatagataatttcaacactatgaatacagggaaggaaagatagaagagaatccttaatatataaaagaagaaagagaaggaagttggaagggcttttcaaggagtcagcatcagtgaaatgaagatgatcctatagcaacacagaagtagaggatacatgggagaatacagaaaaaacatatgtagccagtcacaggctagatgacaaaaatcttataagacaagccaattcatgattggaaatcaggggagtggactatgattgtacttcagtaaaattattctgaccacaatgaagacaatggattggtttagggcagggcttgagctagcaagatgtttttatgggttattaaaggaatgtaagtgagagaaattatgtcttcaactaagataacagcagtagtagtgttgtagaaaaactgggttcttgtcacatgaccatgaaagattaggctcagagacacttcgaagggtgagggggagtggaatttattgggcaaaaaggaaaaaaactcagcagagcaagaggggttcctgttaacaggcccccatctcacagattgaatcccaggttaccacccaggaacaggagaggccaggctcctctcctctgcaaactgggcgaacttcccaaggccccgccctgtcctcccagtacacaggtgggcattattcagaaagaatccctcaaggaaaaagggggccttcatccaggaaggcagtctggtttttcagccttcaggctattttaggtttgaaggtggggttttctgcctcctgtctctattagtaggaatagaggaagttattagaggaagttagagagacttgaaaaatgctaaaaggcaagaacagagtacatcttttgactgactcttatgagagagaagagaagaagtaaagttgttgcagaagttgaatggctttaactgcaagagagataacagaaatcaatggacaaacagaactggttgaaaaaagacaataaggtctgttgtgatgactttgaggtgatgaaacgtgtatttgagggaaaatccccagcagtcaaatagaaaaacttgccttgaataaaggaaataagttaaaataaaatctatatctttaggatccatcaacacatagaatataattaaaaataaatttgtggataaaattgtccagggtgacagtacggagaaagaaggagagaatctgaacaccaaactttgaaaatagagacatttaaagaaaacacttactagaagaattctgataaggaaaagaaaatacgaaattatggaagcccactctacaaaaagtttatctagggaggagaaagaaatacattatttttttcaaagaaaccaatgaaggctatcaaaatggttacctagggatgtgggtagtgaaaattcagtaaaattcacatggaaatggggtaagatggtgtcttggtttatctgtgttgctatgtagaaatacctgaggctgggtaatttataaagaaaagagatttatttggctcacagttccgcaggctatataagaagcatagtgttagcgtctgcttctggtgaggatctcaggaagcttccactcatataggaaggtgaacaggatcaggcatcacattgtaagaaaagaggaaagagagatgggaggaaggagccaggctctttttcacaattaaatttcctgggagctaataaagcaagaactcactaattactgtgagaataacatcaaggcatttatgaaggatgcatccctaatgatccaaacacctcccaccaggccccatctccaacactgggaatcaaatttcaaatcaaactcattcaaatcaaatttcaacataagatttaaaggggacagacatccaaactataatacataggcaagaatctaggcaactgaaacagctttaggaaaactgaaagggaagaagaaaaaaaagtcttcatagtttctcaaccaactaggggcaatagagcattcattattaaatgatttattggggagttaattgtaaactaaaattggaataatttcagtgtaaatatagtcttcacaatccaccaccgtatgtaagaagatcccttaatctaaatttggctcaattcactaccattaacaagttccaaaatcatagcccctgaaaaaatggtagtccgccataagtttttcaccagagatcttctagtgaccagcagtagctctgtaactgtgatagcattcatgggtctggaacttactgttattattctgaggttcatatttggaaggaaatgccaattatgttcaagtgatttaaaaacagtaatttagagttatgtttccaatccagcctctattcctcaaaacctttcaacagcaactttttcctaaattgtttcaggaatagagaatacatacagagctttctcaaatcatgatgatctgatcaatgacttctgttaataactgggtttttctttttggtgtcagggcatttgtgcaccttctgcggtaatgtgattatctgagagtacaagaggatgcatgaaaagttggctggtagaaacaagatttggaagttgtaaagcaactctggcaactgcttagcactgatggctattgtttagtctgcacaatgtcatccagcacaatattcaatattcttttaaaaatagtcatgagcatttcaattcaaagcacaaacatggatttttgttttcttgtgaaaaatctgggaacctggccccagtgatctcacattgccttcgtcatcaccatcagcaggaactgagtcaagcttggcctttagcatgtactctctagtttgtcactttctccacttctccctatttccccttggtcctaagttccggtgaaagttgtcttttgttgctgttgtggcaattatgcttaaattttcccctaatgtttagagaaaagtcaaatattatttggatacacatacttagcagaagtaggtaaattaaggtagtgcaagatagagttatgcttcaacaagaaaagaaagaaagcgagaaagagaaagaaaaacagcacataagtctgtggaaatggatttcttgtttactatgcaaaccaagtgcaggtatgcatgaaaaaacacgctatatgagaaaaaacaagcaatgtaaagcaaacagaaatcatgtgtagatgtgcaagaaatatcaaacctgcttaacaaatttttatctctgtattagtcaggagccagtgaggagatgtaacttatgtcaattagtttaacagagaggatttaatatgaaaaataaaaactgcatattgaagaatcacggacagcaaatgtaggaagcagctgtgaccccccggggctggaagaaaatcaaggaaaacgttgtacttgttcaaccttgaaggtatgtgaaagggcctctgtaaagttcaaatcaacctctgagaaggggcctggtgagactgcaacccagacttttgcagaaagtagtgccagctggtatgggtgtctttgaggagaaatgatgagacttattctgccaaagttggacaaactgaaaattataatcccagcactgctagtcctggaatgcactgctgtcactaggatggagaaatgttgctaagtggacactaatgggaacagaaggaaaactaaaactgaaacaaaacagaaacaggaagaaaaccgaaaagacttaagttctttcatcctcttcaagccttccagccgccttctagtgcctccgtgagctgagcctctagtaattggctaagtcaaaatgtggttttcagagatcaggccctagcatcacaaaatagtataaagaaagaggttttgaaaatgaaagtcaatagcctaatggctgctacagctatctaactggtcctttatctgctagagtttgtaatctcggccttaaagataaaattaaaatatttaacaggcccctatatttgtataatacattatgatctataatgtccttttacacattgatttgtgtcaacttcatgcatttaagctccacaattatgaaaggcaggaatggcagatatggtcacctcagttttccatatgaggagaaggaggtagatagaaggccattgatatgccagtcacatgaatgcaaaagtcagaattgcaaccaagatactctgtctaccagcccattgtctaatcactgcagcacactacttctataaatccacaggtaactggactcctaaaactaatgaagttcacaaatcccactgccttagggaggagaacactggtgtttggcatggctcattgtcccaggtcagagatgaaacccatttgtttgctgactggttttattaagttctgaagaaaaaaatatacctgtctccagtggaaggtattgggctatctgagggcaattgaatttaatgtttcctggaacaccaattttatgtcttgtaaaaaccctgaaggaatgcaactcagcttattaccctaaaagaaccatgtcttggtttgcaggctatcttccagtgccagtaaggagcatagcttctgagatgcacagtgatattttcctatcatcatgggaaaatctgggtgaattagggggaaaacaaaacaacaaaaaggcttcccttccttaaaaaacagtattgccacctgccaggaaattggaaaaataggtacacaaatctgtcaatgaaaacaagatgaaagttaccttctggactggtgcagtgtacatcttgaacagctgtaagtggtggcctgtgttttctcagttactagttccacagactattaaaaagttttatataaggcagtggattatagatagttatgcttaatttgtatttgctttgtttccattattgtacgtgtcatatcctttgatgggttttatggatgtccagacaggagcataattacattcctcagttttctttgcccaaggggaaaaataaataaaacattttcttcagggaccaactacagggaaaatatactgtgaaatggatctggaacaacactcatccaaagacacaccctgaatttcctcccttgttcactgccctttacctcagctttgctaaggaagagaagcctggtattttttttttttttttacaaataatgatgtataagtatctgttggggtcaggtcgagacagttacttcttatgcttcatgattccccaaggagattttatttatttgatccctgatccatacaaatgtgcatggaaacacacacagaatccaaattttggatttctgggtgaatacttttatttcatgttgccaattctctcgttctctgccccctctaaaaaaggaatcactaacctgataagagatattggggacaatctgacatcaactggattatctcaaacaggaaggcgttggcacttcactgaaatacagggagtggggcccatctatttggctctatttctttcttcctctctccttcactcactcatgactataaaatacattttctaccctagaaatggcatgggctttctagtaaagttgttagctcctttatgactggaggaattacaaaaataaccaggctactgcttgccaagtatactggagagaagtgttaaactttgaatattgaactagataacattggaaattgtgtacatcccaagattctatttttatagataaattccactaaattttaactctaaaattccaaacaaatgtattcacgaaggccaggagggcgtagtgcttaggcttgtgagcttggagtcatgtttttgtattgcattcccagttctgccatgtaatttcttggttatgttggagtctcagtatcttttcataggaaataggaacaataaattaataattaaataaattatattgataaatagaaacattttgatcactgaacgtaacaaaggtatatagtacagtgcttgccaccttacaattgctcaatgaatgagagctgtgattatcattattagtgaatgcaattgaaagcagaaggaataataaacaatttctccagcagaaaactaacaatcaacagaaggaataataaacaatttctccagcagaaaactaacaatcaaacaaaacagtggaagagagtttgaggagaacaaagggatacagatctttcgttggcttggaaccatacggatctggggacagattgtcatcacaactcagtccgtttgtaatattgacctgaattttaatatgcacccctaactcagattcctctttctgcagatttacaacaactctattctagagccattttctaagcaccaagtaggagttacaaaaccagggactaagtaaatataaatcatttagtcattcattacttcaataaatatttaataatatctgtcacagtcagtggatgaggtactagagaccaactggtgaacaacactggcttaatccttaccgtgatgtaatgtgactcactcttggagtggtggtaaatgaggggaacttatacaggcaaatctctctctctctgtgcctctttctctttagcaaaaatggaaaaattcctttgtcatatgactttgcagcttctctcagcaagaagtggaatctcctattcttttaaccaaggcttacccgtgttactgttacttgatttggtcaatgggatgtataaaaaatgcttctcagtctcagaaagaagcatgcaatgtgcatgtcaatggactttgccatctcttgatattattgggagccctgcaatatatgtttacataagtcagaatagtattaattctttgggcaggagtgtgtgtattgatttggaagtggcatgaaggagcactctggaactattccatatcattatctgggtggtagttaaacaggtatgtgcatatgtaaaaactaattgagctgaaaaattaaggacttacacttatgcatattgtccctgtttatatacacacatgtgcacacatgcacatgcacacacacacataaccaaggggcaatggctcatgagttataaaaaaattgcatgagtatagtatcacaggagctagggataatcatgttcagctatgatgaatgtggtcaaaagattgagtaagatgaaaatagtaagtttgtactggatcaagcaatgtgggggttgttgatatacttggtgagaacagttttcatggaaatagttggggagagatcccattttggagtaggtttaacagtgaataggcggtgagaaatttgagatggtatcacatctaaataactctcttaaatactttgttaaaagtaacaaacaaatggattggtgataaaagttaatttgggagagagtgttttaagtttagggatactaacatatgcttgtatatagataagaaggatctagaagacaagacaaagttgagatagcagaagaggggaaggataaatgaaggagaaacatttattttattttattttttatagccatttatagtcttaccaaggagaagcatcgaaaaaatttagaattttaaaataaaattactactctactatattttcattggcaacctgctccattagtaggaacgtaatatatgtgaggtgttatcatttctattagtcctaatctacgctttactggatgagcgacctagactcagctaatccctccttaatccctaactgtaaaggaagagtcttaacataagaatctgttaattctgtgacagttacaaattctagggtttttttttttttatttcatcttgatcacttctgttctataacatgcagccacagttttcttacaaagatcacaaaagattacagacagaaaatatcccattggccaaatcaagtaacacacaagcctggattaaaatcttaagagactctacttcttattgagaggagctgcaaagtcacattacaaagaaatgttcccacttttgctaaatagagagcgagacagagagagggagagagatttgtctgtgtatcttctccccactaacctccactccaacagtgagtcacattacattatgatggcaggaaccaagccagtgttgttcatcagttggtttctagtgcctcatccactgactgtgacagatattaatgaatacttttgttgaaggaatgaataactgattgatatgtaagacttcatacataacacttgatatgtattaatacatggatatgtaagatttgatatgataacactttgtgcgtaaaaaataacagagaaactgattggtaataaaagttaatccaggagagagtattttaagattagggatactaacatagacttgtatattggtaagaaagattcaggagacaagacaaatttgagatagcagaagagaggaaggacgaatgaagaagagacatttaccaattgagaattttctgaaaaagttaccattatattgttattggctacttgccccattagtaggaatttaatacatgtgaggtgttaatatttttattagtcctgatctacctttttagtggctgggggacctggactcagtgaactgctttgtaacttctaactgcaaaggaagagctttgacatcaagatctcttaattctatgacagagttacaaactcaaatttcttatttcatcttgatcacttctgttctgtaacatgcagccacagttttcttataaaggctataaaagaatagagacagaaaataggctgaaaagctccccccggaaatctaagatttatcagtagagttgtcttcgggtagacttgtctttaaaattccccaaaaggcccttgtgactgttcaagttttaatctctctctttcatttccacaaaacaagtacatttcctccttccactgtgaaattgtcttgtcacttgtgacattaatgtagaggagaaatcctttaaaggcagcctttgcttctcttgatcttgcagcatgcctcagccaaggcatcctcaagtgcatacacagctagaggggagagtatgggctttgctttctgcatttcaaggagagtgggaggagaaagtggggaagaccgctggccaagatccctatatcttttcatttcatactactttctctgacctagaccaaagattattaaggttgaaagggacattggggaatcatctaatctacctcccacccccaatccttttacagatgaagaaatcgagtagtaaggtgatttgcctaggacttcagttagatattaacagagagtgtctccaagtccctctcctgtgccttgctattcattcatcgaaaagtttgcttcaggtgggctgggctatgatgaactccatgtggttttagtgaatgattcctaaacctgagtgatcatcagacttagctgtaaatattttaaatactttaaaaacctacaggctgccagatcccattccacacggtgtgatatctaaatctgtgctagtgtttttgtctcagaatctgtaattgagcagagaagagttaacataacaagtctgatctttagaaggatcttcttctatgctggttctttgctggtatcttagtacttagatgctataaagttctctaagtgataagaatatatgcctgcttggggcattgatcacctgatattcttctgggagtctggagttttgatatttattactgatcattgtgtctatgtaacccatccccaataaaaatcctggactctgagtttcaagtaaacttcctggggcataagaagtacatgcgggttactgcatttcaggactggagggagggtgtgctctgtgtagcccctttggagagagactagaaagggtgctggtggatttggaaactagaaactgcttgatgtgtatttttgccttgtggatctggctatatcttcttactgtgtcactgcaataaatcatagtcatgaataaaattatatgctgagtcccttgggtcctcctagggaagcactgaacttatgggtggtcactgggccgctgaaacaaattacgtcagataccgtggcacaaacagtgacaacagtgttgacgcagaaaaatacaaatatcttctgatatgtcttatgagcagccagttttggaaacctctggacaaaaccgtgttacataaaaatatgtaataatgggactgttgtattctgaggaatcaaggaaatgttctttatttatatctgatagacttcttaatagtttcaaaagcaaaattttgatatttcatcccaagtcatctcgctgatatcctttctctttcagtaaatggcaatttctgtttcctattcttaattttctcaggccaaaaacattaaagtcactcttgctaggtacaatggcgtgggcctatagtctcagctactcaggaggctgaggccagacggtcccaggagtttgaggccagccttggttacatagcgagatcctgtctctaaaaaaacaaaaacaaaaacaaagaggcaaacaaaaaaatcactcctaattctccccttcttttcatatcatatgtaaatcatgattattgtagagactcaattctgataacttcataataactccacctttacaactccggattaaattgtcgtctctcacctggaatgttgcactagtgcccactcatctcctgccacttacctcgtggtcagactgcttgcctcatgctagcccaataagccataggtcaccttatgtcacatctatcctcaaaagatgccaatggcttccatctctgtcaaagtaaagtctaaaatccttatcatggcctacaggcttctttatagtttagtcccaaggactgctgtgtctaatctcttccctctccatcacaggccttcgcctccagctacactgtcctccttgcggttcttaagctgaccaaacatgctcttgccccagtttctttgtaattgttgttccctcgacccacacttttctcccaaatgtcagcctggcccgtgtcctcactctcctcggatctcagctttaatgtcaccctatcaaggaaagctttcctcagaagcctaagtaaaacccttctttacctccccttatctgttttctgaccttacttcatttttcttcaaggcattctggaagccctgaaatagttatgtgtgtttgtccatttgagtattgacgtctttctcttggaatttgttgtaagctccatgagccgacacttggttctgttccctgacttatccagtgtctaggacagtaactgactctgggaggtaagaaatatgctgaatgaatagataaagcagtgattgtgcaggatgaataggaatttaggaaaagggggtagtgaagggagagcatgctgagatggacttcagtgagaagtatgacgaagagaagatgtgaggttggttacttcagagacacggaccgtgcaggtgaggcactgacacattctgcagtggctgcagagaagtctgaccctctttggtccttcttttgctttcactttgacattcgttgcagtcagaatgatttcctgagttctccatgtcaagactgtgcatggacacagtggattgacacaaatgatatgaaaacagttctttccagcctgttttgcttgaggcccttggtaagcttgagaagccctccctgccagggctgcttctatcgatggagctagatcacggggctgctcctctggggccctgcagggctgcattaattaataggaggaacggcctttgacctgccagagcaaaacatgccaagaaagtgtatgcctctttctttctttcttttttctttttttaatttgatttttaaaagaagactatgaatttcaaataagccaagactacagaggaatttgcgagggattaaaaaaaatctccagcccaggacccaaaaactcttcagagtttgaacatttgtttggaggggggtaaaagtgctatgcattttaaaagcagaattacaataaatagagactctctttctcctttctctctcacatacactctctccgtccctccctccccagatgctttagggaataataggacaagtaacgtttctattactgataaaaatatatgttttatgcatactctggagaaatttgccagctggtctattatggctagaagggagctgccatggaaaatgatattccactcaggttatttggatatttgcatgttttgcaagaaagacagatgcataattatggaaaggggatttggagctaaagtagtaggagcaggtataaaagtagatgcatttgagatcactttttctttcactgtagatacgacagactttaaactgggttagacatttattcagatacagttatgctccagaaatctgaagtgagaatagctttcctccatggcgtcttgccagccaacactatgaccaacaacaaaactcaattactgagtaactattgcgcgtaaaagaatcatagggtcaccccagtaccaaagagcaacacagagcagtggctaaaaatgtgctctgaagtcagaccactgagatcaagcaaggctcaattctatcatcttaccagatcactatatttggacgactgagttaacctctctcttcttctcttctgtcataagttgaattattgaaattataaaattataaaacctgaaaagattatcagattttataattagacaatgaaggcccaaaaaatgaacactgtcattatttactgtctggggcactaattctataataaatcaatcacaatgccaaaaaatattattgtcgttttgaatttaaatgcattgttcagcaaatttttatcgaattctttttatcaagaatacattttagttaacccaaaatatacaaaatattacttcaaattgtattcaagttgcttttagaaaagcaacgcagcattgtgcattatttttctacaaagtctcctaaattccgtgtgtatttgacatttgcaacacatctcaattcagaagagccgcgttcagaggatttgaaggttggtggcagctgtgtgggacatatcaaattcttaaaatgtgctagacactagtctatatgatgtgaatgacaaaaaaaaatgatgcttccttcctttaaggagcaggcaacatgggtcagacattcagtgccctcctttttagctctattgaaaaatgagctagacagtcacactactgaggagtaaaacaactgaattcaacccccgccaggaactgcagctttgtacccattacaaatctctgcccctcccttctcctgctccaagtctctgataaccactattgtaacttcacattggattagttaattgtttattaattgtttattatctaattgaatgtgagtaaacttgagtttattatctaaacccaagttagacagtaagccataaatatatattactgacatcacaatcgcctccatttataatcaattactgaacaaattgtaccaaacatgtgtacttaaaatccaaaggagagagacactgatgtgatcgatggaaggactactgatgagtaaaatcccaagttagatcttataggatgaatgcatctttcctggattaaaagaaaggaaaggatattgcaaacctaggaataaactgagcaagttatggcatttggaaaggtaggcctatttaattggcagcgagtaggtcctcttggctggagcagattcatcttgtttagatcaatagaggagataataagattaaccttataggttaatggtagaatttggttgtagaaggaagtttgaggacaaagaagaattttccagtgaaggacaggtctatctaagattgcagggtcatcctcaacaccaacatcgtcacagggaagtcttgaattgcatggaccatgagtagataatgtctgacatttttctcatgtttagattctgtggcttacctctagaaggcctgccaaggggataatgggctttaatgatttcatcaccaaataaccatgagtatgttcctctctctgtttagtggtgcatatggtgagtatatcgtgtggatggacagaaaggctgctagattccccctccaatatcactttcacctgaatggctgtgaagatttaatgatttaatttctatagaagttctttgtaaattgtcacaggcagtgtcaaattgagattgaggagcatagaatacaattgacatttttgacttacaatcagttgtggcaacaaggcaatagacagagctagactttgacctccaggactcctcttttccataccagtgccatgcataacactgcctccatttttaagacaactcttcattttttctctctttagtggcaaatactgtgtaagtaactccccttctctcaacttcgctatgaagcagatattactgctaccacatttcccagatgaggaaagtgatactgagataagacaggtaaacagcccaaggtcacacatctttaatgagcaaaggcaggccttgaccctagcccacctctgcgagatgctaaaatctggctacaaagtcttgctaaaggatttctaagcctacgccacacaggctttggagttaaaggctgcctgcctgctgctccttacttgggattcagggtacccagggctccccactatggctctcttgaccccgatttatccctgtgccccctaaatgccctttgccttttcttcttagttaactgtgtgcacctttgaaaatttatataactatgtcttcttgtcactaacagaaaagctacagctataaaatggaactttctggaatgaatggttatataatgatgctctgtgaaggaaaaagatataactttcctaagggtagcttttggtttcgacccatttatgaagttccctcagacaagtatctcaaatgctttgtacctcagtttcttcatttattaaagaagaaaacattggctgccttctctgttcaggagggctgatgggaggatgaaatcagatagctcaaaatggagaaaacaactaaattataaagctccaaacaaatggaaagcattgttacttggcaggaagctttgcttgtagagagtcacgttaacaaggactgtggcaggagaatggcgtgaacccaggaggtagcgcttacagtgagccgagatagcgccactgcactctggcctgggcaaaagagagagactccgtctcaaaaaaacaaaacaaaacaaaacaacaacaacaacaacaaaaaacaaggactgaacccatattgtagtgatgacactgactgctggagtaagcttgtgcatgtcccttaaagtctctgagcttcagttttctaatctgaaaaacagagaaacagagtttctcgcaggatttctgtgaagattaattagggtttttcttagaacttaattgtttacaaatcattctaatatttaccacaattgattattgattggaaataacacattagaacatctgtaaaatgcaaataaatatacaaaaaggttagagatcagtatggtttgctgaaacaacttcaggtaactgggggcttttgtaggctgccaagcaagcctgtatagatcatggcataatcagcctaaacggtcgtgctccacagtctgagtcagaacaagtctgaagtctaagacacagacttttcttccagttgtggggggcgttaaaaagacttggtgcatagaaggacggttactcttaataataatgtcttcatcagagcatgtgctaggcaagtccctgctgtccctactgtccagaggagggagggagaagtggggagctaccttcgtccactcagcccttccatccttgggagagcgcgtgcagcagtgtcttgctgtgcaggctaagctgggcagcccaagcacttggaatgaggtcaagaacttttctgactccttaggtacctgcttccgtaatttttgtctgcacttgagacttactcagtggctgtggcctggaaactttctggctagcaaagagatgggcttgtccctgaaatccaggtcccagaaataattctggtgagagctatctttttcaaagcaaaaagcagcataaaaaaggtaaacaggttatccttgggcttaatatgggcctcggaatcaagtatacaaaacccagctttactattcagtgtctttatatttctaggcacatgacatggtcttcttcaatcttggtttcatcatctctttaaaggggataataatcccagcctttctagttcatggtaattaaatattattaaaagagataatatataatgaggtgagcattgtaatgaacacatactaaatgttcaaatatgaaagctattactttaatgttttttcatcttttaggaatatagacaaaaacataacatatgtattatgcctttgcctactgtgtcaaagcgaaggcctttatttaatgctgaacttaggcaaggcagtttgctgaagctctggtgaatacaaataaatttacttagtaacccttgtctttaaatagcttccaaaccggtaaaatacagcaggaaaaaaatgagtcgcaaaaggcagtataggggccaaatgaacagtcaagatgaaaagtgctacaggaactgagatgagagagagaaatgatatgggaaaacatttaacagagaatcttttcttgttttatttagtccatccatctgccagtcagcctgtcaattattaatattagtgaacgccaatattgttccaaaagccatactaaaggtaatgtttgagttgggccttaaaaggtaaataggaagggtatggagagggtagagaaagtgggattaatttccctatgtatttaattgggtgtcaatgtaaatttaaaaaatcatattcaatttttccttagctgtagatgtaactacttgctgataattcccatatgtttgtcctcatcccgaactcctctctctgactctgggaaagtagttctctccagatatgctaataatatctcaaatttaacacattcttacatatattgtgagcattgtcttttcataaaaaaatgagcactatgttagctcctgtctcaactaaggtcattactatctattaggagaagatttctgccctggtcctgagtgtctttgctgggtatgcaagagtacccaaaggcctaactgttctttaaaccagagtcatttctactgctagtcatatagatgtttaagcaggccaagatgactgcaacatgatgcagtatgaccacctactccccaaagactggggactgtcctatttagtgcttgctataaaatatactgggcccttagccctgggttcttcagctgcaatgcaacccaccgagtgtgtagctgcaatctggacccatcacatcactctgtgggccttggggccaagggaattggtactactatgccaagactcctattcattgctgctgtgcaatgattaatatcctgtcttgtattgatccactgagtctcattgtctgcttctgctctgtattattactccttgctctatgaaattgttttttttttctgataccatccaaccaatattccaatttctgcacctcaaaaattacctctctctggaccttgcaaccgtgctgtcataagatcagaaaatcaaaaccccgccactccaaagatacattctctagcttttttctccacagatttcctaaatttattccttttatctgaggacttattcatctcagacaggtcatcttataatttagtgattgcctgtttagggttgaagtaagagagcctggatttgaatctaagcagcactacctgaaatcgttatgatttgaatggcttcttaatatcttagtgacttgttctcctctgatataaaagtaggctagtagtagtaactaacttatggggttgcatgagtattatgtgagttaaaatgtgtaaagcacctgtgacagtgctcagaaaatcgtaggggccccgtaaatgttaaccgtcatcattattattttcatcataaactttagccttatggcattttaaacaccaaggcgtagtcttcagagccatatctctcaaatgcttgaaggtctttctactggtttaacaacaggcacaaaggcaaattctcaatctttggcttttaaagatctgaagtcattctactttccctttgataatctctatctaatgcaacataaattatgttgaacatgcctttcttcttcaaaaacaacacatccttttatttccttttcattgaacttcttcctagttttctcaggttttttttttcttccttcatttttctgtatttatatttcttattgtccttaaatgactatgcctattctatgtctgagcacagtgaataaaacattaaatttaattaaaaatttaagaaagagaaggaatgagaaagaaagcactagaaataccagtttcaaaattttgtgcattgagaaatcattatttccaaaagattttctaagggccactgtccttatgacaattcagtgttctatatatgttcacaggttatttttttatcttaggagaaataaaaatccttactggataatccttatttatgcgtgtttttaaacatactcatacttccctctattgtttgtttcatagagagcacaaatcagatttggatatcttatctgggatttaaacaaatacgtttatacatgagtctatcaaaatccttatttacatataagaaaaaatatatgctcagctttgcccaagaaagtcccagttgatgcctataattctggtttaattattaatagctctcatttcagtctcaaaagtatctccgttttgatggtgaatcatattggcatcctagttataagaaagttttatgactgaggttgtacaagaaatcaaaaagttgcaatcaactattatttacatggtataagatatgcagatgatccaccaaaagcatttattgagtgtcctctgtgtgctcagcttagtattacatattcctttgaatgacgacctgacagggagataccctgacctgtggactttctctttctgttttcaccttcatctggggccattttacccaacctggagatgtaggatcatagaatctcaggttaaagagttcaaaacaattcttgtggttctgattctcagatacctaacttggacttttttttttttttttttgagatggagtctcgttctgtcacccagactggagtgcagtggcgtgatttcggctcactgcaagctctgcctccagggttcaccccattctcctgcctgagtagctgggactacaagtgcccaccaccatgcccagttaaattttttttgtatttttagtagagatgggatttcaccatgttagccaggatggtcttgatctcctgacctcgtgatctgcctgcctcggcctcccaaagtgctgggattacaggtgtgagctaccacacccagcctaacttggactttcttaaaggaaaaaggaaaagctcaatgctgcctcatttcaggaatagttggatttgtgtgttcaaaaaatgtcatcaggagctatctctacctctcagttttgctttcagctatgttggtttcattctcaaaatggctttctccttacagagaccctgtaagatccaggctgacactcttgtagctacacatcctttagtgagactactttggttgacaccagcaaccctcaaaattcattttgacgagatggtttttgggttatgaatctgcatgtaagtaggaggcttggagattgaataggtggatcatctaggcctgagtcatatatagactatatatagatacagaagaagctggaatgaaccaacccaaaccacatgaactgatattgggaattgttttctaggaatagagaggagcttttaccagaaaacacctacagaatggcaaaactggaaatcacagtccactcaggttcaccatggtcaaccaactgcagattaattgctcatcatttattttcttcataaaataaatgtttatttttaatctacaggctaagatgggtttattttttggttcttgtaattgaacatgtgtctgtgcatgtgcctgtgcacatcctttctttttttttaattttttgtgcatgactcctctttaaagaataactaagggtaccaggcttcctcttcctctatcttaagactcttcatctcaaagctttctccaaccaaccatggacaggggaaaactatgaagaattcgaatatgcatgagtgagtgttatgggacgggcccggatgcgcatatatgacttccacctacatttcattagtcagaacacagggccatagttgaacacaactgcaaagggaactaagaaatgtaatttatctctgagcatagaggagcttaaacctaattccctgaatctaataagtggttccattttgtttcctggggtaagggaaaaaaagtctatgtccgcatgcaagaaaatgagcttcttgccttgttctctgtgcctgaatcccagcttttatagggttccagtattttgagacataacattctgatacctttagaaagatcccttagccactacttatccagggatcagctcttagatctctggtttgcaaactcccagccaatccttgtcctgtcctggaggacattctccaggccagtaagactctattatgacatccctaaccttatcacaactccatccccaaactgaccacagtaactcttattgtgttgattgctctttaccaacttgtttttactgcaggagccattagcatttactttcccatgttcagcaatttttatggcattatttccagccgtgctttaggtaacagtctgtcaaccccttgataacaatcccaatttatcgctaagttgtaaacattgtctccaagcaaagattggcctatagggtctaagccctgaagcaattttatttttacaaattctaaataaaacttatgttactcagaaggtaattctgggtgggtcatgagaagaagaaaaggattaaaacgtggaggagaagaggggagggaaaggggagagagagaggaagagggagagacagagagagaaagtgaaaggaaaaactatctgcaaagctttggagttctttcaaagaagaaataagagaaaaaatatgtcaccacctgtcagaggataaaagaaagtaaaagaataaaacaggtaaaacaataagatagagagccaagaaagcacaaacaaggggcaggttataactgaaaaagtgtgtagagaaaatattatggaaaggcataggagagaggccagataaggggcctgtttgaaaatatgtctctgtttccctgctttaaactcctaaccagccatcatagaattcatcagcaagcactgaatgatcatgtacaatttgctgggcacatgtgttatgtgtgttcccacagatgcatgttttaaggtgtgtatcccatttgagcaatggtggataagaggcagaagtggaacagattctcagaggtacaggctttcagaagagggaaagatctatgtcagctggagaactcagaaaaggattattaaggggaatgagggttcagctgatcttagaagtttgagcatgaccaaaacatagagataaaggctgagatcactcttagtaggaagagaagaagaaggacatgtaaaggctggacttaatcaggaaatctgtagtacgggaactgcagttgatggaaggatttgatggagggagagaaagagagaaaacagaatcagattagagaaagtaaaggaaaaagaggaaagaataagaaaataaaatagagagaatgggggcgggtggagaatttaaaaaaagacaaactttcagagacttacagattttctgggtgtagaatgatgttgttggcctcacagggcactgctaagaagagctggccctgctctgaggctaagcttctgtaactgtccacttggagagttgtaagctgagaaagcacaggctgacccttggtcagatgtcctgaattgcagtcaggttggcagtgaagccatgtgataaccctgaacatcaccagctgaaatgccagtgttaaaagagagacacaagccattatcagtctaattccaacatccttaccatgtctgtttcagatacattctgtctattcaaattctgtgttttttttttgttgtcgttgttgttgtttttgccttttagtatgcttttgtattctgttttttcttaataggccatgatataccatgtcaaagggactgctccaaatagtcctttagtaatgtggcaataagttgtggatgtgggaagtattctacagcaggtcctgaaataacatcatttccttcgacatcattttgttataaaacctatgagaaaaaaaattaattcccagctggggtcactgtctatgtggagttggcacgttctccctatgtctgcaggttttttcgcaggtattttgcagtttccttccacatcccacagctgtgcccctgagatgaactggcatgtctaaacagtcccagtcttaatgagtgtgtggtgtgtgtgtgtgtgtgtgtgtgtggatatgtgtatgagtgtgtcctggtatgggatggcatcctgtccagccacctgagattctgaattagaataaaggagtaaataattatcttgtttttattaatctttgggaaatgtacgtatagctcatatttattttactgtttaatattagaagtgttttgggttttatttagaagtttgaggatgttgttatgaccagaaatatgccataggaacttaactcttgtttatgtcaattagcctgaaataaaattggtgtctttatagtctgttcacttaaagtcacaattttcaagaacctatctgtgactttgatgacatactgtatagttctctgattaggttagtcttttggtaagcatatgtatgcctccggactgagattttacgtgtatttctcattgtttttctctccccctaggtggagcagagtggctggagtgggcttgatttgtgtgtttcccttctcattggaaggctagacctgactggagttgagtatttctcttcccccaggtcagttaggctgtgataataccccagcagcttaggttctggttaactagtttcccttgagtgcagtcctctttaagaagaacagagtgttctgctgtatttcaaaatggttccttttcccctccctctgctggaaacccaaggggatttttctctgatatttactgtaagaactgggttgagtgcctggagggaaaactcacaaaagtggagggtgggcagtgtgattggtctctctggagtttttaactctcatgcttgtttgcactgagcctccagcaattcagcaatttgtcaattactgttcagatgctcctaccccagccctggttctcttggcagtttccaccgtgcatttctgctccagtaagccttcattccctgtagttgcctgtctgtctctccaatcctggggacaacagcggtttgccctgtgttctaccctttcttcctgatccagcaagagtttgtttttccatccatttagctttttacttgttagaataaattgatgacttctaagctctgtaggtgtggaaccagaaacaataaatgcaaccgaagactttaaaattgaattttaccaatgtatacccataccagcagtgagtgttccagataccttcctccttatcactacttaatattgtctgtctctatcattttagtgattttggtgggtatgtgtagaataatttcacagtgcttttaatttacacatcacagataacttagaaatgaccatattttttatgtgatgcttgtcatatcttctgtgaagtggtggttcaattattttatcaattttctattgggttttagcctttcaatcattaatttgaagttattgtcatatgattgttatttgattggtatatgttcgtaattgaatatatgtattgcaaacattttctccttgtctgtggtatccttgttcattctcttaatagtgttgcttaatgaataaaagttcttaattttaatgaaatgtatgattaatgttttattttgtggttagtactctttgatatatatattcaggtaatctttgtcttccccaacataatattcctcaattttctaaagaagatatacttttaaaatatttaatttatgatcattttcaaattgattttttaatgtgtggtgaaaggagggatcaaggttatatcgatagataggtgtatatataatacatatagatacagaaaatgacctagtaacagtattaaaaggctttcctttactctcggaatgtctctgttaatttacaaaattattaattttaatatagtcccgtttatcaatattttctttgtttaaaactttgtggaaaaaaatgccaacctctgtgtcacaaatatatacccctatgcatttttaaagaaaatttaatatttttcatttataatttacatttgcaacctaactggaagtgagtttttattttctggtagaaagaagtatatatgtctgtatatgtgtacgtgtgtgtatgtttgtcccaacatggatatcccactgatcagcatcctgtattgatatattcatcccttcccttttatactatagaattctcttttgcactatagggagaccatatacatgtgggtcattgctgacttttctactgtgtttgaatgttctatttgtcaatctttgtgccagtaccacactgttgctattatactagcttatatttaaaagtttttttcccgtagtgtaagttctccaggtttggtcttcctgaagattgtcttggctattttttcccactatgaaatgccatgtgtattttagaataaactcatcactttcataacaccatgatatctataatgtgattgtattgatattataaaaatttgagagaagttgaaatattttcacaatagtgatttttccaatccatgtaaaagataaatgcccacattaacataactttaaatattttaaagcaatcacatgtgattttttgcatactgttggatactttaacgaagatttattcccaaatatttgatgacttttatgccatttgaaatagtattgatttttaaagtttctggttatatttctttgttgctgatatataaactgacttttatatataaaccttgctgccttgctaaattcatttattaatttaatatttttatgtaggtttcttttagatattttaaggacatatgcatcatttgaaaaaattgagatatttgttttttcaaatttttgtaaattcatgccttttatttattttttcttatcttattgaaatggttaaaacctccagtaggttaaaccaaggtgattatagagggcatacatttctttgtccataactcagcaggaaatcatttaatatttcaccactcttaatgatggctgatcatattaagtactcattatatttaatatcaatataaatctgaaattatctttcattacttaatctatattttttgttgataagtcttgatggggagtataattttattattgttatcaaagaaacaacttattttctctatttatttcaccaagcaaatgttaaattttagtatcatgatagcttcataaatttcttattttttgtgtgattttgtttgtttgtttgttttaattctagcttcttacaatgaatgctttacacaaatccatggccccataacatatttctaccataccaaatggctgagtgccttcatttcagagttgtcccagtcctaaatgtctgctgctagaattttctaagtagatgtcttgcctgcaccatggccttctatgctatcctttctagaccttaaaactgaactttcaaccccttcgtctgggtgtgtactcaggaccaaaatgtggttgtaggttcagaacatcctagaccattctgctgaaatcttaagttctacccatgccctctgcacaaatttattgcaattatcatattaggaaggcagattgttagctctactctctgttaaacataatacccatttagctctgcagacaatgaacttctctatgagtctgcatgcacgcgcgtgcacacacacacacacatacacacacagctaactgagcagactgctgattcctcaggatacacaatgaataagttaatgtctggctcagaggaggtactccaaaatacgacgaagaaagagtgaatgaatgaatttgaaagtacctgtttacatcatgacttattgatttattcatcaaatacatagtgaatgagtaataatagttttgcagcttcagacatgaaagtagtggaaaaaggtaaagcatgtataaataggcacaagatacaggttttcttcaattgatttactattcaaggaaaagaaaatgaaaaaatacatggcaacatgaaaacactgtcatataagtgttgtaaaatatggagtatggcaataagttaattcacttaatgtataaaatattgcatttaatcaatttgtgttaaattcccaatctactccaaaaattgtgccagttgctgttagagaaaagatgcaaagtacagagatatcagtgacacaatccttggtccccaatggcttagaatcaaataaggaagaaaatgcatttaatatataaacactaaggtatttgtaaaaatgtggtttatgtatgtcttatgcattacatgctagaatatatccattgcttcattaatgcagtcagcatccgttaaggcccaccatacattgggtatgtgtggttgtactaagatgtgctagacttcgaaggcaatcaagcaatatttctaggaggcaacatttaataaggtaggatcgaaataagcagaatggtcaaggcatttgaagtagaataaatggcataagtaaaatttcaaggacaggaacaaaaaatacctgggcacacatattgtttaatttggatgagaaagaattataaagtagacagtaagaagaggagattgggggtaaggagaaagagttaaagagtttcttaaggtcccagccttttcaccattatagaaagactcactttaaggttcatctgtaggttcattcatggcatttagcattctcagatgagttcaattcaacacaacacagtgaaattcaatacaaattgattgaatgcaagattttatacattaaggaattaacttactgtcatgatgcatgttttataccactcatttagccatttagtgtttggtattcttcagaccagtcagctgatctgtaagctgggttatgactcagaatttcactcacagctacacaaagtgaaacagttactcacagaaatttgagaccacacagtctccattctgtcaaggaggttctctctgggctattagttgctcagagaatcatattccctccatgtgatcagctcttattgatggcaaaaaagacaaagcagaatactttttacgattagaacctcaaaaggagcccgtaagtgtgtgctgtgtcgggagacaggcttgagtgggataacaatgactctggataagaatgtagatgacagtccatccaagagagcacattgtctgttttctctccgatttttggcagcccgtgggtgggtacatgacctcagcagagaagcacacaaaattgatttataaattattcatatatcatgttttaattctaaaagctggatattaacttgactaattggctctcagttggaaaaaaaaagaattatgagatactagtttcatatttattagccaattgtaagcaataatttcagcaaaacctaactcagaaaaatatattaaacgttcaaaatctttattaatatgtattttattcttttaaattatttgactgcataattattatgtatactgagagaaaataaaaaactcaagcatgaagaagaaaataaaaaatattcataaatctaccatctaaaaagcgttgtaaatttttctatgtaaaactacatatttttctccaattttttttctcaaaaatgggcttataatatagtatcctggaacttttgaaagcaactaaataagataataccttaatagttttatcatattgcatcacatagatgtgtcataatttatttagccaattacttattgttgaacattaatgttgttcaaaatgttccaatactataaacaatgtagtaatgaacattcttatatttgtagctttgcacaactctccaactatatacttagaataaaatatagggtgtactcaaccaagaggtgtaacacatatattttactcaaaatttcagctaattatttccatcctttttatcatatgctaagtctgtagcttaacttatgtcatgagtttgtatacagatatataaaaacatgaagtaactaaaatttaacaaatacaaagcaaaattctacttcaattttcttatcaggttgtgaatagacttgctgaattaacttctaatattcatcttctttctttggtaagttgatgaaatgatccctattttaaatagctgctgaaataaccaatgcttgtgaaagtgtttgtatataaagagcttttgaaaaaaaacatggaaaaatttttatctatgcttagactgcataggacttgtgactcagttttaagaactgcacatgaatttgaaattgctatttgagatataaacaaaaaactcacccaggaccaatgaattcttggattcctggcagaagaaattgtaagacttctcagtagagacacacgaatgcatggatcagccataggaaaaaataactctacataagatgagatttaaaataatataaactaaaatttacaggatgtaactgatacaggagggggcagggaagtgctggtaagggaagggcgtggtccttggtttggggtccaccccggggcctgtgcccacggacctaggtgaggacaagcatttatgttttcctgccgaaatgttgcgtttcccaagaccacctggcctgccaaggtggtttaacatcttccaataatttgacttcagtattccctgctggttccttctcacatacacactgaagaatgctttctcagcctgatttccatgtctgagtcacgtgcagtccattttaatgtcaaccccatttgtgtccccagcatcagctcctgagctactgcacttctccagtgcttaggagtttagctcattaggtgctaaattactagcaccagaaagtgacaagtttcactttgcaaacttttaccaccataaactcactcaataaaaacaaaagaagccatagagaagcagggtttgggggatcataaaaaaaatatatgtttcaggcagtttgtatttatccaagtggcagcattgagttaatgctaaggaagtagacagcttcagttaatgagatgtattatttagggaaaatagagctgtcactatttcttgccatgtaaagcagtggatttgttacttttgaatgctggctgcattaaccaaaacatcatttattcctattgagatgttcccccagagctgcactttggttaataaagataaaccttcatgttggttgtcaaacgatatcttcccatcctaggaacccttccaacagcaacctgggcacttattccctgaaaagatttgcttagtgtaagatcttcatgtgtatttcagagcttcggtggattcccttaactgacctctggagcactttctgtgacaatgtgagatctatacctgtgtggtttgctgaagcatgaaatctaaagaaaaccacaaacgaacaaaaaatttaagaatttcagccccataacaaacttgcatgttttcattggacaattatccagcttccagtctccctctctcctcttcctagccaaacttccccagatgtctcttccccttcctcacctctctcttgctcccaaaccactctattttagctacagcaccatcactccaccccaagaagttttactatagtcaagaatgggctccacgtaactaaaccaatgagtagtttcagctgtcttcatttttcacctattataagtattggacactattgatacatcctgcttctttaaaagctatatccagttagtttccatgattctatactattctagtttccttcttatctctatcgccaagtttattcctcttcacccacagtcattaaatgctgctgtccctcaaggctcagtataagctttgatccttcctctttctatcatctctctctagaagacctcacctacagctacagccttgaatgccctctttttgcaggcatctcacaaactggcccgcgactctaactcagacatctcccccaaactctggactcacttaaccagctaaacctttgacatctcccaaaagatgtctcataatcttcatcagttcccaaaatgtctagtctaaatggctgagtttctttcccaagcatgaacctcctccaaaatcactatgtattcttctccctcaaaccagaaacttacgtgatatcccgaaaatagccccccttacgtttcatatcaaatttatcatacatattatctatttttccccttaaatattgttcatatctatccaccttttttttcattttcatcccttaatttagggcccaccatataacaggaactcaatatttaaattttgaattaaagaatcactaacgtcaacactctagtaaaagcctagcctgctgcaagagcttctgaattgatctcttcagtccagatttaccccaatacaacaattctccactttcccaattagctggaagctttatgcacacaacaaaaaatagggttgtcattcactttttcccactgtaaatgaaatgttaatcttcaagaaccacatcaattatctgagctctctctttataggcccatcacatcccatgctctgtcatttccctcattgcaacaaccaccaggctgctttaggccctttccactcaacatactctctacagacatggtgtcctctctctggtccagtcctctactccaccccaatcacctcctaattgatgcttactcatcctttatatccaagctcatttcagcccatttcttcagaaaaattcgtaacaacctccctgacaggatcaatcatttctatgatgtgctataaaagcacaaaaattaaatgctaacttgttagaatttttctttatttgtaactacatttaaaatatatttctgagagcacaagttcattaggacaaggatgtcttcttatattcaccattgtttccccagaaacaaatagctcaatatgtttaattttacatgtatatgtattttatatgaatatgatttggcttatgtaatatatgtgtgtgaataaatatttgtatatattctttttaatgtatattttatatatatatgtctatctatattgtggttttagacaattttatgtctctggggctcaattttctcatttatttaatggggccaaaataataatatctaaaatcttgcctgtgtagatgtaacagaataaaatattaacaattttgacaaaactgatattaaaataataattacatggcaaaaaataactgtatactcaaactcaaagcacagcagaaaaactgtgagataatatttgcaatatatatcacagataaaaattcatgtccttaaatataaaaaactttttgaatgagtgaaatattatcaaaaatataatagcaaatgggcaaaagatataaatggatggttcacaagaagaatgtaaatacaaaaaagacatttaacctccctcataatgagaaaaacgaaaataaaactgtactgacttaccctttctcaagtatcagataggcaaaaatgaaaaaaatcatatgacaacatactcagtgaagatgtagataatagtcactctcatacaattcagtatgaaaaaacattagtaagcaccttatgaaaatgaactagaacttgtcaataacctataaaactacatgtatgttcacatttcagaccagaaatcaatttctaaaaattactcctgtagatacatctccaaatataaaaaaatacatatgtgtgaggttattaattacagcattgattataaataaaaaatactggaaacaaactgggtgctcatacataggagggagattcagtaaactaaggtatatccacagaatggactcaatatatccagaatagaatgatgaggaagagaaagatttctatgacatggagtgattttcaagaaatacagttaagtgaaaaagccaaaatagaaagattagaaaaagcatactgttcttagccaagggaatcctaaaccaaaagagcaaatctagaggcatcacattacccaaattcaaattacactaaaaggctatagtaaccaaaacagcatgggattggtgtaaaggtagatccacagaccaatggaataaaatagagaacccagaaataaagccaaatacttacagccaactgatttttgacaaagcacacaaaaacataaacttgggaaaagacatcttatacaataaatggttctaggaaaattggatagccacatgtagaagaattaaactgaatccatatctctcatcatatacaattcaagatggattaaatacataaatctaagaccaaaaaaaccataaaaattctagaggaaaacctagaaaaaattcttctggacattaacctaggcaaagaaattataactaacaacctgaaaacaaatgcaacaaaagcaaaaatacataaatgggacttaaattaaaatgcttccacaaggcaaaagaaaataaccaacagagtaaacatgcaacctacagaattggagaaaatattttctatgcatccaacaaacaattagtccccagaatctacaaagaagaacttaaacaaatcagcaagaaaaatacaaataatcctattaaaagggggcaaaatacataagtagacatatctcaaaagaagatatgcaaatagccagcaaacgtatttaaaaaatgttcaacatcactaatcatcagagaattgcaaattaaaaccacagtgagataccacattaccccagacagaatggccattattaaaaagtcacaaaacaatagatagtggtgcaaaagtggtgaaaagggaacacttatacactgctggtgggaatgtaagttagtgcaacttctatggaaaacagtatggagatttcaatttctcagtgaacaaaatgtagatctaccattcaatccagcaatcccactgctgggtagctacccaaaggacaagaagttgttatatcaaaaaagatacttgtacttgtatgtttattgcaggacaatttacaattgcaaagacaaggaatcaacctaaatgcctatcaactgaagagtggataaaaaaaatgtggtgtatatatataccatggaatactactcagccattaaaaaaagaatgaaataatgtcttttgcagcaacttgcatggaactgtaggctattattccaagtgaagtaactcaggaatggaaaatcaaatatcacatgttctcacttataagtgggagctgaggaatgggtacaaaggcatacagagtggcataatggactttggaaactcagaagtggagagtggggaaggggatgaaggaaaaaaaactatctaaagggtacattgtacattactcaggtgatggtacactgaaatcctagacttcatcactatacggtttatccacataaccaaaaatcacttgtagctctaaagctaatgaaatagaaaagttaaaataaaaaaaacacagaaaaaatactaacaatcatgcagtttaaaaagaaggaaaagtactgaaattccttgattaatatctatcttttctgctagcccataaattctgtgagaatggagattttctctgatttgttcaccacttatgtacagtacctgaagtatcataagtgctctataagtgctaaaataaattgaaaaaaatgcagatatgtgtttcaacacattcaaatacaataaaaacttctatatatataaaacatatgctattttttgtgtaagaaagatgggggagtgagaaaatatggatgtatctttttattgtacatataggaaagattctttagagattaatgaaattggttagttacattgcttgggtgagaacaatggaaagaatggaaggaatggggatagggtggagaatgaagcttctccaagcataccatgttgaaccatctgacttttagacccctgctaatgtttcaaataattaaatgaagggaaataaataataaataaaacaatatgtggggaagtctaaaacaaaatacaaacagaaatgcattttttaaaccatatttggagaagtcatgtaaccacactggaggaagagaaaaaaaagaacaaaatcaggtaattttcaacagcatttagattacacacttcaggccaaagacaaaattaactttggaaatatgttggactctggttagtaggtttctttttcacagatagatgggttaacagttctaaaactactttctgtgtattctagatctaagcaaataagtaaatatattgtagatactagaagccagatttctcattgtcagagaaggaagctttaaatatggaaatgcggaaggatagtatgaatgctctagtatttggaagaatgagtgtgaactggattttaatacacataaataaagaagtagttaagaatgctttaggctgcatgtatattcatacatatgtgtatgtttgtgtaggattttgtgtatatatatacatatatatctttaaatgtaaatctgttaagaaatacatatagatataaacctatgagtgtatatgtatccttgtatatatatttgtatatctatatggcttctaactctatccactgagagagcctagaagcgataataccctagtagcaatgagcatacctagtagccacatcttgatttctaatcacattttccacttaaaaagtccagacattttggataaacggctgatttcagggatagagtggaacaataaaagatgtacctgaaatattattttgtgtcataacgtgatgaagtgctcaatgaatgccagttctgtggggcaacacttgctaaatctgggatcatttgagtatatttaaacccatgatagtaaaaattttaatccatacaataaattaataactcatgagtccatgtgcataacaataaataaataaataaataaataaataaagctcttctttacagcagacattaaagtaataaatgtaggactgatggaattagaaaatcgagtggcagtcattattgtaatccttgtctgaggcaagactcctcaagaggtaatgaaactgttaagtaaaatattgacaagtaactatttgaaaggaaactacatagtttcaaaatatatctttacaagttattaattaaaaaggggaagcataagaacctgtaccttggagaaaccaagtgatcatagtgaatatcaccagaaaggtggtaagcccacaccacgttcctccgaacgtgattcaccgagaaggacagaaaaatcccttagtagaattccaggcaataatgatctgaacctaatcatttagaagtatcaagcagggagttgtggctcgtgcctgtaatcccagcactttgggaggctgaggcgggcggatcatttgaggtcagcagttcaaaaccaacctggccaacatggtgaaaccctgtctctactaaaaatacaaaattagccaggcatggtggtgagtgcctgtaatcccagctactcaggaggctgaggcaggagagttgcttgagcctgggaggaggaggttgcagttagcagagatcgcgccattgcactacagcctgtgtgacagagcaagactctgtctcagaaaaaagaaaagaaaagaaaagaaaagaaaagaaatatcagacaggcccaatttacgtatattctacaaaatacctgcattttatttttttttaatgttagtatcatgcagtacaaatttaagaaggcttctggattaaagaaaattagggaaacatgataactttttgcaacaaataatctgattttcctctggaaatcattggaacaatggtgaaactaaagaatgttgctttaatattaattttctgattttgataactgtactgtggttatataagagaatagtcttacttctaggaaatatactgtaaaggaacaaaggggcatcacatctgtaatttattcttaaatgtttcaaaaagtatgtacacgtgtgtctgtgtgtgtgtgtgtgtgtagatatcgatcgaggcatagatagacacatggaaaagagagaggaagaaaacagaagggcctgtagagagaggaagtgagaatgagagaacgttttcatgtgagtacacacaggaaacaaaaagcacaagaggaaatgttaacatttggggaatctgggtgaagagtatgtgaagatgtcttgttcaattcctacaacttttcataagtctgaaatcatgtccaaataaagtttaaaagaaaataaaacttataattctatgcattagtaaataatcttctggtcctggtcaaagcccaaatggtaacatgatatgactaagataagacaatttgtcagaagcagagctacgtgtagaacaaagtctcaggtattctttttactaaacaacaatcaacaagtcatcagttttccaagtcctgtcttcttatgcccaaagcagatattgataatcagttaatagagccatggcgcggtctcagtatcctcctcaattcattgcttcaggcaacctttaagattgaaacctatttcccattctaaatatcacacctcgctccctcgaattcatactgcagtggaactatctcacaccagaatctttacagaaggttgctttttaggtggtaacagaaatgaagtacaaaataaaattttctactttgaaagcaagctatgtgctataattaaataaattttaataacttaggactaatctcttccttgaaacagagttcttttggtctgaatgcatgtagacaaccccttgttccttttgccgcagccgggcgaacagggccctcactttccccactaatgaagcagaaagaggagtctgttaaaacatcctttcaggtttggcttaaagttctaagacattagccattggtcattgatcgttgcaccttcctccaccataaactccactttgagcctagaatgctgcttcagaatctcagtgtaatgacccagatcatcatttcctatgtgagttgacactgtgataaaactcacatgcttttacagggattccaccttcctaatttaaagtcactataaagagtaaatgacttctaccagattctttcatgggatgtggctgggggtgaggtcaatgagaatgggagaattaaggtgggaaaataaaacacctgaaggacattgtatgattaatggaagggaaaagaaatctgagagctgagcctcaaggtttcaaagtcatcctctgctgattttctaatatatcagggtgtctgaggtagacagctgcatttgcatcttaaagtgtaggtcagattatgccatcctaaactacggtatatttttgcagcatattctagtctcaagcaatgggtagagttccattgcccaggtagccgaacattaaagggatgtttaagagtttctctctctgcctttttgagaaccatgttttggcacagctacctcaatgacacaaggctatagattgattacatgcatttaggccaaaggaatgctatttgcatggaagagactggtctttaattactgaaatttgtttaataatggcatgtctttcaggggaaccaacatgtttatgtattaatcctttaagtagtagtcttggtccctaacttggaaagtgcaaattggcaacatttaactacttcaatccaattccccaatctcatttcccaaattttctccactgagagctgccagtgcccccagggtgcatatttcacataattaagctttatagctagagcctgttctgagatggtcagctgcctgaatcccattgaaaatgcagacagaacagaaagtgcaaggctgattcacacttttggatgctcagacattgccctggttgctctccggtttgaaacaattggaagggagacttttattctgcataggaaagactcagtcacgcccctgaggaaggaagtcatcctctggctggtaccaacacaaaattgaaccaaggggcacataaattatcattatcaaagacgatcctatatttataataatttcctgtatcttattgtatttcttcatcttcaggacaaggctgcaattggtacagtctttgtggccattttttaggttaagaaaatgagaatttttctatatctcatccttttgctaagatggtttaaaattcagattttctgactctaaaaccagtgagttttcttattacacctctaacaatgttattttccctgctaattctttgatatatttacacacatgcacacacacacatatatatcctctccttatacaggggtcagactgcggtataaggctggtggtcttagagagaagggcaggtataatgtcggagacgaatgcctgatatcggaggagacatcagtagatagagtctcctgtgatcaaagattactaagttcattctgattttagggcagagatggtctacttacagctggtagggtggatctgggtccatagatttaactataactgtaacgaagacagagtttcctggaacaccaagggtccttatgttccatattccttccagtaccagcacatggcagcccaaaataaaaatggtattgaagtaattggaaatatttccaataaagcaccaaagccaagatttgctatttaaagctcagtattagctgaagccagactttccttggaaacacatacacacacgaagatctattcaatcgtatagagataaaaatgatgaattggcagatgcacgggtttaaccatttgtaagcagggtaggcaggattggggcagtacctcccttattcccaaactctctccacattctggctacctcaccatggccacacaatgccttttccagcaggtaattgcctgaatttaaggctgcacgatattttatgaggaaatgccactgtcttttagattatagcaaccaagaaaaaagtactaaaagcctgaaacaaaacagtgttgctggtggtatggccttcctagaccccagggccatccttgataatattttctgtgttctctaatttcatctctgccaaaagccattaaggtgtatcagcagccataaaaggcagactcccagggaggaaattgtaagaaacatttctggggttaaagttagcctcacaccaaatagtcctatgaggaaaaaatacagctgacagatttataggatttctcttacaaaagagaccttgctggaccacaggtagcaatataatctgctgaattctcacactgcagggccttgctttatacaagagtaataggttttataaacttaatctcattatatccattgaggtaattcactagggcaattcaatatgtgaaggaaacctgcagtgaacattctgaaaacttaaagacgtgttttgttttctttattttttagacagctttgatacacaattcacacactgtacaatttgcccttttaatataatgccatggtttttagcatatttacacaatggagcatccatcactacaatcaattttggaatattttcatcgtccctccaaaaaacactgcacttcttggccttcaaccaaatctccccatttaccccagctctcctcagtaatatatttctgagttgatagatttgtctatcctggacatttcatgctgcagcaggttagtcctgactttttatcataatggtcatgaggttccatgaaaccgagagaatagaagcatgaaaggtctcttgaggcctgggttcagaacttctaatgcattctattggccaaagtgagttaaagatcagcccagattcaaggggtggaggaatatattccaccagttgatgatgaatggagaagccataaagtcccatgtcaaagagttacggagaagtttgggattcgagccgccattaaaaaatagatctaccattgtgatagtatattttatcaaaattctgcatgtgttatcatcattcttagttaaaaacataagaagatatattactaaatagtctggcactgcatactagtctttataaaatgacaaggcaatatctgtggcatctaaaccaaacacctatatactgataaaattttctctctaccttcccagcaaagcattctctccaaaggtacctctcaatgtatcctgggtctcatggacaacaaaattaaactcattatttccttcagaaacttatctttttcctcctgtattttatatttaaatgaataatacaatcaattatccagttacctaattgtgataccaaggaagtatttaagattcctattcccggctggcttaacgcacattgttcaacaagtcctacatctctaccttcaaatggctgttaattcttgcttcatctctgcattcaaccgccactgcattattccaggatctctttattttcaacctgaattatacaacttttggacttgtttctctgttcctgttctcatctgtctttaatccaaatatccacagttgtgctggtgtaaatttactatattatggcatctctccagctaaatgtcatccaatgatcttcaactatttcccacttaaaaatccaggcttcttactacagcattcaaggtcttctctgatctgaccccttcttgcccctccattgtactttcattttcttactttgctgtgttcttgctcagctcacatcatacacatctcatcatacacttctatttgcctcaatgttcttccctctagtgtcataggggagggaggacccatggtatttaagagcaagtacattagagttagatactctgattctgactctaagaatgttgagttcccacttaatgatgctgagctacccttttcttattagtataataaaatggaaatagtaatgacatctacctcatagggttgtttagggtattaaatgtaatagtgcatgcaaataatttagcacagttacttgcacaaataagcattccataatgttaaacgtcaatattaatatttctatcacctcatttttttgcttctgaagacccttttcatgtttcaagacttaaagcttacatctttgagcacccattttggaatggaattctactatcccattctcattcttccagtgagttcccatcaaatcctaggcataacttcactacagcatttgatacataatatggatttctcctctctttttgtatgcctgtatcccctccaaaacctataagccacctaagagcagggattgtgcttcattcagctttgactgccttgtgtcagtaaatgcaagattcccttgtgaagttatggaaaatccaggcccagctttagcagaaatgagtatatgcagtcatagatggagacgtggctagggaattagaatttcttggctcagtggactttatttactcaatcaacttccaggtcatatcctgacagctgagtattgaccaacagaagagcttgtaactcaggcatccttcaggaaccttggatcaaaacaattgtgatcctgccaagccttggctcaaggcaaggacaattgcctttgattctaaaccatttagggaattccaaaactagtgttagtcaaggactcctatataggtttatttattatgaaaaatatcaagactgagaaactaacattttgggaaattactattatcaacatctgatagaaacaggatgaccacattttgttgaatgtaaatttccaagagcaaaaaacatgggaatgaggccgatttcccatcttaagcacgcaggatttcaaatcaatttcttattaacttgataacattgctttttctagaaaggtcactattttttgtgttaagaatatgctcttggccaagcatagcggctcacacctgtaatcccagcactttggggaggctgaggcaggtggatcacttgagctcaggtgtttgagaccagcctgggcaacatggcgaaatcccatctctacaaatattacaaaaactacccacctgtggtggcacatgcctatggcgccagctactcactcaggaggctgaggtgggaggactgccggagcgcggaaggtcgaggctgcagtgagccatgatcatgccactgcatctagcctggacgacagagcaagaccctgtctcaaagagaagaaatatgctctttaaccttcaggtagtatctgcaatttgtagagaagattgttttcccttatcttttatttcttattctagtctctggaacttgcttatcaatcagaaatgcatttgagggattgaatttaagcaatacatttaacatacatacctcttagcagggtttttcagtataagtctcattttcatagattcttgctcttgattccaaattatttttgtgactcttttcctgattgtctgggttatctggcaattatttgtagactcaggagcttgagagaagtctggaatttctgcctgccaatttgtagtttgactttcaaaacccagctctttgcttttgttcttatttatctttcttaaataaaaaaaataaaaaaaaagggccaacccattttttctatttgtctttattccagagaacatggtttatataaactatttaactattgcaaaaaacacttctgatcctttcgtttcctataaagggagtaatatttcaccatctccatgatatgtttgtatcctatacaggaagaacaatgagacatggagtgaaaaaatttccagtagctctactcctttatcactggacagacaaatagctcactgcatgtgggttcccatatactattttattatgaaagataaaacatttagaaagagaagacctcttataatataattccattaagctctcctcacctcatatttttatgttttatgtttatttgatatcattttatgtaattatttgctgtagtgctctgatttatacttaacaaggtaattgtattacaaaataaatgaggcttgaattgatttgcagtaaatgtatataaaagttatattcttggttgaagttcaaatactgtgggaggagtaagaatgcagaaacacatgcccatgtacaactggcctccaccacacacattatacaccaggttttccttaactgggaccatagaggactaaagccatactgacacatacattatgtctccatactgtatataaacataacatctaagtatttatgaatattctcttccctctttcaaaacaaatacaccacattaatccctctttcttgtccttgagctagaacttatatatttctcccaaattttatacaaaatatagccaaatgtgacattaagcttttctccaaagccatgtatatttttaaaaattatacgattatctgttaattatctacatttatttactctgtgtcataatgtcaggactgaattaggcaaaatatatttttcccccatccaaaggcttccttttagaatctgccaataaaaggcaggctcctgaggaagagggacaaaaagggatgtgtctccttttgtaactgttacatctgttagcgtcacccaacgaaggaatttaatgcagtagcaacacctgattcctgccttcaacttctttcagcactcttaaaaccagcttaggagcccctcagaagcactagcagtaagtaggctgagcagcatttcttggaaatccaaacccagatccacaagatccctttgaggatctcctgaatatcagcaacagacaagcaatacttactccagagaagtctcatccccagttctgcaaggtcctttctctaagttcttgaggtaccagcagtaactaggagccaacctgtcttcactgatcttagttccgcctgtacatgacccctactatgaaattcaagattttgataactctgtctttatccatttgttctcctagccttatgggtattagttatttcctgcagttactacttctatgttaccatgctgttccatttttgctctttcatcattctacatcttggttaacaatactctatgtaaaacgttcactgttgaattacagaatgtaatatctgtttttcttattagactctgatgtatactgtaccagtagtggccctagaaagcagatattcaaagtttgagattctggaattggtgtggttgtaaccttgtccttgaacacagaattggattacttacaaatgtaaaactggatataagttatttatagtacatagtttttgtttttgtttttgtttttacaattcatttaattatccacctgtgtaactcaggaattccacgtgggtttaaatattaccaaattaattgagatgcttagggatagaaagagcaccataattattattacaataaaaaaataagccagacaaattgaaattaattttatgagtttttaaaaattcatcagcaatcttgagttttcagggcaagcgcctagcccaaaattgaagaaaggtaggcatctttaggcagagatggtgtatgaatactggactacttgtgacaggcacaactggacaccaatcacagtacccagaaagggtccttggttaaattggcggaagctgatcatgtgctgttgaacatgtgaggcccctaaaactcacacaaactggagaagtctatgcccttttcaaggattcttctccatgaaccctgctgagtgctcacagacaagattggaaaaaagtaactaaatgttctttgtggtacagagctgagaggagaggggaacaggagtttatgcagagaaggatgctcctctatctctgctcaggaaaaaaagcctcaacctatgctgggaaggacagaaaacatggatgcccttagggcacaggtgaggattcattgcaactgaggaaagcaaacagatagaaaagtccctatcttggaaggtaggcaggaatgtgtgctgggttcagaactacagccagggtaagagcaggatcactgtgtaggggacaccccgaagacccaagacatggtgctggcaaagagaaggcatgaaactgagaatggatgagcattcagagaaaacaaaaacgaagccaaaagcctctgggaagcagcctcctctttaaataaaatgtacggctacagggatctgaagagtgtgatatgctggcagtaaccatcgcaatagaaatctcattggtcaaatttctaactaggttaattcaagccccagcactaaaggccaagcagaaagaaaatgtgcccaggcataaaagctgtttatctcagtctttactatcctttacaagatctctggctttcaaaaacaaaccacattaagaaatgtgaaaaagcaagaaaaggccaatactaccaagagataaaaccagtcatcaggatgagactaagatatgacaccgaatttagtattatctaatagatgatttagaataactatgtttaatatgataaagtttttaatggaaaagttgaataattacaagatcaaagtaggtagtttcaacagggagatgggaactgtaagacacaatcaaatggaaaagctagaaatgataagcacaataaaagaaattaacagtgacttcagcaggcttatcagagaaggaaagaatcaaaggaacctgaagatgtttcaatagacattttcaagcaaacaaaacagaagatagaaaaagagaacaacaacaaaaaaacattaagacatgtatagaacaatgcatgtaagggtaattagaatcatagaagaagagatataaattaggctaaagggacatttgaagaaataatacctgcgaactttccaaacctaatgacagtcatcagacaacagatctaagaatctcagagaacagaggcagaataaatcccaagaccactacatttagctatatcatgttcaaactactggaaataagagtcaaatggaaaatcttgaatgcagacagcaaaagggaaacaagatatcccatacagagtaacaagtataagaattattgaggaagtagtcagccattcttgtgtaaaaccaatcaatgtagatggaaatacaatgacatctttaaaatgataaattgaaaaacaatccagacaacaacacattcaacctagaattctatgcctagagaaaatgtgtttaagtaatggagaaacaaagactttctcatacaaacaactactgagggaattcattgtcaccccaattctacattgaatgttaaaaaggaggtttttagaaacaaggaatacgatatcaaacagaaacttacatctacaccacgaaaaggaagggcactgaaattggaacaaatgaagataactgaaaattacttttctcctttccattgctttaaaagataagtgaccgtttaaggcacaaatagttgatagcatatgcaaaactaaaatatctgacaacaatagcacaaatgatgccaagataaattagaagaaatacagttatatatctacagccataccaccctgaatgcagctgatcttgtctggtctcggaagctaagcaaggttgggcctgcttggtacttgggtgggagaaaatataatgttgtatgatccttaaacaacacatgaagtcgtatacttgaaaattgaataaattaaatatgtaagatgtattcaactctaggacaacctctaaaaacaattttttaaaaatcattatttagaaaattaccaattacaacataacagaaaatgaaagtattataatccagcaaaatatttgaaagatctggatgctgaaaaaaacaaagctttgagaaaagaaagcaagatgaccttaataaatagtgaactatataatgttctaatgacaactaaatggtcagaattcaactctttgtcattgtgggactgaggtctctgttttcttgctgtcaagccaggattttctcttaactccttacagccacctgaattcctcatcatattaccccctccatctttataaatcatggtgtcaagtcttgttcatgcttcaattctatctgattttacttctgtcacatctattctgcctccagccagagaaaattatctgcttttgtgggctggtgtgattattttaggcccgtgagggtaatccaggatattctccccatcttaaattcttaactttaattatatctgcaaaatcccttttgccatgaaatataacatttcactggttctgagaattaggatgtgaatatattggggaggggaacattattcttcttaccacaaaaggaatcaataaaaagagtgaaataatagtgttagaaatcacacacgtgcacacacttatacacacacacacactatgaatgttttcaaaggacttttcaataatatcacaacaaaaagtcaacaaatttgagaataggtaggtcaatatcaattatctaaaatgaaataaaaggggccgggcacagtggctcacacctgtaatctcagcactttgggaggccaaagcgggtggatcacctgaggtcaggatttcgagaccaacctgaccaacatggtgaaaccctgaccctactaaaaatacaaaaattagctgggtgtggtggcaggtccctgtaattccaactacttgggaagctgaggcaagagaatcgcttgaacccaggagttagaggttgcagtgagctgagatcacgccactgcactccagcctgggcaacagagtgagaccccgtttcaataaataaataaataaaaataaaatgaaataaaaggaggaaaaaatgttaagaaaatactgaacagaacatttaagaattgtgggaaaacagcttttctctaacatacatgtaattggagtcccaggtagaggagaggaagatggttgtttcagaagtgtttaatgtgataatggccaagaatttttcaaaattaatagacaagaaaccacagatccacaaagttcaaaattccaattaagaacttggaaaggcaaaaacaagaaccaaacccacgaccaaaaaaaccgaggccagactaaaccaaaccaaacacacacacatagacacacacaggcattatcatagtcaaactcctgaggcataaaaatacaagaaaaatcttgaatgtagccagggcagggggaatatataaagtacagaagaagactatgtctgggtaaccacagatctcttttcagaacatagcaacttagaaaacaatgaagtaaggaacacctctaaattttaaagtagaaagcagagaaacaccgaaagaacaaaaaattacctggtcagatttctataaccacaaaaaatatgtttcaaaaataaattaaaaaaatggttttcaaacaaacctgagagaatcaattgcttgcagaactgaacaataaatattaaagaaatgtattcaactgcataatcatttcaatacttgcacaagcacatttgaaaaattctgttacaaaaaactttcgggggaggagccaagatggccaaatagaacagctccagtatacagctcccagtatgagcgacgaagaagacggcagaagacgggtgatttctgcatttccatctgaggtaccgggttcatctcactagggagtgccagacagtgggcgcaggtcagtgggtgcgtgcaccatgcgcgagccaaagcagggcgaggcattgcctcacttgggaggtgcaaggggtcagggagttccctttccaagtcaaagaaaggggtgacggatgcacctggataatcgggtcactcccacccgaatattgcgcttttcggacaggtttaaaaaatggcgcaccacgagattatatcccgcacctggctcagagggtcctacgcccacggagtctcgctgattgctagcacagcagtctgagatcaaactgcaaggcggcagcgaggctgggggaggggcgcccgccattgcccaggtttgcttaggtaaacaaagcagcctgaagctcgaactgggtggagcccaccacagctcaaggaggcctgcctgcctctgtaggctccacctctgggggcagggcacagacaaacaaaaagacagcagtaacctctgcagacttaaatgtccctatctgacagctttgaagagagcagtggttctcccagcatgcagctggagatctgagaacgggcagactgcctccctcaagtgggtccctgacccctgacccccgagcagcctaactgggaggcaccccccagcaggggcacactgacacctcacagagatgataacaaactatctctcagaccacagtgcaatcaaactagaactcaggattaagaatctcactcaaggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggctggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaaagaatctcactcaaaaccgctcaactacatggaaactgaacaacccgctcctgaatgactactggatacataacgaaatgaaggcagaaataaagatgttctttgaaaccaacgagaacaaagacacagcataccagaatctctgggacgcattcaaagcagtgtgtagagggaaatttacagcactaaatgcccacaagagaaagcaggaaagatccaaaattgacaccctaacatcacaattaaaagaactagaaaagcaacagcaaacacattcaaaagctagcagaaggcaagaaataactaaaatcagagcagaactgaaggaaatagcgacacaaaaaacccttcaaaaaattaattaatccaggagctggttttttgaaaggatcaacaaaattgatagaccgctagcaagactaataaagaaaaaaagagagaagaatcaaatagacacaataaaaaatgataaaggggatatcaccaccaatcccacagaaatacaaactaccatcagagaatactacaaacacctctacgcaaataaactagaaaatctagaagaaatggataaattcctcgacacatacactctcccaagactaaaccaggaagaagttgaatctctgaatagaccaataacaggagctgaaattgtggcaatactcaatagtttaccaaccaaaaagagtccaggaccagatggattcacagccgaattctaccagaggtacaaggaagaactggtaccattccttctgaaactattccaatcaatagaaaaagagggaatcctccctaactcattttatgaggccagcatcattctgataccaaagccgggcagagacacaaccaaaaaagagaattttagaccaatatccttgatgaacattgatgcagaaatcctcaataaaatactggcaaaacaaatccagcagcacatcaaaaagcttatccaccatgatcaagtgggcttcatccctgggatgcaaggctggttcaatatacgcaaatcaataaatgtaatccagcatataaacagaaccaaagacaaaaaccacatgattatctcaattgatgcagaaaaggcctttgacaaaattcaacaacccttcatgctaaaaactctcaataaattaggtattgatgggacgtatttcaaaataataagagctatctatgacaaacccacagccaatatcatactgaatgggcaaaaactggaagcattccctttgaaaactgcacaagacagggatgccctctctcaccactcctattcaacatagtgttggaagttctggccagggcaattaggcaggagaaggaaatacagggtattcaattaggaaaagaggaagtcaaattgtccctgtttgcagatgacatgattgtatatctagaaaaccccattgtctcagcccaaaatctccttaagctgataagcaacttcagcaaagtctcatgatacaaaatcaatgtacaaaaatcacaagcattcctatacaccaacaacagacaaacagagagccaaatcgtgagtgaactcccattcacaattgcttcaaagagaataaaatacctaggaatccaacttacaagggatgtgaaggacctcttcaaggagaactacaaaccactgctcaaggaaataaaagaggatacaaacaaatggaagaacattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcccgcatcgccaaggcaatcctaagccaaaagaacaaatctggaggcatcacactacctgacttcaaactatactacaaggctacagtaaccaaaacagcatggtactggtaccaaaacagagatatagatcaatggaacagaacagagccctcagaaataacgccgcatatctacaactatctgatctttgacaaacctgagaaaaacaagcaatggggaaaggattccctatttaataaatggtgctgggaaaactggctggccatatgtagaaagctgaaactggatcccgtccttacactttatacaaaaatcaattcaagatggattaaagacttaaacgttagacctaaaaccataaaaaccctagaagaaaacctaggcattaccattcaggacataggcatgggcaaggacttcatgtccaaaacaccaaaagcaatggcaacaaaagccaaaattgacaaatgggatctaattaaactaaagagcttctgcacagcaaaagaaactaccatcagagtgaacaggcaacctacaaaatgggagaaaattttcgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaatacatgaaaaaatgctcatcatcactggccatcagagaaatgcaaatcaaaaccacagtgagacaccatctcacaccagttagaatggcaatcattaaaaagtcaggaaacaacaggtgctggagaggatgtggagaaataggaacacttttacactgttggtgggactgtaaactaattcaaccattgtggaagtcagcgtggcaattcctcagggatctagagctagaattaccatttgacccagccatcccattactgggtatatacccaaaggactataaatcatgctgctataaagacacatgcacatgtatgtttattgcagcattattcacaatagcaaagacttggaaccaacccaaatgtccaacaatgatagactggattaagaaaatgtggcacatatacaccatggaatactatgcagccataaaaaaatgatgagttcatgtcctttgtagggacatggatgaaattggaaatcatcattctcagtaaactatcgcaagaacaaaaaaccaaacaccgcatattttcactcataggtaggaattgaacaatgagatcacatggacacaggaaggggaatatcacactcttcagactgtggtggggtggggggaagggggagggatagcattgggagatatacctaatgctagatgacgagttagtgggtgcagcgcaccagcgtggcacatgtatacatatgtaactaacctgcacaatgtgcacatgtaccctaaaacttaaagtataataaaaaaaaaaaaaaactttcagcaatttggaagggaattttcttgatgtaatgaaggaaatatccatgataaagagcatctatgaaaaagttaagctaacatactgaatagaaaaatgttgaatgcgttctgcctaatattgagaacaaggcagaaatgctcctttttcttcttttatttgatgttacagcagaggttccagtcattgaaataaataaataaaaagaattaaaataaataaaaataaattattttcatgaagtcttacaaaacttgcagaacaactgttagaactagtaagtgcatttagcaagactacaaaatatattactaataatatctaaaaatcaatagtatattataatctatctgcaaaaaattaggcaagtgaaatataacaggtttgagtcaaaacccactcaatgtaccctttacattagtgtgtttatggtatatagatcttgcctaaaaaggagggaaaacactttacacaaatactgaagtctagttaataaatatttagaatgaaatataatgatgtatgcaatttatgtaagtatattaaaatgagatggatagagtatggactcatggacagatacatgataaaatacatatagtaaaatgttgtgggagaatataggtgggtatactaatgctcactgtaaacttgatgtgatgatgcaggagctttggggaatcaagtgaatgatgtactttatcactggggttgtcattatagctgtaagagctgtgggagcagaatgactatttgtaactactggaaagctcacaaaaagattacaagctctgggccttaaaccccttaaataaattatggtaaaagaattatggtaaaaaattatggtaaaagaattagagtacatcaatgatgtactctaattctctaactccttatatctgtaaggataaccttagtgataattaccctacacaatatgattgtttgggttgcagaattacaacgtaagttgaattcaaagacatgctgtgtctattatgtgatagtcaaggcattgatagagatgggatggggttctgaaacacctctaaattttccctctgaaaattggagggaacagttagatagatttagttgaggcaaataatttcaagactttgagtctctgcttctgtgctgacttcagaaacatcctgccctccaatatcaaagaagggtagtgtttcaagagcccccagctacactggggctccagcattagcacagctagcaactctgccctaatggaagatgaatgggagatggacagggtatttgcagtgtgcctttcacaagatacttcttatacctggtgaacatcctaaggcctggttgtccaaaatgtgagcaggggtcccaaacacaggaaacttgtttatactggcagacgtccctgtgactctttcctgacctgtgtccagtttatgcctacctggccttctctctggagctgggaatccaaccttgtgttctccctgatatgccatggaaacaatggcctggggtagctcatggtttttcagatgaaaggagcaaattcaatacatcaccacaataggaaacaagagcaagatttttacttagagattctgggcagagagggcacaatgagtcaggaggacagttttccacccctgggtcatgcaaggcaggaatgaagagtcaggcagagagagacactatgtacagcaactagcaatatatataacagaataggacatgggtcactttaagttcacaagcaaatgcccaaatagtcccttttaaggaagtggccccagaaaactcagtgtgttaggtgggaaagatgcctctaagctccactttggcataggcttaagccatttaggtgtggtcttctacttctaatgcctaggcagcaatctttcctgcattattcttgttacccgtagcctgccctttacttacaaatcctgtggtacattcactttgttgaaataactagtgcagttttaatttcttaactgctctctaatacaccattctaatacatctttttaaaaaattcttcatgagggccgggcgtggtggctcatgcctgtaatcccagcactttgggaggccaaggcaggcagatcacctgaggttgggagttcgagaccagactgacaaacatggagaaatcccatctctactgaaaatacaaaaaattagccaggtgtggtggcacatgtctgtaatcccagctacatgggaggctgaggcaggagaatcacttgaacccaggaggcggaggttgcgttgagccgagatcgggccattgcactccagcctgggcaacaagaacaaaacttcgtccaaataaataaataaataaataaaattcttcataaaacagtttcaagatcttttaaaaattgatattaataatcattctttttctttcatatttttgggtgttatttattccttacttccagactacatggcaggattttcagatcatactttactaaaaagtctagtgttaaagaaaaccccacaatatttcttaaatttagagacattattttatattacataatactgacaacataatttatacttttctttcctcttttatatgcattgtttcttacagcaatagtagctattgaggaaaccaactggtcaaatcaaactcattactttctacccaccccaaacatatacttcctctgtgtttcccaccaacaccattccaatcatgtaggacaggagccatatggtctcagttgtgatgactcaaactctgccactgtggcacaaaaatagctatagttattatgtaaacaaaggttatataaggtatggttatcttccaataaaactttatttacaaaaataggcagcccctgggaagtagtttgcctacccctgaggtaggtgttatacccaataatcatttttaactcttacgtccaatcaaatttcaaatgcatatcagtttatcaaacactcacagagtatgtgctctttactggacgtgattaaggtccagctcttatctctgaagcaagctgcgtagatatctactactatgtagtcttactgtcccactataaagagcctcatacttggtcttccatctaatttctttctaaacccttcagatttgaaggtattctctctttagaggtcacagatattttgtgccactgatatggctttgatgaagggaggaacaccaggttcttcgtttcgagttgaattagataaaatgacaccgatacacgtggagtggttttaaggagaggagagtttaataggcaaaaggggagaaggtagaaggaagaagctccccagtacagagacagagggaggggggctccaaagcctaaagaggagaccctgaattcggaggataccagccagttctatgcaaaggctggaggagatggtgtctgatttccatagggctcaggggattagtttgaccatgcatgtcgtttatatagaccgtgaaaaacctggccctcccatcccagttctttaatatgcaaatacagggcaccataatgttctacacatgtagggatatgtgggggcggccatgctgtcaggcacatgtaggggcaagggcaagagagcaacagtgggaattgccatgttgggtggacccggtttccaacggcttgcatttgcgtattaaaggttgccagcctgggtctaagaaccaggactttcatgctagacaagaaacacttttttggagctgtgaaaaaaccttccatgtaccccttttcctctctatctgcctaaaacaatttcttaataactcctaccacaccacaagaatatgtcaacatagcgcaagtcatggatacagagagaacggcatttcaaaggccaattaacttatttgtcattaatcatcttattacagaagaacacaaaacacctgagtaagtggtaatgtacagcccaagttcccttttgttatttctggaaaggtcctcacctctagtataaatagggttgttttaaaacgtgaaatctaatcataatattattatatgacgatacacacacaggcatacacactaagtaaaggctcctgcctttgttatttatgattctggaaatgtaatgcatgcctcactggccctgctgatgatgtctgcaagcatctttgtttgatttttttaaaagctggaagcaacaatgctggatgttgacttgttaatgaagaaagagatctaagacctgagacctttacttagtcagaggttatttagcaaatctggttggctttggattgaaaaaaaaaaatctattttcctatactggagagaaaaaggatgctaaagaggtgaatgaggttacctgatcatcacaaagtgcctatgctgcctttctgcaactaaggcattggaaattgaagtgtataataatacaggcacttcaccctttctgaaactggtcacactgatggtgtttgtattattaggtttgctttacacatttaccatagtttcctgcccaaccaactcctcttgagaaaattctgtgtggctctatgtacagctatgcactaaatattggcaggaagccaagcattaattggataaatatcaccccttctggaaaaatatttttcccaggtttttctcttgtatctcccctttccattatacctcgtccttgaattatctgtatttacatactacagaaggcacttcaggattcagggatgagttgaatgactggtaattaattgctctattggtgatagaagactttataggagccattgctcataaaactggcacaggtgttaccatctttctagaggcacctcttttctgacttccctaatcccttgattccaggcacaactctctccttcgggcacaacgtaatgtggattgggctgtatgtgtattcatgtttctatttcatcaccataaccttacaaagtatcactttactcatttataaaagggacaagcccatggaatggaagaagcattagaaaaggtaatgaatgaaatacaaatagcaccttgcatcccacaacatgtctgctcaatacaaggtaaacatatttaaagctatgttagagaattttaaacctgaaagaggccttgaggagaactgagtccataggttccactggcaggtgcctgcaacagaataaccagggatttcttgctccaaacactggtgctcagctttcccgtagacctagtgaatcagactgtctcctgctttcatgttttaaaattgtcttagatgattctgatgagcagtcaggtttgtaagccagtacatcatttactccttcttccaatgctcaaatcttcctctcaatggccctgttatttgttcttctagcttcttttcagtgatagtgaactgactgtctccaggaacaggcgtgtcctcatgtgacagatttgcacagttcttccttctacacacataaaagctgtcatcagtattgtccattcattaaagccaattctaaccatgggggttatgaataaacaaatttaaccactttttttttctgtttgaaaatgctccagttatatgaaaagatttattttcctacatcttttctcccacgtgtctaatgtatcctgataaagcccctgtcctggagtcccagtttcttgtttactagattttaccaaatgctatttcattgctagagtttcagtggccttatctttatacttttctgataactgtccctctttaaagtattttcaatgtcttatttcagtcacttcttccacaaacatgttgcaaatatattcttgcctgtaagcttttgcaaaaggaattttaggtcttttttgcctatatgatttctatattctcaatcataatgtaggttttttaacatcaacactgtgatttttcatatgagaatctgaaaatgtagaagtaggtagggttgaaaaccttaagactcacatggtgcaactccctaactcttagatccattttagagacaagacatggacatcctggtggactaagtggtttcctcctatctcctgctacaaaaggctccttatattaagatattacatttgtataatgcatagaattcaggctaacagcctgcagacatgttgttttaatttattatagccatatatatatataaagctagcaattaaaagtcaaagatttcacatactactctggaaaagaaacattgaaagagcttgcagttttagggtagcattctcaagtagtaacagtgggctggagctaaatggtacatacccattttgacagaattacatgctccacattacctgtctagatattgtagacagttaattgtaccttgcctctctcttatatgtatgttttttacttgaactgtagtttaatactacgcaatacccagaattggcatatacatacccatatattaaagaggtatacacatgaagttatctgaggttcttaacatgtgaagcagtgcacagcattttagtggtttggagtagtttagagtgatttggagtaataagcctctctgcttgaaatctccagtttaccacttacaagctgtgcaacattaggcaagtcatttaatttttctgaaacatgatttctttctctgcaaaatggacaatgtaacattgttgggaagctcaaggaagaaaatgaatggaatagaaacttttagccaagggcttaataaaattagctatctttattttgtacagactgggtaccagaactcatatctcctggaccgaaaatgaaactgtttctattgtgcaattctgccacacatctatgtttcatgtgtgtccttggccacagtttctggagcttcataaatgaagtccctgctggggataccagctggttctagatgagcagtggaaatatctcaacatcctgcctcaacctgccctgtccccaaagcttcttatgtggtgaacaggaaaaaggctctgtgtgacatgacacttcaataatatacaaaggttgggttgtgagtaggatcagatgcttttatgtctatttaaaaacaattggtaagtaatacaaaattgagagaatcaaattacaagatttgttaggtaaatgagtagcctgggactctacctcgtggcctttgcaaatcctaagagtcttatacaacatattggctttgtgtatggcttccctctgttgaatctggaaaattaacttatgagagaaacttgggctactccgcatctccaggccagagacagtcttcaaacttcacattctcagtagcaatctcttctctttcctgtcctaccattttttaaatgcttagaatgttgggggcagtgtggctgtgtggagagcaggaatgttcttgttttttaagatagcatttactcatgcctcagaaacaccccgaaagaatcaatacttcctcataaacattttccagagtttggtcttgcctcatctggtgcagaatcattgttcttaattgtataaaagaaaagtgaaatttctttttttttttttttttttttgagacggagtctcgctctgtcgcccaggtcggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggccaaaagaaaagtgaaatttctaaacttatccaagaccttttaaattatatcctcaggagtggatcccaggaaagtgtctttctctcctttttcccttcaaaccctctagattattgaaatacactgaagtttgagaattaagtaatccatgttcagagaaatgtgatagcctctgaactaggcatagagatgaagagagaattggcatcactccagcaacaagtgttactgtaaatttagacatatgaggaatacaaagctgtaggtcaagctctttagaagtacgcaggtttccttggctctgaaaatgtaaaaaatgagaactatgtaagaaaataagaacttccatgattaaatatgagaatgaattttgctaataataattgctgtagggttttgggaatgggccaaggaagcataatgggaacaatttggaaaggaagtgatacgatttaaagtaggtcttaaaatatgttcaatctttacatggatggataaaagagaagggggatttttatggtggcaggagggaactacatgaatagatgtgaggtgttagtaaatacaggggtttaggttaatgaaggattgagagggtgtattgaagatagaggtatatacaaagtcatgtaggtgcttatgaaagtagtcaggacaagggttgagatcctaaacttcaaagtagatcgttatgctttagtgaaaaggcgatctcttgatccagcacagtgaacatacaagcctttccataacagtgaaatttgaccaggcatttgagcaacagagtcccttctccccacataagactttgatctggaaatgtgtggacaggcttcactttgggcaaacaaaaatgaaaaccatatccaaggcagaataaagcatttgtaaagcaaggcaaccctattcaaagagcagggggaagtgaaaagagggaaaataagtggaaagccagagatttacctttctctgcttgttgctttagctatgtctcaaggggctgctcccccactctgcaaaaccagacggtacctctctggtaatctgtgtgtgcagcaggatcaacctacaaagcatagctttataaaatacagttgctgaaatgggaactggcagcctcattcattttaaataagactaaaacataaaatcacattctttttcaaggtttcagattgcatttcatatttcttatgctaaatcccagatcacttgaaaaccccacagaagattaaactcatgttctttttcttatactcttacaatactggcaaaataaagtttttgcccttccttttttttttttttaatcctttaaccaggtcagtgtcattcattcacactgctctgagactgtgctaggtggcacagagagtctctaaggcacgatgtggacaagatttagtgctgaggaatttggttgagatcctagctaaatatagctcagtggcaaggaaggtcttcattttatgagaggacttcagtgggcataaaagaccaacctattgtagcaaggctgaaaaaccccataatctgggaaaggtattaccagccttattccatgtgttggtctaaaaatcagtgtgattcctattttacacactggtttaacctagcatatttgcatacttgctcagtttagtgaatgtctgttatcattttagtcatgcaacttggaatcccccttccttaataaaaaataccctcatttccctctgaggagctagaacttccctaatctcacaatgtgtgctttgggtggagatgagtctacctccagctccaaaggaggcatctgatttagccctgaacctcttttttgaccacaaagttggatgcataggtagatagaggaataaattggagccaataaaactaatcttaggatatggttgaaacgaccaaaaaaaggaggtctttttttctttgccttctataatttccacagccatcttttcatcacaatgggacagcctgtctgagaatgaggccaatgcaaagaagaaagtggagcccacgtacagagagatgatacattgatgatatcatgtgtcctagattcatgcttcatatgaaggtaaattttacctttgatgttttgtgtgttcattaaaaaatacaacattatatcaagatactgaggtagcattcaatggtaaatgtcagtggtatgctgactgccaaatatttgccaactggatggggtgtgtgtgtgtgtgtgtgtgtgtgtgtgtgtgtgtcaagagggagatgagggtaaagctctgatttacagtgttttctaatctccataaacattctcctatgccaactttgagctaccagcttgaggtcactgaacatagtcctgggaagagatgtatactgtagattcttgcaagctgatgagagctagctccaaggtatcactggttagattatatgctagctttcagtaagtctaaaaaatttttctcctagtatttatcagtcattttggaaacattacacctttttcaaaaatccgtaaaatattgctatgagacatagtgatgcctggaacacttcctttccagtttgtcagcagaggatgaagaatagcatcatctcccattaacacaagggtagggataggtttagaatacttcagatacatcatacaactctgacttagtaatgggaggtaagaggtgatcagaacagaagcacacatatcagaaagacttcatacctgtgtggcaatatttagatttatctttcatatggaaacctgggaaagccagtgaagttttctgagtctccctttgcacatctttaaaattggttggttactaatacctaagttacggagttgataagagaactaaatctgataagctatgtgaaagggcttagcataatgtggagaacatggtgagtgtccagtaaatattagtgataatgatcataactattaatataaataaataatccactacttttttctctcctctccttctaggagtcccattataccgatactgaaacactgaagtcttgttcgtgtcttttttatgtttttcagattgggtaatttctattgatctgttttcattatcattgactctgattttcttttgctctccaattggctgtaaagaccattggtccatttttcaatttatatgttttaatttgagatcctagaattttcatttgtttctttacaaataattaatctgttgattttcactttgaaatcactctttttctgttaatttaacacgtgatatattgacattttttaaattgattgctctttctctgaatcttgcttaacattgcctcatttcattatgcttttggtaaattttgattgtctactagacattttgaatgtatgatgcactgtggactctggcttcagttatcttcctctgaagtgcatttatttttattttaataagtacttaaattatcgactgatcacaatgaagttgtgcattctttggtttacaattttttttcttccttcagatttcccttaattctatggtcagtctttagtcctgggacctagcctctactcctaaagcttaccccgtctggggtttcagtggaaaacccaaggtgactaccacttgtctaatggtagtatccaagctccgaattctttttttttttttaacctgtggtagagaacagctgaaatttccactcagctttttcagatatgtacttattgctctcttctacgttctttggatatatgtgaaattcagggtcagccacgatgtgagaggagttcacaggtaaattgtggagccaacccaatgtggctttccccttatcaggactagtctctcaatttccagatactttgtcagctgcagtctctgtcctctaacacagtggtccccaagctttctggcaccagggactggtgtcacggaagacaatttttccatggactggaggtggaggcggaggcagaggcggtgtgtgtgtgtgtgtgtgtgtgtgtgtgtgtgtgtgtgtgtgtggtttctggatgaaactgttccacttcagatcatcaggcattagattctcataaggagtgcataacctaggtccctcacattcacagttcacaacagggttcgcactcctctgagactccaatgctctgttaatctgcaggaggcagagcttaggcggtaatgctccttagctgctcacctcctgctgtgcgcccaggttcctcacaagccacagactggtactggtccatggcagctggggggctggcacccctgctctagcataccaaaccaaccagcctgcagctttttacctgagtttcagcaatcacataccacacaatgatgtgaagtaaccctaaaataaaatctgtaacatacccagtgccacttcctttcttcaaaggtcaaatggtcaaatggtctccagcttttgcctgatttttatcattctctagtgccttcaaacagtatttttaccatttttccagagttttaaagtttattaaagaggagtaaatgtaacacaagatactctcatgttattggaactgtaatcaacccattccttttccatttgtatcattttaggcggtttctatatttctcacctattgaaattcctcattcttgtattctagaaataatatgcttttaaaaatgttatttttagcattctggtgccttagagtaggtgagggtatagcttatgctgagttcttcacattgaatgaaactttccagaggtagttattaaatggctttcttggttaagcattcaccactaatttcattcaaatatattctggtaatgagtaaacatcagtttttcctactgctagaaataattctcccatgttttcattatgatctagggtccttttaacaagctcctagagaataggtttcttacaggtttaagtggaaaaataatttcacatggggtatttgtagggtccagaggtgactgacattatcatgcatttatgtattatttctcaggactcagagccaattgaacctgtacatagacaataacctgaaaggcaagatagatgcaggtttgggctacccagaaacagttggcatctttggtagtgtcaagcctggcctccttttgtgcagactgaagtttggcttgtgtttttccatcagcctaagcttttccacttaccctcagtaaacctaggctctatcccagctgcttctaaatttgccaagtgtaaatgagctcaggctgctgaggaaaaaaaaaaaaaaaaaagcctgggacactaaggaaaatagcagaagaaactcttcaaaactctttaccccccagtgacttatgagacagcttctagaataagcaactacaatcttttcctccttctttgttatttaaaagaaaacatcaaaccaacactacttaaagtttaattattctgactaggagggaagttcttatctcagctgtgatcttaattgagattgatttgaaatctagctaagagttctccttgacaggagatatcacagaggcagacaagtttaacgttacccagcgaacttggtgagatgcagaatccccttccaagtttcttaaggcatcactagcagaggaaaacggtaacgatttgtcgtttcgttttgtttaggatctatatatactctgttaccaaaagatggactaaactgtgtcatctggtccttttcaaatggaagtcctaattgacagtcttcagactatcaatcctgtgcatcagctattatttgagttatcatgctatcattccagagaacccacagtcagatgccagtgtaggtgtttcatattttctatgttcaaggaattataagatgttttggagagataaggaaataagtttagcatcacacacacttacctacataatctatggtgttattgagcatcttggttatacgtttcattttttgttgtttgctttgggatgtagctgattcagctgtaggtgcactcaagtgtgtgaatgcaggcatatgccatttaaattcatgaattacatgtccatacattgcaataagactttccatttattaattcattcatatttaataaacagtaaatgcaggtgttagtttcaagttcaggttccagtccatgctgaggtccaaagggagtgggtggatgaatgacacatagctggaagaacactcagggggccgtaggtaggtgaaatatggctttattcagccactctgatcagtagctctcttacactgtctgctctgtcttggctgctcccacacacgactgcgcggcctgctctttcttcagagtcagcagcttaactctttctctgggcacaagctggccaggctgtgtcctggccaacccccgccctccgttcatctgcaaagacagacagctctggctctctctctctctctttctctgggtgcgggcacacctgtacattgtcagcagagaaattataccttttacagacaatagcagcatagggccaagggatggcctccccatgttatggctacacagctgtgacaacaagtggagttatatgcctgcgctctaaacttgctgagtcaggtgggatggaaacatcctaccttggcctatccttgaccaaagcacagccatattccttacagcagggcacctggggtaacttgaagctagccaaaatttggttggaagagatagctggttatgatggtgggaaatgtggtgccaggcacctttccaatgaaacattttcctcctgatagtctcttactggggccaattttgccactacaatttacttctttggattgggtcatggctactttgaaataactttttttttaagtactgtgttcagtggaggagaggtgggagaagtttggaacaaggaggtgaccaactttatttttagacatgctgatttttagttgtctgtgggcatcgggatgaaggggtcaaggtggatacacttgtcagtattcagggaacagattgtggttagagaattatgtttagaagggtctgtatatccaagctaacagaaaccatgggtgtttatgtaattagctagggagaggtttaaaactaagatgagatgcttgttgctattctatgaagcagatattattattccaatttcaatagaagaaaattagtcccatggagtttacttaatttttatttaatcactaagtcgtgatgccaaaaatagaaccaagttctcttagtcaaaattatcatttgttgagtcatgatctctttcttgcccacaggtagctattggggcccagcatgcataaggtactatagagctaagaaaacaagcagaaggcacatgattggcccccaggcaagagtgggactgtacgagtttagaatgaatctctttgtcactatttacaccacttgtctcttttaggcctttcattgtattattggtcacttcttttcaagtcacggtctgtaggccctgctggaatctttttctgaagaggtctaatggtttacttttgtcaaagaggaaagaactgaacttttcaaccaaacattcaaggtcccctgagtctggactaactgtgctttccggttttatttcacgcttcctcccagaacggagtctttcctccagccagacagatcttgtcactattctcttgttttagtgatctatttctatgtaataatatgccccaaatttagtagcatgagcaataagcaacagtcatttttatgcttgcctctcacaactcttggagttgtctgaattaaactaggcattctttgcttgaatttctcatgcaattgaagacaggtggcagctggaaccgacgccatcttgaaggcttctttattcacaagtacggaccatgagctgagaagactcaaagatctgggggattaatctcctagatttcttcagtcatcttcttcttcatgtagtatctctgtgtggtctgcccagtgtggcagctttggtgtagctggtgggtcgggaccctggtggatcaggtttccaaagacacctaccccataaaagagagagctaggcagaaactaacatcttttgtgatttaaccttggaagacatgcagcatcatttttaccacattctatttgttataagcaagtcactaaggccagggccatattcaaggagaatgcaactaaacttcggctttcgattggagaagcgtaaagtcaattcgtggacatgttttaaaaacattatcccaccccaaaaatcttccgtgctttcaagattcttgcattgatagagatagataccatttcctagggctaacctatttctccactcatctaagtactatatatatatatatatatatatatatatatatatatatataaaattgtttttttttttgagatggagttttgctcttgttgcccaggctggagtgcaatggcgtgatctgggctcaccacaacctctgcctcctgggttcaagtgattcttttgcctcagcctcccgagtagctgggattacaggcatgcgccaccatgcccggctaattttgtatttttagtagagacagggtttctccatgttggttagattggtctcaaactcccgacctcaggcgatatgcctgcctcggcctcccaaagtgctgggattacaggtatgagccaccatgtccagtaagtactacatattttcatatcattgttaactgtcacttcctctggggagacttcacttaagttaataatcactaatgacgtctggaccactttctgcaatactctacactatatgcaatactagctatcatttttcatacacatgtctacctccccaactaggaagatatagtgaggttttaaaagataagaacgtgtttcaaaggttaattcactgattaattcaggatattaaggtgatatttattatgtcactattatttaataattgataaatgatagacatttcttcattacgtttctgaccaggtttatagtaaagctcaggtctgaggaccaggaagcttcacctctaatttagaaactcttgatagagcaaatccctttctctttgagtctcaattctatagtattcataaaatgcaaataaggtccctttgggcaggaacttggagaagggcaaactaattaccctcacactgcagtgtaatttttggtatgatatcccttttgaattcagcaaatcttggaggctgttacagtttatgctcttcagccttttttcttggtaactaggtggcagtagcttggagaagcctctaatcttggcaaataaccattaaaataaaaggtctctgggagcccctgggggaaaactttatcaggaaaccaattagtttaggtccaacccttgactctttctgttcagaattttaaaactactgccttatatcctgttttattttcttaacctgtaattaattactgcccattacaaattcccagaccacaggaagcctttatctgcaacattaggtcacttggaagaaagattaaatctgtaaagagaggatactgaatgactgaagggtttcaggactgaacatattaactccagagatggcttcctgatttggggaataatccaagacattctgtaacccatacgtacagaaatcttccatcacgactgtgtgatccgcttgagaacagcaggtgttcctgaaataactaccactaccaaggctagattctgggggatagggagattgtcaggtcatggccttgattgtgaaatgagtgcaacttcttcccaccaacgaagaactgaagaaggacagatgcagccacttgtatcattatgacagatcaaactaattatgacagattaaacatatctttgttacatggtgaattttactcgaatatagtttcgagtaaacttagcatcttaaagattttaaaatttttattacttagccctcaccctacatacaaacaaggttatgttgtattgtaggcatgcattgtttcacttaatgactaacatgaagtgagtattgttatcccacatttaaaaggaaaaaaactgaagttcagagaagttaggcaatttttaaggatcacagattatcagtggtagagatctgatttaaattgaggatctgctgtttctaaaatacatgttctttctgctaaatcctgtatacacacatacacacacatactatatctattcaaaaaatataattcaattagagagtggaatatcaaagaagaactttttcagatgtattttattgttatctaaagttgtatctctaatggctaacatggtggctagcatggagggcaggcttagtaggtagttattgaatgaatactcttgtgagttgtgacaagggaaaggatacaaataaattgttgagaagtacaaagaaaagttgagcttgctcttaaaaaatgggacaagtctgggcacacatttgacaggaattgagtgtcagaaaaggatttccttgcacatgggcccccatgagcaaagtgaggggttaagtcttagtaattcaaagggtgaacaaaaggttcaatgggaaatgaaaccattgaaggtggagtatcagacattaacctaattgttaataggtagagaaagagacactttttagttaaggcaaattttactccaactgaaatcactctaaacatgggatcacaggtaaggctgaacttgacaatttgttaagggatctgatcatgccatctgaattgacctggtgcagggctttattcaaatgccttatcataaaatgaaaatagagttctccttctgttcatcatatattcatgtttattttaatgtttgttctgggaagatgggctatcacatacctgtgagggcagtgttacaggaggttaacttgtcaacataatttacctcagggggaaaatggtgtttctatgatgtttatttttcaacttcagaacaattataatgcattttagaaaataaagggaagtcataagaactctctaatgcagcctgttccaacaacaaaaaaaaatttctaagtctggtatttccaatccagtcttagaattttttttttgttggaacatgcttcattagaggatttacttttaagtgagcaaatttagtggaattatgtccacactgcaaagccaacacttgttctacaaagcagagggaagattgaagcagcaagggaagttgtctcccccacatcaaggaatcctattcacatttgctggagaagcctaacactcggagaaatgagctgggaaaatttcacatcaccttcaattggtccttttccctccagtttgtcatccttttcctcaactttttagtggatgattaggtatgcttcaggctttaggtccctaagagctttttaggaatgacaaaggagacatgatatcaacatgttactgcctcaggagaagagcctgaagcagaccagttggtgaaacaaaataagaaaggctgaagttgaagtcgcatttctacacatacttactggctgtaaatcgtaatatctatactcatatgactttctcctatgtgtatttattgaatgaatgaatgaatgagaaaataaatgtgtattatttttgcctccttctcgtcccctctcaagcacattaatttagcacctactgtatgctatgcctctaataaatatgaccctatccttgtcctcaatgattgtgcaatccgattgcaaaaaggcaatgtggaggactatgactcaagattcaacatataaggaaaagaatgattcatagaaaggttaaaaacagagagtgatcaccacgatgtgttcaaagggtcaaaaataaactcccagctcaatagcccaggagcattatccttactttgcagaggtgatagaggcacagagaaactaaagtatcgttctcaatcaaaattctactagcaggtaaaaaaggacaaaaaacccattatttccttttattactatgaactgtttctcaagaaaatagaaaatattaaaaaactaccataaacagaaaaattcttatgttcaaataacttataacaatgaacacacaatgccagctcacatctgcttaaaatactgaacattggtcaagtttgatttacaaattatgacccagacaaatctataaatgcatcaaagctttagaattctagcattaaaggttcattcccctgaaagcaaaacactttccctctttccagattttatgtcattctacatagtagccagaagggacaattaaccatcttttgaagacattaatatttacatgcattatagattatataacccaatcttgatttcccccttgcacaatggcagtaagccccacctcaagagtccagaactgggatattctctagttctgtagtagagactgcatactcagtattgaaaaatacagaatattagggccctacaacaccctctattcactttcatagcaaatatgatgaggaatccagtaaacacatagcctgaatctacctcatagtcctctcttgcaatgaaaatcacctgttctttttgcatatgaaatggaattgaatatatgatttattaatattttagatatttcatctcatggctctacacacatagacacacatatgcattcacacatggcaagggaaagaagtgaaagaagaaagaagaaacaggccctactcttagaaaacactacactggtaagcaatcgtttgtgagccccttgacaaagactaaatttttaattcccatgtccccagtgctcacatctggtctcaataattgcttattgaaaaactgaacaaatgattcaatcttcattcacttactattcatttatttattcattcaaaaatatgtatggcattctgttttgtaaaggtaatggcaaaatcataatgggggaagacaaagattatgctgtgggctggacttacatggaaaggatttaccagagctatatgatagagttagaaagggacaatttaaaggaagaaacaaacgaggcatggaaagagggaatgttttacataatgcagtaaaagccaacctaagcatagatttatatgaaagaaaatatgcttctctgcacctagtaggaatgttgagctgctttgctagtagtaagcactgttctcacctggttctcccattaagattttgtgctatcctatttcaatgaactgctttaacatccagataattcagctctacttcttcagaaatagcccttattcctttcactaattatttggagattttccatcgtttacttttgtagttagcaggtgttaaattaaaaagaaaaaaatatgaaaggaccaccaccaacaaaaaatgctccactatatacatgccccatcacaaactctagcaccaatcttccttagtctcttctattgccgaattctctgtcctgttttgtactatcatagtgttgcacttgtacttccttttcaaggttcccattacttgcattcctctcttagctaaccctgaagaaacacgcatctgttctctctggaaaaacatttctgattctctgaatctagcctgggctagatgcagctcattttttagcaacctatgctaatatcaacaaaaggttcatgttacagagggagctggatctagggtctcaaatcatgccaccaaaatacttttcttttgttttcttctctctttgtttctatgtttgaatcattctggagaaaacttcttcttatattgggccctgaagacatctctgaaataaaacattcatatttgagatttactttaacaaaaatagcaattaacactttcattggccaggactggagtcatgggcttacccttagaacaaggatgcgcagtctacccagcctaaattacagggaccaagaatggaacgggatgatatcttaaaagtcaattggaaggagcttcaaagtgtgattacacagaggaaaggataagttaaacaattatagggatttaggtggattgaagacagagtgacattgaaagagttggagaaccgtactcaacaaacacacacaggcacacaatactgaaaaaaatgaagaaatactagctctgatattataatagtattcaacaacaaaaaagggccatctttcctttgtggaactgtttatctggcaattaacaaaagatctttgctgaaatcatgggtttaagacccaaattaaatttgtagttttgttaggaggtgctggacagtagcagttagagaacaggcttttgataataattacgttgatgcagatatttagccagaattctgtggacattatctcatttaaccagcccaacaatctggattatcattatctctgtttcacagatgatgaagaaatagtctttgcaatattaagtaacctgcccagagtcttacatgtggaaaatggtcaaaagaggatttgatcttgaatctgtgtttataaaagctttgtctattccactgtgccatgagggctgctttccttgtctcctgtttgattagcaggcaaaatttcagtttttcatttggcacattgaaatattccattttccatcatttctcatatataaacctccctgactctagacaatttttagagaaaatgaacccaattttgccaagcggcttcttccgtggatgcttactggtgaagcatcatccggcagtaggctgaaatcacacaaccttaggaaagcctagttcttcctcttcccaagagaatggatgtgaaggtgtacacagacagttggctcctatgccaaattttggcttgattaccaagatgtactggcaataatgtgaaggtttgtttacatggcctattgcctacctgtctgaactatggaccatctgtgtatgagttgcctaggcaataggttgggaatgagcagaccaagatttatctgcactgattgtaagcagaaaatgaactttcccaagtaaagatttgattttaaaaaatcaacctgaaacagattctctagatacaaattattttggagaagggagaagtgactggttttgctaatattgcaatttttatgtttttgttgttccttaagataaagcataaataactgacagaagagaaatgagctactcaatgaattataaacacaaatgagtccataaaatatttacctgcaatgaagcgtatttgatactatttgacagtaagtatacacaaacctaaaacactattgcaacaagaattatttttaacgtgctccttttgatattttttaattgaagtctactattgtcaaaacttaacagggacctgttaagttttggggtcatgtttttgttactctcttttctccaaaaaccaatatcttagctatagggtgagatactagcatctcttcttgttatttattattacaatcatcataaatttgactatttgcaagtaattgtataggtgcatatttaagagtaattacagctatccatagagttttgggggaagtaaaagagacacttagagatccacatcaaatttggcagtgaagtttgtgggaaagagcacattatggggttaatgagggtccctgcctaactgtcctgcatccacatcttggctagtgttagctccctatactctaaagcttgtataacatagcacagcatgggtattaagagtactgcattcagaccgtcttgcctagattcctagctccaccactccctagccacatgactgtgggcatgggcgtgctgcttctcagattcctgatttgtaaaaggtggataatagaaactatgcatagagtggttattgggtgagattgggagagtgagagattgagcctggtacctgaaatgtgtagacagaggtaggtaatcaatactggtattctcctcttggactttacgagtgggaataatatcaatctgcattatttccaatctctgcattctatataaaacctcataatctcccaacacatattctggacaggtgttattgatccatttcagaacctgagacagccaatgtgcctatgctgtgctgacataattctgaattgcagctcaggtagggagtttaactggaggaaaaatggggaggttggctaaggtgatcagaatgagaacaaagattgactgatattcccaatagcttctgttaagctcatttcctttcaggaacactcatccttcattaacccagaatgatgatttacaagaccttaaaattagcttattttggaaatttatcaatgcaaagagtaaaataataaaagtttcagattcatatagatgcttccataaaaatgacagtaaaatttatctgtacaacttggagtgtgggggagggaaaaacagaaaatatcagctagcagttatccttaatgagtggggaattactatggaacttattctttcacttatgtggagattgattaactctcaaattagataattactgtattaatgccgggtttacatataagtgaatgggatttgatgcatagcatctacctatagtccttgatttgtacaagatatgatgagaaacttctttcatcctgattttccaaaaaaattcttagcccaaagtgagaaataaatgttttctaattggaaattgaaatataggaagagtaatcgaaaggactgtcttaccttgtcctactgaaaggcagtgaaaaacagtctaccaaatatttcttcttcctgcctttatccagttgagcatttcttctcttcagtacttctgtctccctttacttcactagaacaaagtcaacggtgagaaaaattgccaaatactcactaaatgggtgtcaaatagagaactgagagcttattgcagcttatgttcccctaagcaactcttgtttgtttacattttgtagtatctaccagctcataatagctgtgacaacaggatgacactgaccctctcatcttacttgactgaaacatctattgcctttgatatgagttgagtcaatattgtcttttctaggtgttttgaattaaaaccaggaaaattggacacagaaagtcattgtttaatgtggaattttgcaatatgtacatttcagagttgaagaagctatgttctacagaaatgagggttttatagcagagaaagaagagagttctgagagagagagagagagagagagagatagagagagagagagagagaatagagaaacaaaaatgaaaatgtcccaggttctcgaaagttttaatttttcaggatctgaaaatttctggatgtctggctgcatgtttagtcaagtcacagtgaatctgacagaggcaaactttgctgattaagacaattatttgactggttcattttcttaagctttccgtgtcttttttgtaggataatcatgttagcggttgtaggctctggatgctaacctgtttactttgttttttcgaccatctctagcttttagacattaatcccacttttaataagcggtgctctttgagtctcaattaacaagtcaaagcaatttctgctgcttctgatcaaggattgatattctttttgtgggccatacatcacctcaatctttctagcctaagtcgggggatcatgagatgggcacatattccttccacatcttctttccaaacactattcctcttcataattaagctgctctttcccgagcattatcattagtccttacaagagacacaaagtagattttattattttcattttcggattgacacattgaaactcaggaaattaaaataacatgttcaatactggagttgggacatcgaagggttggaattttaattgaggatcgctggtctcctaagccaaagccttttctaggaccctaccacctcttgttctttctcagtgtcaggaatttaacattggattaattacttacctcattcctttgggatttttatagtattcaccgtcaagaaccataagcacttttgaatttcattcctcatcacaatcccaagaggaatgtgtctattaacattttaaagatgaggaaactgagtcttggaacttgccaaggacacagcatttatagattgcagtgttggacagcatgcccagatcggtctgactgttctcccaatccacatcacttgctccagatctttactccctcttttattttccagccataattagcatgtgttaaactgggacacttggcttagtcccatgctactctcaagaccagatgatttgatgtactaacttagagaaacagaaagggaaatggaggtggagaaaaatagagaaaagcactgctacttgcacattaaaaaaggaatggacaactcattcaatgaacaagaaacccctaggtctaagttgtccctcaaccctaagaaaaaaaataggatggctgactttgaagtaaccgccttcttccagctgtcatacactgactttagctcccatgctggaagttgccaccttatagcacgacttttgttcttattccatcaatgcttctgatattcatttcaacctgattacaccctttctctatgctcaggtcattgcataactgattatgttctgcaagccttccttctgccctctcggttccttccttcttgtcatgcctcttctttgttcctttgttcattcatttactcattctcttcaccaccaccttcattctcttttccctttcctgtcactcctctatgacatgcattagagaagggagaaagggggaataatctactcatctatgtgttctattcaaccacatgccttaatatcttgtttctataacaagaagtaattttgcaaggacattatgggactcttaactataagtaagaatctctcttgtcctggagacatgtagcttcagttacttacatttggcctgcattctaaagcttatacatataaccggtccaaagattttactactgcctaacctaacttctttcaggtgcatggccagtttattcttgcttattctccagctttcccccaaaccctctaagagagctctttaataaggttgaacctgtgacaacacagatggagacagtagagacagaaagcaaagagagcaggccgacaggcataggcaataagcaagtcatcatgctctgtgcacagaataaagagtgttgatccctcagctacacaaactggttgtgaaaatagggaaaacattagtttttggaagttaaagctcagttaatatgtgaccaatgacatattaccccatttgacacagtaccccatgtcatgggatactaagtgttttctgtgctagcagttatgagaaaatttcagaatatggcttgtaaaaaatttttcttctcagattataaagccttgattttcagggggggtttaaaaataatctgtatgaggcccagcgtgatggctcatgcctttaatccctgaactttgggaggctgaggcaggcagatcaccagttcaggagatggttaacatcctggaaaacatggtgaaaccctgtctatactaagaaacacaaaaaattagtcgggcatggtggcgcacatctgtagtcccagctacttgggaggctgaggcagggggatctcttgaacacgggaggcagaggttgcagtgagctgagattgtgccacagcactccagcctggtgacagagcaaggctctgtttcaataataataatctgtatgtatatatggtgcatacaattacagatctgcaagaataattactgtgattgattgagtgccaaaataccccaatttttcagcccaacacatatccacaacatttgtaaaacaacttgtaacttctcattcttccctattcccactgttaaaggtggaattgattgtcccacctttcagccccatgataaatctatttgtaatttggctaacagaatgcaggagaagtgatagtgtccgaagccactgtcactaggccggtccaaagccgaggcctcaagaggcctttccagattttattctaactctccgacccccgacccccgactctgacatgagaacaaatatgagttggtcttctggaaaatgagactattaagagcagagcaaaattatcccatccaagactgtccttgcccagtcgtccctgacaaagagtctttttttttttttttttttttgagacagagtctcgctctgtcgcccaggctggagtgcagtggcgcgatctcggctctctgcaagctccgcctcccgggttcacgccattctcctgcctcagcctcccgagtagctgggactacaggtgcctgccaccacgcccagctaatgttttgtatttttagtagagacggggtttcaccgtgttagccaggatggtctcgatctcctgacctcgtgatccgcctgtctcggcctcccgaagtgctgggattacaggcatcagccacgactaagagcgtctcaatggttccttcagtttgccaacatttgcgacaggtttcttcctgactctaggcccctgactccctttccttagagcattttcttttgaaaacttataaatgctttctctgcccctttaagatataaagctttaaaaagaaaaaaaaaaaaaaggctctggacaattttagagcccaggaatgtccttcccaaagacctgagagccatcgctttggaatgtagtcattgaggaagatagaaccctaacttccagtctctgtggaaggagcctaacttccatggcaccttgctccaagttgtgaaactacctcttgtcacaaagatatgagaagtttatttttcctttggataaagccaattagcaatcacagacgacctatgacttccccctaacatcctccagtactttcccaccagttcacccagggcttcaaagccctcccaccctttgttgcagcaaaattgaattcaggttgagttctgccttctttgcctattgcaatagatttgagtaaggtttttcttccctattgaactttttgtccagtaaatgttttgctttgacattctccaacggacatagcaatgaactataggccacagatatgtaagtccagattggatcagctgagcctgacacatatctgcaaatttgcccagtcaacttgtggtttcataagtaacaataagtgtttttttgttgtaaaccactgaattttggggtggtttgttataaagcggcaattaagagaaattatgcagcagaaattggtagctatctgtgagggtctgccatgactaaagcttaaaatacttggcactggctttgagacagagacacaagtgagagctggaaatatgatgaaaaaattattataagtggctggaaaaatttcaacttgtgttatacattagtgaaactattggtaaataaatcttctgcagtaacatggcagacaggaaatttatctaacaatcttataaatacgagtaatgagattttcaggaagtaaaagctaagaaactacgggaagatgagctaatgaaattacccagtttgcaaacggaatgtagaggaaataatacaggagccaagaaggctttagaaataaaactattgtcatctcccacttttctacttgataaaagatatttcaaagtgaaatgaaacctgggtgagggggggcagattaaattaagggtatggctgttgagttgtttgttaagacttaaagaattaaaatagcatctaatggaccccttgtgatggttaattttatatgtcaacttggctgggccaagtggtcatatgtgtggtcaatgttgttctgaatgtttcagcataggtatttttgaaagagattaatatttaaattagtggccttttagtaaagcagattgccctccataatgtggctgggcctcattcaatcggttgaaatttgactagaacaaaacagtgacctcccctaagcaagaatgaattctgccgcagatggcttttgggcttgaatgcaaaatcagccctctcctgagtttctaccctgctggccctctgaagatatggggctcatcagcctccataatcacatgaaccaatttattaaaatgcatctctttatatatatatgtacaaaatgcatcctttatatatatatgtacatgcatacatacatatgtgtatatacatataatcatatatattatatgatctatatcatgatcatgatatatattatattatgatatatatattatatattatgatatataatataatatataatatataacatatatattatatataatcatatgtatttatataatcatcctattagtaatgtttctctggggaatcctgatgaatacacctctttatctggataaaatgatttctaagaatttttaagaaatttttccacaacaatctgttacatttgaggtggtattaagactaaacataaatgcttgtctcagaaataagtatggaagtggcatatattgaacttgaattgaatttatgtattgaattgagtgaacttatgtcaaatccatagaaatttccctaattttaaagggactataaagccaaagattatgccatccttgactataattttaaaaagcttcttggtcttgaaattactatgggctggaaatgggttgaaaaaatggctcaaaggatatattttccaatatctgcttcataagacaccaaaagagcagattaagaagaacgtctcagaagtctttggggcccgaccaagcaacacttcaatcccaagagacaagcaacttctgcccaatataatttttggaattgctgtggactaggaactgctacagctctcatcttcttccccttcttgaatgggagtgtctactgtagctattctgttcctattcactgtttcatattttatatcagggataggtgggataaagtatatctttttgattcatagctcttcaaattaagagatgccttatttgaggtgaagtagaccaattgatgctgaattttgagtgggatgcatgattggattagactttagagtttttgagcatgggtgggtgcatttttcttgtgtgaggatgtgaataattgtggccagagagtaaactgtggtagatctattgccaacatagtgcaaattgtctacttgtctctgtatctatgccctctgcaatgtgactttggaggtactctcattaagcagtggattctatgcccccacctttaatccttgctggtcttatgactttttccagcccctagaatatgacagaaacaacagtgtgtcaggtctagaagccatgcatgcttctgctctttctcttggatatctgcctccaccatgtgaacaacaacaacaacaaaaaaaacaaaaaactactctactgaaggatgaaagattactcagatcagagccaagatatgttattaggggccatccaagatttctcagcccttaactgatttgtctgcagactgccaacacatgagtgagcccagctgatacttgccaaacctggcctggacctgcataactgctcaaatcatgagacttatgtgaaataattaatagctgttgtgttcagccactagttttgggatgccttgttgtacagcaatagctaagtgactaaattatatatcatatttctaccagggaaatctagggggaggcatctgtgactgtctgcatcagatgaggctctatgcttacactctcccagtcccactggctgccttgtggctgcttttccacaacacaacagacaggttgttgcctctggcccttgcttatctcccagatagatgtaggtttctcctctacctctttcaataatttgctcaaacataaatatctttgggaaacctttcttaaccacattatctaaaatcattccctgtcagtcttctctatttactttcccccatagttcatatccacattgaacgcactcatgctactaaagtgaatatgctatgaggacatggattttactatttgttttctttagcgccatatatctggttaactatacatgaaataagaatgaatacattaaattggagaacaaaaactaaatgtaaaagaaagaagaaaggaagaagtaaaaacaaaaagaaatgaaagaaaagtcattgtaatagaagaaagaatactaacaacatgtaactgtaacttataattttttatttatttatgcatttatgcattaaataaacaaagcaaaatttactacaagccatttgtataaagtgtggtgacaaaagctaggtctggtactagtgataataataatagtaataataaaaaattacataggacccctttcttgagaggcacatcctctccctttcttgagaagaaagggactagtatgtgcccacggatttagaaaggccacctggaaaagtaacattttgattggattgaatatatacataggttatcaacagagaaagttatttcagactgaagtaaaaacaatttatcaaggaacatagtttatttgggaagtggccagaatgtaattgtagctatggatggaatgtcagattggaaggaaactgtataattttttttaagacagggtcttgctctggtgcccagtctggagtgcagtggcatgatcttgtctcattgtggccttgagctcccaggctcaagtgatcctcccacttcagcctcctgagtagctgaaaaaacaggcacacaccatcatgcctggctaattttttgtattttgtttttgtagagatggggtgttgctgtgttgcccgggctggtcttgaactcctgagctcaagtgatctgcctgccttggcttcccaaagtgctgggattacagatgttaactaccatgccaagtgaaaatgtataattttaaatatggcatgtcaagaatttggaatgttgtctttaggcaatacgaatccaggaaaaaaaaaaacttaggtgagaatacactgatcagatttaattcttatgtcaataggtaacataatccaattttggaagataagtgttttcagatacacagaaattatttggatctctggacaaaggtggcataattcttctgatagggccacttaataaaggtcctaagtggagctaaagaggaagccaggataaacccttttaggctttttggaatacatcttactgtagctgcaaaagggatgggggcttctggccaagcctctaaagcgccttgctacctgcctatgcatgaatcatgctctacttctagatgaagtatgaaaatgacattcctgaactcaccataaataaattaaaaacctcaagtccttttttctagtagggtaagtccttatacactaacctaaatatgctcttttcacttattcatattgtgacaaagtaatgctactttatgaaatgactggtaaggatttaagttgcagcccaaggccagggagcgaggctaattaggccatgtaggaattgaacatttcactgtagactctgcattcagtcttaaacatgggcaacataatagtatttttgaggcaatatttttcagttcctttcacaggatttcctggttgagtcaggaaaatatcagtttttcccaatgcacagctggcaagcaacagagtggacagggactgcatctttccataaaatttaaggtagaattattgtatgagatcttgaaaatctgatccattttcaagtctcaaccttgtgcagtaaatataaaaaatcaagccaaaatctctgctacatactttcagcggtctgtcacttccctctctcctcagtgtcaccccactggatatgacctgttacttccatgatggattgagcagccgaagttcttcagcctgcctctctattatggagactccctggtacttgacaaaatgcatcagtgaggttctgatgacctgggtgggcctcccttgctgcttgaatggccatgtgcacacaaaagcaaatggtgttaaaggatatggatgaagcaagtgactttccctgaacaatggacctgaaaagacatggagaagctcacagagggcactggagacgtgtcagcagaacttagagaagctgctcagcacaccccaagcacagaggcaaatatgaaaacaaatggaggatttgcaaagggatggctgttcaccaagaagaacagtggaagagaagtggagtcctagcaggagggctgtgaattttgtgtagggtccagattagggcagaggaagcacacgtgctcacaaattttctgtatgaaaaggggcttgagcacaagattgagagagctgaagtatgtagtagactctatttttgcctgcctgacatctattcctcttttaatggtgtttcctcctgttttgtgttggtgaacctctgttttcctatactcaaattacgttggtgagatgagggtgtggtgtccttccctcagctccagggattgaaatgaacctcatgaatggttcagagaatcacatcataccagatatgattttttttctaaggtagacacaacccactcctattaaagacaatgagacaatacaatccaattccatttttggggttggggggtagaattgctgggaaacaaaaaacaaaacaattttttttttctgctgaactttaagctcttttgctataagtctgtagctgcacagggccatcatacacaggaactggattcaaaatgaagccacaacagaaagcaactagatcagaaagatgcaacatggccaattactaatacaattgtctgagttcctgaatccacacttgcctagacttactagctaagttggctaatgagtcatattgtgtgtttaaatgtgtctgggttagatttctgtcactgctaagcaagtgttctgacttatacaaagtatcaaaacattgttcttaggctatacaacccccttgccccctaactcacactacaacccatgaattatagcctaaatcaaggcttatatacaggtagtttattctgggaattaattccaaggaacggggtggaaagtgaaacaaggaaggaggggaggcaaatcagaccatgtaattgccaagtttatcaccactataagcaaatgagggtggatcccataagggattttatgagaaaccatgtagaatgaccttcagtattgtgcatgtgagaaatggaaaaggagaatattcatctattgttttctcttcctgtgcatcatgattgccccataaagttctaaattctttccacttccagacttgcacagacatcagaaatggctgagtaggttcctgcagggttcttctctgcagagaacaggaagcatctgatatattccattcatcactctactcagatccacctgtgcactcattgagtccaatccattaaaatactctcgtattagtctgttttcatgttgctgataaagacatacccaagactgggcagtttacaaaagaaagagctttaatggacttacagttccacatggctggggaggcctcacaatcataagggaaggcaaggaagagcaagtcacatcttacgtgggtggcagcaggcaaagagagagagcttgtgcagggaaactccccttacagtaccatcagatctcatgagacttattcactatcacgagaacagcacaggaaagacctgcccccatgattcaattacctcccactgggtccctcccataacacatgggaattcaagatgtgatttgggtggggacacagacaaaccatatcattatgctcctggcccctcccaaatgtcatgtcttcacatttcaaaaccaatcaaatccacagtccaatgtctcatctgagacaaggcctatgagcctgtaaaatcaaaagcaagttagttacttcctagataccataagggtacaggcattgggtaaatataaccattccaaatgggagaaattggccaaaataacggggctacaggccccatgcaagtccaaaatccagcaggagagtcaaatcttaaagctcaaaaatgacctccttttgactccatgtcttacatccaggtcttgctgatgcaagagttgggttcccatggtcttgggcagctccacccctgtggctttgcaggttgtagccccactcctggctgctttcatgggctggcattgagtgtctgtggcttttccaggtgcacagtgcaagctgtcagtggatctaccattctagggtccagaggacagtggccctctcctcacagctccactaggtggtgcctcagtagggactctgtgtggtggctcctagcccacatttcccttccacactgccctagcagaggttctccatgagaccccacccctgcagcaaactcctgcctgggcatccaggcatttccataaatcctctgaaatctaggtggaggttcccaaacctcaattcttgacttctgtgtacccgcaggctcaacaccatgtggaagttgccaaggcttggcacacagcagaaggaccctaagcctggcccatgaaaccattttttcctcctaaacctctgggcctgtaatgggacaggttgcttcaaaggtctcttacatgccctggagacatattccccattgtcttggcaattaatatttgactcctcattaattatgcaaatttcttctgctggcttgaatttctcctcagaaaatgagattttcttttctatcacattaccaggctgcaaattttccaaactttaatgctctgattccctttgaaaactgaatgcctttaacagcacccaaatcaactcttaggttgtgacaaaccattaatttcttcaaaagacctaatacaccaggattagtgaagcaagctgtagtaactgttgcctcttgaatgcacagttgaggcactgcttgaattgacattctctgagtgttgggcaatacttttaaacctaaaaagctggccaggcatggtggctcatgcctgtaatcccagcactttgggaagctgaggcaggcggatcacctgaagtcaggagtttgagaccagcctgggaaaaatggtgaaaccccttctctcctaaatataaaaattagccaggcatagtggtgcacacctgtaattccagcaacttgggaggctgaggcacaagaattgcctgaacctgggaggtggaggttgcagtgatctgagatcgcaccactgcactccagcctgggtgacagagcaagactgcctcaaaaacaaacaaaacaaaacaaaacttaaaaaaccaatattcattctatggtgttgtggtctcaatagatagaatatatgagtctgacatctatggggtaaagataggtgtaggcctgctttcaacactcttagcaaattacttgggacattcatgcattgtgcttttttggatacagagatttttcttcctgatgagggaataccttcaccatgattaggttgaccaacatgttctatgactatccaggttttcaactagcggtcctgctttccagaatacacctaaaccccaggcagctgcaggggcacttactcagtcacttttgcctctgtatgctggtggctcagcatgcaaagaaaaaaagttttcatagatgcaggggtcttttatgctgattatcaaaaggtagggtgctgcttcattataaggacatgaaaaaagactgtgtttgaccattaatatgctggggcatattaatgccccagcaactttcttgctctattgtaaccttaaataggcaagttcagcaaccataggttgataagtacatgttaccagggcctcaggacactcagaaataagtgtctgggtttctgataggcatatatttctggtagaaatataacccaaattggcttttgcatataaggtaatatattggccatattaattaataaaataaaaaattgatccatggttcaaatagttttattagtaactcaacaagtaattataattcttttcatatttctcttctacgtttattttgtgatggctttatttcaaagcaggttcacatgcatggtggcccattgcagctacaggtgtacagcaaatatgcagccataaaaaatgatgagttcatgtcctttgtagggacatggatgaaattggaaaccatcattctcagtaaactatcgcaagaacaaaaaaccaaacaccgcatattctcactcataggtgggaattgaacaatgagatcacatggacacaggaaggggaatatcacactctggggactgtggtggggtcgggggagtggggagggatagcattgggagatatacctaatgctagatgacacgttagtgggtgcagcgcaccagcatagcacatgtatacatatgtaactaacctgcacaatgtgcacatgtaccctaaaacttagagtataataaaaaaaaaaaattaaaaaaaaaaaaaagtgtcaagtttggaagtgattttttttttcttccacatttctaacagaagacctagaaatgaatcttgacttctacagtgcattaaggcactggacttagattagagctctctcagaaaacataacctaaaacgagagtttgtgtacaggtagtttctttgggcagtaatcccatgtaacaggagtaggggaactggcttttatttcacaggttaagataccaacggcagagttctgccaaactctatatcccaattacaaataaaggttctgggatgagtcatttacctatggaacttagtatgagattaacttgggtcagtactccacttaaaatctgcctaccagtagtccacattctaggtgctactatgcctattccagagcactgactgatatcaatcctaattcagacactctaccaataaccattggtaatgataggcaggctcctttctctggaatacagtttttctcataagtcaccacaggcccctgtggaaaagtaatgggatattaaatatcatccatataagcagtggtattgcagagtccttcctaaagcagacacagcctcctcttcaatcaatgagaactggattacatttgaaactcagtgagaagtcatgatttttcagccagccttctattcaccagctcttatgtccatcccctactcagcattatattcagcttcattggtcaagcacccttaggttcattctgacaagtggttctctgatttcttccagtaaataatagccaaatattgcaatattgcaggaggtggaggagtgtatactactttcttctacagtatgcattgtatttctctacttggatgatgctgtaatgtgctcatatttactagtatggatgcaagagggaagctgaggaatattgagaaaggcaggcatctatttgttaggtatctgacttaggggaagtattgaccacatctcaaggccacttcttgtaaggagaaggttgctgctacttctggctgtgtgggattagggaaatatgggtgctatggtttggatgtttgtcctttcaaacctgttgaaacttgattctgtgtgttagaggagggtgcctaatggcaagtgtttgggtcactgagaaggatccctcatgaatagattactgacctctcttgggagtgagagagttctcactcccttcattcctacaaaagctggctgttaaagagcttggcaccgtcccctctgtctctcttgccccctctctcaccatgtgatctcttcacacactggctcccttttgcctttcatcatgagtagaaacagcccgacaccctcaccagatgaagatgcccaattttgcactttctagcacagaatcatgagccaagtaagtgatttttcttcataagttacctagcctctgtattcctttatagccacataaaatgaactaaaaccataggcatttacttcacttatgcttatctattcaaatatccccagctcaacactcaagatctcacttgtgtcttcctataattctgattgtatcctaacaaatttattgagcctttccatttactcaactttgtagctacactagttttacagttagatcctaagtgcaatatttagcacagtcaccctgttgcttcaggagcgaaggatctatttagatgcttccctggagtcattctagctcccatgttatgccttcagtgaatagctagctagctttgtgtgtgtgatattcatttctcatatcttctaaagctgccaatcaactttataccatttatactttaattgcttgcatatggttttaatatcagcattcaatataagctgatgtgtccccttcatcccatctcaatttactaccagtgacaatcctggcgatcatgatgcttttatgtcaggtgctgtcaccattctacttaccactagttttgggagacatcgttgttgaactatgagtagtccaatttcataacccagacccaaagctttgctttttagggtactttccatttaaacactctgatatctggctcgtcttaaaagaagagcctgaggtaaggacttgcaagcagttagtatcttggggaagtgacagcaaggaattaaagatgaggatttccaagagtgaaaaattgaaagaaggcaagcgaattcaaggatgagttattgagtttatcacaactgtaacttaaccccactatagatcctctgcagtgtcatttaaaataaagataggaattttccacccaaggtgcagacaggggctattatccccttgctctatttctcattgatcattttttctcactggagtgttaaatctcttctatgtccagatttgtgcatgcatcaaaatgtttgggtggttttgaacaggtatccaattcagagttggcagacatattttggggtagaaacaagcaactcagaggaggcactaacaacttataactacatgcaactggttgctgcagcaatggctagaataaacaagtggatggactaggaaatgggaagtttgagtaacagtgatatctcatggagcacatatctccactcatgcatagagtgtgggacaaatgttttttccttcaggttctttgttaacacaatctccagtgcctgttttgggagtttacaaatgcttacataattttaggtcaaggaaccactctcttcctgctgcctgaaattcttcatttcacgttttcacaaaatctacaaccttcatggttgttgccttttctctagccagtgtacctttttccatttcaacagttacttatgttaaatctttcatgtgcaatgatattgaggagatccagtgattaaccagagatatacctcaccttcacattgctttgaaatcactagagagaaaacattatcagaactttcatactgtcatatttttcttactcttatttctggcaacacattttgtgtccttgagttaaaggatactattccagggcttcaggaatgaaataaaaaacaaagcaaaaaaattgagacatgatttggcttctcagaggtttaatttggtcaaacacagactgaaaactttgggatattaattcaatcagttggagaaaagttaccaggcattgaagataaagtctagactcaaaaattcaggtcctttgggagagcagaagtatagaggtggaccttattctaggtcagggaacaaatgctcttggggaatttttttttaatggcagaaacatatcattttcagagttgacatggggaggagtgtgggaggagggagaggatcaaaaaaaatgactaacaggtactaggcttaatagatgggtgatgaaataatctgtacaacgaatgcccatgacacaaatgtatttatgtagcaaaccttcacatgtacccctgaacttaaaacaaagaaagggaggtttcaactattatcaatggatttaaaaatccaatagtgattgatactttgtgagacagaaatttgaatttgaaataccagctaagctaagttgcagcctcgcctctgcccagcgtccaagttgaaacacatgaaaagacagcatggtgggtgtcagaggcctaagtttttcatgcgtttatggaaagcagctgatttccaaagcagaaacagtgatccatgttgatcctggatcccctctggaacaagaatagggaaaggtaggcaaggatggtgaatatgtgccaaattaaaacaagcaatgaatctacctggaccttatactgaaagggtctgtgaggccattccttggctgagtgcaaaatagttccatggttgattagtggtgagtgacagcggagtgaacatcagcacaagtgacatataattaacatccctgataagggcaacataaatgttatcttggtatgggttccccttaacgcttatcataagagaaagccttatgagaaggtagtttatttatgaatgaaatttcacagagcaggtgtaaggggatgggaaaatgaagaggaaaaaagtgaagccaatacaggagcaaagtgttgatttggccattgttaggtaggctgatcttcaggcacattctggggaacttatgagtctcaacattcccttctcagggaatgaaaggtgaaagcatgcatttttaagcccctggctcattggtcaagagtaacctccaaccattgattcactgaacttttgtgttgtgtgttcatgaggtcaaataagttattgtcagtatcccaggccacaactgcattaagcaagtggtaagaggcccagggcctggggaagaactcgaacaaatctgcacaaagtcttgttgaactggggaccacaactatgactgaaatcagataaagggctgggaagaaaaagtagtgcacaggaggttcttgatacgtatattctggcatcactctttctcttcttattttttgcaacaagcctatgctgactctatgaataaaacttgaccaaatcttaccagtttaagggagtatgcacacaaacagtaacattcacaagcataatattgcttgggatttgcccaagtccggatttcatatttgagtagtaaatcatgccattcaagcttaggacacaactgctaaaaggcaacagtgtcagtgaaataaaatgaacagtgctgcatgctaacaaaatgagggaaatcccttattctctatttttaaaaagatactagcctgacccatatttattattttttctgaaaaaatttgttttcccagaagcttttgaaaagcactccaacagtaatgtagcagaaaaatgatagatgttgagaaattaaagtgctctgggttataaacttgtacgtctttgtttcccatgctcttttgatgagcttgcaaagttttagaactctttaatttaagatgaagtggttttatttctctcagatacagtggaaatagtttccttatctatcattagaatggtttaatactttcattaatccacacatcataaagcataaggggagttttataccgactccaatcagtcattgtgcctgcttcagaatggaaaacggttgttttctgctgattctaagacagacttaaggctagtatcttcatgagccatcacaattagaaaagcaagatgaagacataaaaatgctgttatcatctcctctcccttggcataatttggattattgctataagctgcagaatatttgcaaatatatcagggatccttgaatttgtggcaagacataaatatgggatatcgagaggcaccagggctgcctctggggcgtggaggattggtttcctgataccatctagagaaaacctttgagactgagcatctcatcctcctgttccatggccaagaaggtaggtcaggtttgaaactaggcagctatgtcatggtacaggagtttcagccactgttcctgcacaaactccactgatgttcttatttcactggtctactgaaaataatatattcggaatacctttcctcttctgacatagagcacttggttttctatccaaaatgggctagaaggaggaaacaggcatctataatatatattagtaaaattttcagtcctcagtgatatggattccaatgaaggtaatcaccaattaccttaggtgattatttactctggtgtaattgaaaggagagagtgtgctaagaagaagacgacactgaagagccggcagactagtcagaattcacagcagcaagactctgaatactaaaacacagactgtcctcatgcaattcctagtgcacgaatcccagccttactgcacaattataaatggcgtaccctaggcatcctaataaatggtatgggtcctagcactgaggaacaaaaatggagaacttagaaaaaagcacaaagaataaagggtcaaaggaaagaagaaaatataggtcagggatggcaaacgtacagccctcccctgtcccacacacggcaaaaagcatgtatccttatcccaaactccaaagacactaagtcctaatcctggagaaataaaggctatctagagaagaggaattatataaatgaccaagaaaatgtccttccctccatttgtagaacgttcttggtttaaaagaccatttgtaatcttacatatgtgctgcctcaagtgcttgcatcttcatgctttaataatatcttagttacatatgatgttttaaattttcgaggtattttcacataaattactggcttaattttttacaaccatcctgtaaagtaaggcaggtatgattgattgttctgattcaaagagttaaaataagtgaggctcaaagaagttaagtgacctttcaattttacatttttttagaaactggaggagcgacgatcaaagcacttggcttccctgtatcatctgtattgaagtaattgtccaagattgatttaaagagaaaaaatatgtctgtggctaaaagcaagttggaaatcattaaagtaaacatttttaaaagtgctttccagagaggaacaagagagatacttcccaggtttcctgaagtcttagttgtgacctatttggatttgaaagcagccttaggtaatctaacaattttgtccccagtcagaacattatgtaatagtgtaccacgggtgaaaagaatacttctgttttttcaagacaatagttttattcactgagacctgaattactcttttagctgacatacgtggaatggctacaagtgctattctgcaccaaaaaaatacctggcctcgtcaaaactatgaaacaagttccacacaatcattgcctgcaggtatgcattttgtattgctgaaatacgctaatccatttgtgtatacactgttggcttctagtttcaggaagtaactagggtaaaaatttttgagttactttctgttctcaaatccacaattgactcctgaaattgtgtgctcaatttcttggtagaatgaaataatactacatattttctttacaggaggaaaatgaattcagtagaaaaaaataaatctaatggggatatatcattcagtgaagtcttcctctgatgaagaacttaaggttcccctaacttatcactgtaagaaaagagttatggtaagacacactttttccatgttagtcttgaagcataaccattagtacctatttacagatcatctgttgagtgtatactgtgctaggttgtctgtttttctttatctgccaagatatttggaacaacttgtggtgcagggactctaagtggctcaagtgattcctttcactagaggaatattttgagaaattatattatattttggctttattgatctaatgcaggcaaggttactttgtctccaggtgacaaaataaatttggaatctctacagtattatgaaagaagccctgagcatagattagggagactggaggtaaaaggtggaactaggaaagaagaacggagaggcagacctacagttaggaaggaagctgaaagaaaacgaaaaccactgaatttataatggagaattttaaaatagggtggtagggtattccttggatttacctatccctaaagttatacactaactaaaaattgttggattgttcaccaggcattcaagaactaatgccagatggaggggatgccaggctgtgtgcacacataaacacactttttttttttcaatgagctgcagaatttaatccaaatgttgtaacttgacatgcatggccactcaccatcagccttgtcacctgccatttttccatttttctccctatgttccaaccagaaaaggcctcatgggaaactagctgtccaggacactaatctataaagagcactaaaataaggcttaagttgttattaaaaaaaaaaaaactattttactaacagcagctcatttcagaataattttacattggttccaagtaatattttgctgggctgctttgagtctatgctgaaacatccaaaatgcaagcctgaatttcatcctctggccactataattccatctatgatgagcgtaaccaaggaatgaagtttggctagaggtgaattcagggtagaggcgtacttttcactataagttaaaccaagcagctgcttaacaatccccctccttgacctttatcccaattaacaataagccagaacttttaaaataaatcaatatgcctgtgtgtgtgtgtgtttgtatgtgtgtgtatttatattaatatcaatttattcataattgtctaaagggtcaactggctattaacctgttcatgtccctacctgcatttattgggccctagtccaattacactgaagcccccacccccatctcccccacattccttcaacattctgggtacttcgttgtccttgtccatcctcctccatgagaatagaacacatttaaagttcccaccgctcccacttgggtcatagccaataatatcatttttctactcagtgactctgcataaaacacaccagcttttcctgttggctccatttgcttcttcccctggaatctcattgcacttggttcagatctcagttttatcatttatcaggctaattgcaaagactcttttctgtaataggctttgagttccccatggacaaggggaacatcttatcagtttttgtaaccctggtgcctaacccagaacctagcactggagaggtggtctataagtgtctgttaaattaattcttaaattctctaatttgggtggtagtcctgaatgagtagctaaccaactgtttaaccttggagaagcatctcaatttctgtgatgtgatgcttcagaaaaataataaaactatcaatgtcacacttactttgaaacatttttttttctaaaatcaaagaaacatgctttttagaaggtaagaaagcactctgcaacttctatactgatactgacacacagcaacatagaataagattgatcaacgtcagatcaaggtccaggctggtacggagcacattactgtaaaagttcaaggtttaattataggccctgtcttctgactaaagtaaatatgaagttaataaacaccacaatttgaaatctcagttcttccaaggacatctccaaagggtggcattcattgtcagcaagtgtgtgatgctcaaagggcctagcaattgttctgtgcctgagcatttcttgagacactctggaaagtgggaaataaatcttggtatggacgttgaaattaaggcttaatatggcaaaacctgctaagaggaatataaagagaaatgtcagcaaggaaggtgtttccataccctcttttgaaatgttatataaagtgaattccactcaaaaagtaatagtttcaaccgaaatgtctaggcttatttattattacattctctacttcaattataaaaaagaaatgaatttaaaaatcacacttgtttcacttaaattattataatcattgtccactgatggtgaatatatgttgtttagtttgtcctgaattacagatcaatttattttaaaggtcaaattatggtgtgacaaattactccaaaacttagttgcttaaaatagccactttattatgcttgtggattctgcaagttggaaattttgctattattcagcggggtgcttacgtccttttcataatgtctgggtctcaaagttgtgggtgactcaatggctggaggttaaaatctttgaagggataattcattggtgcatttggcacctggatgaaatgactgaaagattaaaactgctagtcctaaagtgtacatgtgatgagtccatgtggcttggcctctcttcaaagcatgcatgtttcagcgtagttagactttttatgtggcagcttaaggctccaaagacaagtgttccagcaaatcaagtagaagttgcaattggcctaggaaccacgcagtgtctcttctgtttcattgtactgattacatgcaagtcatctgcccatgtagattcaaagaagagtgatcatattggtgaatgtaatgtcaaaaatccataggccaagcacaggggctcaggcctgtaatcccagcactttggaagtccaaggctggaagattacctgaggccaggagtttgagaccagcctgggtaacatagagaagtcctgtctctataaaaaataagaaaaaaaaaaaattagccaggtgtggtgtcatgtacccgtggtccccgccaatcaggagaatgaggtagaaggcttgagctcaggaggctgtgactagagtgagctgtaatttttccactgcactccagcctaggagacagaactcgattctgtctcaagagaaaaaaaaaaatcacaattattaaaaaaaaattaaactgcaaccattcatcttctgagaacaaactttatatctctcccatatctaaaatactctcaactgttttggagacacctaccttccctccacccacactgaatctcattcattttattgccaggttcaaggtccagcatatcaacatttaagttagttcccgtgtgtatgatactccttgtgtgtgctcctctactgtgattcctctagatctgacgaagcatgctctataaaaagcaagtaatttaccccatggataacaacatataatgtcaaaacagacgtagaatatctgctacaaaagctttcattcaaaaattgggcaaaagggaggcagccagcagtcactgggtaaaatcacctgaaattcagctggacacctgtgggtagttttgtgattagggctcactctcacttcttgggtattattctccatgacttttggttctaccttctaagtcatctttcataagaaatagtctgtagttgtaacagagtgcagtcgtcaccccttcctccacatatccattttctgtgatttccattactcccgatcaactgtagtctgaaaatactaaatggaaaattccagaaagaaacaattcataaatcttaaactgcatgacctccttagtagcataatgaaatctcatgccatcctgcttcattcttccctatccctcctgggtgtgaatcatccctttgtccagcctgtgcatgctatctacactacctgactgttattctcttagtagacatctcagctgtcttattggcaagtaacccttattttacttaataataattccaaagcactagagaagtgatactggcaatttggatatgccaaagagaagctgtaaagtacttcctttaagtaaaacaatgaaagttcttgacttaataaggaaaagcaaaaagttgtatgctgaggttgccaaggactacagtaagaatgaaacttctatccataaaattgtgaagaaggaaagaaatgtgttctaatttagctgtttcacctcaaaccgcaaaagttacagctagagtgtgtaatatatgcttggttaagatggaaaaggcattaaatttgtgggtggaagacatgaactgaaatgtgttccaatagacagcaaccgggatcagtactacacatggtttcaggcatccactggggggtcttggaaagaattccacatctataaaggaggactactgtggccagctcatctgatttctgcccacggaaagttgggaactcaaaagcctctcttcattttgtatagtgttcctgtttgtcaaaactgggacttaaaagaaaaaacaactataatattacaatacaatttttggtattgtaatacaaaccattacaatacaatttttaaatgattacgaatttcctgtttatcattttataatccactcaattaagccaaagccaaacctacaactctcttagaaataatcccttcttgaccttaaacaccctatgagttttctgtggaaaaatgctcttaaggttcttagaagccctattgtttaacagaggactcttagaaacacgcctgagaatctttgggtgccttttatgtgcctgaagtgtctataaagcactgacttagctctgaggtctcaacaaaggatcttacaattgaggtctgtacttgatctttgccctgaggctgcttattacttcgagaaccttctactgattgaacagacttttctgagcatttaacatttcttccagtttccgttagacagacaaccgattggttcattctttagctcataactctcctcttctaactttactatacgcagcttgaagaaggcaggtggcaccttcaacactttctttaactagattatcaagttcattcaatatattttctattttatgagaggtgacagttttgctgaactttcagccactacatatcaagattcttctttcttctaacttcaagtaagagtttgctcgttatcctttcagacttcacctacagtcttcttgagtctcttccagctttcacctgccatcttgtctcaatgccagtgtcacaatttaaatcctttttttattgcataatgaaaatttccaatcccccttgcatgtgatttaagctgggaaaataagatccttgttcaggccaagactatttcttaaacctttgcaaaacagagtcttcacttttggagggctaacctatgtagagaattttaggcctagaattagtggagaccattttgccaccacttttttaacagagcgcagacttggctccttgacacttgcaaagccaataaaaagtgcagtgaaaggaaggtgactttacttccagagttagcagtgggcaagcagccagcttatgcttccagaaaccccttcaaactttaggttgggaagaggagtttttaaaaaaggaacttggaatggaaggcatgcaggagggatgttgagtataagttctgtgtatcttgttctcgtggctatctcaagccacggtccccctggagtgcaggctggtatcatctcagcaatggctgggttgtagactggctaccctgaggtaatctctggaattttgcaaatgaggtaatctctagaattttgcaaacgtgcatgagataaaggagtacacagtgggaaaggaagggaggggagttttaaagtatctttcaaggctatattttaagactaaggaaaaaggtttctactgtttgttttaatgttacatcttgagagagaagaaaggagacaagaaaaaatgttttaaaatatattttgaagctaaattactaagttacacattttgacttcagtaattaaattaatatggagaaaagaaagctgaaagatggaaagagagagatattactgatgaacttgtttctagctttgcctaatgtcagaaaagccatctggacttttcaatgtcatgagacaataaatctccttttttgtttaaataatttttacttaagttttttcataatatatctctgaaaatacatattcaaccctccaccaacagctctgctcattctgccccatctacatggaaggaagcctccttcctctctgcataggttagtaccacctgtcactcaacctttggtcaaggcccacctctgctgagaaatctctctcagcccagcagatagtaatgacctttttctctgactactcactgcactagagatctaggactcaggtgctttaagctgtatcacatggcattccaagttgtccttttatagtttgtccttcggagataaaactaaacttggttaaaagtcccaattgcactgcccttgaaagtctatagcctctgcaatgacctctaccaagttaggagatctactttctcttggccccccagcctccatgtttgacactacacatgacttttatgtttatttccactttggatttggacatttaaattcctgaactactttttcataaatatttcactgatgtcaagcattgatgggttctgcaactgaacatttgtgtatcattgggagagagtgcaatccataatgcagttttccaccatcttattcatttccccactacttttttagcttcctccaactcctgtattctcagtctccacccccacattctaagagcaaaataaatccttcttattttaccatacagattggtttggtggatataattttttacttagtaatatactatcccaaggggtttgtccaagtatttcttttaaaaatgtatagtaaaacctaagagaaacctcagtaaatacaatgatctccacctcactacaacttacacatacgttggttttctaactaggctttggtaactgtggcataatttacaaaggagaacagctttaagtttagataggtttgagtgggaatcctgactccactgctttcttgaaagtcacttaccctctaaggacattaattctttcatgtattaaattgagatcatgatagttacttcaaagatgaaccaaggtgtataatgtgccctgggaagctccatagatgttcgacgtccagctctgccttctgcgttcagcacttgtcacgttgcctggcatgagcaaggtgctcagtagacaactgatgatgtaaccatggcagtgccctgagattgcagcatagtactatactccagatgcaactgggctttacacactgtggttctgactggcttttgaagaaagtccactccttttagccactgggagcctccttcctggcatgggttatacctatatatttttttcagtgtactaaatttccagcctttgctcaaaattgtgattcagaaatgtgaataaaacatcaaaaacaaaacaaaacaaaacaaaacaatagattttgtgggaaaaaacttaaaaaagtaaagaaaagccactttcttctgggaaaaccataggttctgttgacaaatgtgtgtgtgtttgtgcgtgtgtgtttgtgtgtgtattagtctgtttgggtcaccataacaaataaataaataaactgggtggcttataaaccaaagacattatttctcacagttctggaggatggaaataactcaaagcaatggcagattgagtgactggtaagggcccacctcctggctcatagatagctggacttcttctcacagtgtcctcatatggctaaaggggtgagggaggtctctggggtctctttaagagggatcctagtcccacagggctctattgtcgtgacctaatcaccttccaaatgccctgcctccactccacacacccttacattagagattacatttcaaccaccgaatttaaggggaacacaaatattcaggctttagcaacacacacacacacacacacacacacacacacacacacacatttatatggacacattgaagaatcaccacctagagtaatgcctagtaaaattcctaatgatgcaaaacaaaaatcttacaatgaatgcttgtaagagagacaccccatccttattgtctgctacatctttggatgaatcacatttaagcttgctccaaaaatttgaacgttctttttaaaggtcattatatttagctaatgaagatggcaacattgactgtcagaggcatggctggtagtctccaggagtataataccactgcatgtgtggaactaatgatatctccatttttggttcaagatattgcaaagaataatttagttttgcttcaattaaaaagaacagtctcgaaagctgtagaacccatgccccatatgagatctggtaatactaaaggaaaggaaaaccctttaatcggcatcaactcttctttgataaaaataacagaatcaattaaaatgtatgccaacctctccttgaaatgctaaaacccaaatagaaagtcttattgtagtttatcaagataaggaattcaaacatactacaaaacaatgaaaatgtaactcagagagagagagaaaaacactaaatcacaccaaaagcatcaaactgcgaatgtgtttcctttcatgattgtcaatcagtaatcatctctttcgaaagcaaggcacaatagataattaaaaaagagaatggacacaatatctgcctctgagctatcaacatctcactgataaaacaagacttaggggtcatttaccgtggctgctattcctgtgactatttttgcctgcactaagtttttgtgaacttcaatggcgagttttggcttcctttatttatgcatttattctttttgtctgtaaatattcaactgagtgaggtacttaagagtcctgagcctaagccatctgaaaatattttgtattatctgaaatcattttgctgtcattttttcctcttattcacctattcatttattatcaaaatagctactaaattgcccattatgtctacagttctatagtattagacatataacattgatagacacacatatttgccctcaaatgcattctagtctagaaatagaaagataattaaataggcaatttccctatagtgaattaaatgttttgaggggttaagaatgagatttttcagggtaacccttcctggtcagaaatgtcattgtggtagctttgtgtcaccttggatatgtgtaaggtgtcaactatggttcccagagatccttttccagttatggggagctacaaaagacattactgtgtgagatttggagaataggaggggagcagtagtcactgagcagcttctgcacattgtgagggacctgctgatatacctcattggtgagagacagctgctagatctgcaactgctccaccttttctggatcctcttgtaacttttctgacctctgggccagatgtgcatgttttgctccacagcaaaggggcccagcttctgcaggatacctacacccctaagatcagaagcaacaagaactgacacatgtttttttactttattctcctggggctccaaattgtgcctgtgggttccaatttattcttattctcccccaccccctcgacatgtataatctcttctcaacttcctgactcatggacttcaaattctagcatcacaatgcaaaggccatattcttatagaaattgctttaccagtttccacaattgagtgtggtccaatgtctattaaaggcaactttatacacacacacacacacacacacacatatatatttcttattggttctgcttctctgattgcgtgcttactgatgcagtcatttagttaacaaagatttgcagatgcaggtccccatggggatctgcaggaggatcttaataagattacctgtcttctctcaagagtgttgtattgtaaaactaaataaggatctatctatctatccaccttctaattatctatccatctatatgtcatctaaaacagtaccttagcacatagtgagtgtcacgtaatataattacttatctctggctctctttaggcctaatctgggttcaagactcattctaggtcagcggccatgagtaaccagcccctttctaggattatttttccatcgccttttctagagtatcttgaacatttttctcaagagacatgatagagagaagggcctgatctttctgtaagaaatatcccgatggaagatttctcccctgtggaatgctgatctcatctctgctcagcatactgttgaaggaatcaataggttttgttcttaagatgatatatgttcagaaatctgacacttcatttttgtcactcatataccagaaataaccccctccctcttgcctggcagattccccagtctttcaaaatgaaggctttgaaagtgaggatttgccatgaatatgaaaattataaagttggcattttatctcagcagatcatttatcctacaaagtactgtgtgtaaattagaatttcttttcttctccatctcacacccccacttttttatacttaattaaatttatctttgtctgacttaaccttcagaagtttgggtctccatgctcttcatcaagtgccttcctgaaagcttctgttttgggcaaactatgttacatggattcttctagtaatgtgcctggaaatggaagctgagcaatttgcaatcacctcatgtgttccagtactaaaaaagcctctatataattgcaatgcaattgaatatgtttaaaaaactaatacaagtagaatggttaaagacctcaactaagaacattttggatgaatttataaaatacgcctttactttagaaattaatgcactttgtttagctcatgagaagatgaattttcttaagctatgattaagaatacatttaaattaaaatgcactcataagatagaacatgagaacttaaaagtctcatccaacttaaaacattcaatggaagtaatttcttttgtctacttaaacatagtttatggcatctatattgtgctagagggacaataacaaagtttgtaactcaatgagaacaccaaaattgatttaagttttttttttcttcagagcatatctttatttcaatcaccatgagaaagtaaaggcttaaaattctaatttaatttttaaataacattcaaaaagttgtcttcttctctaagaaaacttcctagtgatttataatagtgtaacatattttttcttcggaaagctgaagtaacttgtgcagtttatcttggagttgtaatggtggaggaagatttcaagtgaaagctaatgaaaaagattaaattatctaggaagctaaagttgtagtctattataattattatcaacatagtgtgctatttaagacacctgaaatcttttgattaattagcatagcttaggaaaagctaataactttacagctcttcacgcctattgccatgtgtataatttgatgttaaactataaaatattgacaaccggattccaaaaataatagagaaatgagaattagaattgtcagagttcttcctagagcctatagctcttgagtccaactctggtgactatggatttgaatgggcataagggaaaagggaagggggcttgaaaaaatatataaagcttgaactgagcatggtatgtggtggaagggggtgaggtatgagtttagaaaccatcatgacctggccacaatagacactggaaactactagagggaggagggaaggagtaggtaaggattgaaaaactgttagatactatgctcagtacctgaatgacaggatcatttctaccttaagcctcagcattatgcaatataatcaggtaacaaacctgcacatgtaccctctgaatctaaaataaacgttgaaaaagaaaaaaaaaaggaaagaatccattgtgactacacaaaacagcatctctgaagcctcaaagaatctagaattactgtgaataaatagatattttttttccaatgaacttaatgagaataagtgcctttaccataccttgcaatttctgaaaactaaatgacactaattttcagactgaaatagtttgctattagctcagcacaataaatgaaaatagatccaaagctaggggcatatctgtggaatttcagaattccaaatacaaagagaattccctaaaaggttccacagtggctaaaaatgtatggcgttcagaatgtcatcagacatctcaacagaagcctcaggtgccaaagacagcaaaaccgtaacttcaatagcattatgaggaaaaatcataaatatattatttagaagtgccaagtaaatatatctaaatcattaaataggagtttctcccagggagcagatttggagatcataaaatattagagcagaaatttctgtgttttgttcatttttatatttgattttatttatttatttatttttgagacagggtcttactctgtttcccaggttgaagtgcaatggcctgatcatggctcactgcagccttgacctccagagctcaagtgattcttcaatcctcagcctcctgattagctaggactacaggtgtgtgccaccacacctggctaatttttcatgttttttgtagagatgggattttgccaagttgcctaggctggtctaggactcctgagctcaagcaatatgcccatcttggcctcccaaagtgttgggattgcaggtgtgagccgctatgcctggcctatatttgagtgttaactttaaaattaaaaaacatttaaaaacataaattgaaaatggggaacgttaagagttctatgatcagtgagagcttccaaaaaggtatgaatgatcctctgctctgaactagatcaaatgatctcccaaagcctaaaaatattataatataaagaacagttaaggtttgctaaaaattatcacaaaatgacttgatttgttgtcccatccaaacaaatgtgccaatgggaggaattctttttaccaaattggaatgctttagttggcgccagccaggtcgataggaagatattcagcaaaattagtacaaaaatatatccttattcaaactaagatttttagaatgtcttcactgaactttctactgtatttggagttctttcccaggtattcttatgcttgcgctgtgtactagaggctcagaacacgtccaatccaaacctccttggtaatcacggttcctcagaccctcctgaggcaaaactggcctttcttgggtttacttttctggatatttcaatcacttttgtgccattgtccctgctggatgaatctttggtccactgtaggaactgagacttaataaataatattagatacatttaaattgttcattatggaaaggaacacattttattagtagataactacttgtaaataacctagaaagttggattgacagtaaactcaaatatgagttttcagtgtaatatggtcttcaaaactgttgatgggatctttttttaattttttttttttatttttgagacagagtcttgctctgtcacccaggctagagtgcagtggcacaatctctggtcactgcagcctctgcctcccatgttcaagcaattctcctgcctcagccccctgagaagctgggactacaggtacccaccactacaccaggctaatttttgtatttttagtagagacggggtttcaccatgttggtcaggctggtctcgaactcctgacctcgtgatctgcctacctaggcctcccaaagtgctgggattacaggcgtgagccactgcacccagctgatgggatcttaccaaatagttatagcattttctgtcctctttcttgttgctattcatattacagctaaagttcgaactttagaggcaaccatttagtagactgagatatacagtagtagacttagagtagagagactggcatgtctccactccacccagaggagggacactgcagggcgtgaaggctgccttacctggagatgaagctttggtggaacatgaagactgggttttaatacctgaaaaagctgcccttcagggaaagaatgagaccaatcttgctgctgttgttgttgttattttgttgtgtaaagaagtagaactagcacaagttgatagagtttcctcataaagaagagatactctctgatttaaaatgtttgcataagaagattgtgatctctctatccctggagatccttaaacagaaccaatattttccaagatcaagactggttctgagtgttttataattttgtagaattactcaaatgtgagaacagacaaacaagtattagaaggtgaaatgaggtcaattataagaacctttgaattgtattactcacccttgtacactctctaccacaaatatcaactcctcagcagaatatcttatactgagtcaaattgggtacttgccttactgagaagtgtccatggacagtgaactatctctaggacagaggtggcaaatacatgccctctacgcttcctttcacccgtcattaaagactcagaattctcttctgttgtcagggtgcaacctcagaatcctcctgaaaacaataccccgtcactgtaaattggagtggcatgccagatgcaacctgcttgccatctctgctccgggatacatttgacctcttgccacatgtcccatcagcacatcagcaactgtattcatctacccgaaattctcttttttatcttcaccacgttgatacttatcttgtacttagtaattcatgccttggtgctgactatttcatttcatttgtttgtttctttgctttttaatagagccaccacataaaattattttttaaatgggctactgtatacaattttttttttttttttttttttgcgagagtctctctccgttgcaccagactggagtgcagtggtgctatcttggctgactgcaacctccgcctcccagattcaagcgattctcctgcctcagcctcccaagtagctgggattacaggcctgtgccaccacacctggctgatttttgcatttttagtagagatggggattcaccatgttggccaggctggtcttgaactcctggctgcaagtgatccacctacctcggcctcccaaagggctaggatacaattatttagattgtgtactgaacaactctaatggagtctcatttacattaaaaatgaatataggcatatagatagacataagtctatctataagaataaggtgaaatgagatcaataataagaacctttgaattgtattactcaccctagtgcactgtctaccacaaatatcaactcctcagcagaatatcttatactgagtcaaattgggtacatgccttactgagaagtgtccatggatggtgaatacttctttattaatgtataaaaattaagttttgtattaataaaatatattaatattaatattttaataaaaattttacaccatggaatactatgcagccataaaaaatgatgagttcatgtcctttgtagggacatggatgaaattggaaaccatcattctcagtaaactatcgcaagaacaaaaaaccaaacaccgcatattctcactcataggtgggaattgaacaatgagatcacatggacacaggaaggggaatatcacactctggggactgtggtggggagggggagggggggagggatagcactgggagatatacctaatgctagatgatgagttagtgggtgcagcgcaccagcatggcacatgtatacatatgtaactaacctgcacaatgtgcacatgtacgctaaaacttaaagtataattaaaaaaaaaaaaaaaccagaaagagaaaaaaaaaaattttatatatagtaatgttcaacaaatgatagagaattttcttatttgcataaaagctagtgatgagattccattagcttgtaaacaattagaatataaattgaactaaatacatatttgaaacacagagcagtaatgaattttcaccactatcccatccaattttcacatatcacagatgagaagcttcaagcccaacaacggtgaggtgacttactgagaatcttacatagagcttaggtagaaataaaatagaaatcttcttggaaacagtcctattctcttttacatagttttcctctaatgggtttgggggtctggtccagaatacacaaagctgtctagacacaggtagcaaagccgtgataatggaataaatggcatgggattgacattgcataataacaggccagccctgagggaggtcacaaagcagcactgtttctgaaactgctatttactttttgatgtcctttcacacacacaaaaaaaaaagacagaaagaaagaagagttcaagttagttgtaggggagaggaggaaagtaattttctgtggagagaaacaaagctgtgactgagaaaggaggttctacaagacatttgtgggtgttgtggattacgaccagggtaggatttaagaccatctatcatccaaaagcactttcaaatgtatcggggtagggggaagcaaaagagcccaagaagagattagtcactatagagacatcatgggttatcattgagacttgatgaggtttatattaaataatattgttaaaggcttgatgtgacatcaagtaatgatgtaatatagtaattataaagtgattataattaaatttctgcaatgagctttataggcaaaaagaagatgaaggaaataagatgcaaatttcagcagtgaaaatgttgtctatggaataattaatcaaaaagatttaaaatgatggacatcaaagaaaatctctgcactgctacctttcattacaggaagaaagaagagcttctaacatacagctataaagcaagtgcttccaccctcagcacagataattatttataaaaaataataaacacagttaaaatcacacctgtccctatcacagcattatgtaacactctagaatcctgagcttcctgttgacatagtttgagttattcttattaatttccctaatttattgaacattactctgtgttctttatacacatcagcttatcaaactcagtcctcgcaagaactctgtagggtagttgttatttctaccaatttgaagatgaggaaactgagtctcacggaggtgcagtgattgcccagagtttcacaggagaaagtggtggagtcaggatttgaaccttggtcacctggaggccaaacactttggtttttctaccatctcctgctgcctcttattaggccacttgattctctgcaaagcatcagtactcctgcttcttagattctagattcttcctctgggatcctcaaacatgtccaccttgcacacatggcctctgagctggagccttgcaaaatgagcaaaatataatactgggtgagaatgaaaggcagaatgactgaggattaaagaatctgcagaaccagctgactgactttgcctgtatgttgattatttcgattcacctcttttgctatccataggcataaattgcacaaacctgtacagctgactgattctggtcctagcccttaacttctgatgatgtcctttaaaaaaaaaaaagccagtttcactacagttgcatctgctcatcctttaagctctttaaatgaactccatgtttattccttggctcttaacatggaaaaaaaaattttcatttttttccatgttattaatgctgtttttaaagagtcacccgtgcttttcctttatgtctttgacatgaggaaagtctgtaacattagaggacaaagccaataaaagaaaccctgccgttgttactttcttagcaccctcagatgcctgttgatattcacattcagataggagagaacaggaggaagccacttttaatcgaagcccacatgcacaagcacacatgcagaacaaaaaagctggaggtggggaaagacaccatattgggacgtgtcagggactggattcatccttgaaactgcaccaagtggagagcttgggtggtagctacagctgtcttatatcttaaatgttgagatagagccatgtcaagcaaatgattaaataaataaaggacagttgcttttcttgagtgatactgatcttagagtcagcctcaggtcaatagctatttttcttcccagagcaggacacttagagacaccaaataaaaaaaaatagagagaaaaacagacatcagatagtctattagtgaaatatataaaacccaggacatttcaaagagtaagttgtaataacatttccaaaattgattgaatcaacctttagatccagagaaatgaagtaaacaaatttgaaagcaagtgagaaaatgacataaccaaggtctttagaatttctttacttggcaggtgtcatagtgaatgtttgcagatgctttgacaactggatacaattctcagaagatttagatttcttaattaaaaaaattatctcaacttgttaggaagaaaacactgccttaattaatattaaggggagaaaattcccaatttctacagaatttccaagagcttttagtgataactcttattaacattcaggtaaattgtagagatacacatacatttccatcactgctgacactgtatgttggtgaaactatctccattttttcatccatttcccccttacctcttcttattgtagagtctgtagaaggtaaaatatccaatttctaagctcttttgtacttagaaataggccataagacacagtgctggccaaaagcataaacatagacagttgctgtttccacatctgtcccattatctcccttcctgccagaatacagactggaggactggagcacagaagcctttgtcaaatggtgaggtgacagtcgtgtagaaacatgtaccaagggaggcaggaggaaagagatcaggggcctgcatagcacatgttatcacatggaagttgcacagctcgggattccctagatctggattccattaatgtgaggaaatatgagttatggactaatatggaatgtatgctaacatggacatgcactcacatggatgtgcacacatgtgctggcatggggtatgctgtatgtgggacaggtactaacctggggcatgcactaatatggggcatgcattacatgggatatgccctagcagggggtgggcgttaacatgtgttgtatgctaacacggtacatgtgcttatattgggtgtttgtcaaaatgggatatacactggcatggcacatgtgcaaatatggagtgtgtgtgaacacaggagattggctaaaatgggatgtgcgttaacaagaacatgcaatgatatgggacatgctctaacatgggatacacactaacctaagctgtgcattaacttgggatatgcctactatgtgctaggcaccattctcggtactgtttatatctactgtcctgtttacttctacaattgtctctttcaaatctcatataatttacctcacttccaaccagctttatgatatcattgaatagtacttaaataataaaaagaggagattatatttttccgggtgtttgagttttaaaaatctttcagtggagcatggcatgatatgtttcttgctttaatcatctttattctaaaaataaaatgggaaataagacccacgtatactaccaagtgtgtatctaaaattatttcttacatttattaagtaagtaatatgcattaatatggggtgtgcattaacttgggagatggctaatgcggtatctgtacgattgtggacacgtgctaacttgagatgttaactggctaaaacggaatgccagttaacttgggatgagctgacctgggtcatgaactgatatcaggcgggtgctaacatgagaagtgtgctcatgtgcatacatgctaatatgggttctgtgttcaacctgccttaagtatgcctgagagaaaaatccagaaaaaaaaatcaaaactcctgattactgaaggagattccacgtgactaaaataaccttctgagaacagaaaaataaatattcaggaacaaggggcactataattttcctcatacaacaagaaagcatgagagaatgctaagggagttctgagaaggctgcagactctgtcagtggatgagcttcagttgtgtggagcagaggtgagagagcttttcttttgttaaacctcgtaaatgagcgcatttttcattccactcttattaggtaggtcagcagcctctggagtacggagtcgccatatagctccaattcctagcacacacagtgccttgcataaaatcagcacttcatctgttgttaactttgatgcaaatggcatagattcgttagattattttgactcatccagaaagatacatgagaatagtttaaacaggcaaaagttaactaagtatttgttacatacgtcatataaaaataatcaataatgagaaatatatcttttatttggactacaataagcctaatgaaaatataatgtgtgtgagtaaacataattttattcttcaaccaggctgctgactagagaagtctggcttttacatctcctctccttttcggcctcagatattaacaattttgtaaaagggaactagattaataatttaacaaagatgagctgaatattttcttctattattttgccagataagcaaccatgctgtcttactttaaaatcaatcttaactacattttctattatgtactttctgttgttctaaacaagactaatttattttatgcaagtcactgagcaactaccactaaaataaaattgaatctgaacctctcttaagaaaccgctttttgttctaaatttttaaaaaatcaagtcttgtgaaattccatttaaaattatttttcactcgaagagatttaggctcttataaaaaccattcatttctgaaacattgaagagagatttttttctaaaataattttgtaatgttaaaaaatctactaagcattttgaaaataggaaagtgcttctctgacctcatgaatatcctctctataaaacaggcaataattaatattttgaagaatttcctaatgattatttgttcaaaatcttacctaaaatgaaacaagctactgggaatatttttaatattatttataaaaattagcatgttagtatatgattcaaatgctggatttttttctcctgtatgttcttcagagtgaatgatattttcagatgttataacttaaataaaatttcaagacattgacatttggtcaatgaccaataaaattttatactatagtaaatgttcatatactctcaaatagtttaatacacagccattgccatttatttaataatctatcaaatatttagttagcacctactttgtgctaggcatcattctcagtactgtttatatctactgtcctgtttacttctacaatcgtccctttcaaatcttgtataatttgcctcacttccaactagctttatgatataattgaataattcttaaataatataaagaggatattatatttttctgaatgtttgagttttgaaaatcctttagttgagcatggcatgatatgtttcctggtttaaccatatttattctaaaaataaaatgggaactaagacccatgtatactacaaagtatatatctaaaattatttcttacttttttaagtaaacaagtattttaaagaaaataaaataggatcatgctctggtcctatctgtactggatttattcagttagtgtctaatacattttcacaggaagaggtacaggaagttcatcatgactttgtcttcacactttcaatttggagcccacaattatgtctcataatttttctttgtaacattcaccaaaacctttgaggatgtggtggtagaagctttcagacccactggctttggccctcattagtttctcctatagaatgtatttttcttttctcccttcaatgcagttagtgtcaacactacagcaaccttccttatgctgcgtgtgtgtgtgtgtgtgtgtgtgtgtgtgtgtgtatgtgtgtgtgtgtgtgtgtgtgttgagttatagggaagattaagagcacagttatggaataacaaaataagccactgtctgaatcctgattcaattccttcctggatataatttataaatttcctgggcctgatttttcaagagttcaagcattgcacccaagagcttttaataaatggcagatgtgtttattcttgagtgttaaactatctgtaatctcacttttgtagctggttgattgagtgtgggtgggacagatggggtggttcccataaatacagtatagatataataaatactagttgaactgaatgacttcactcaatattctgtgtaaagaaccctcagcacactcagtatcagaaagaagctcactctttacccaattgctgataaatgtataaaatatgcgcccatccaacattgacacttcacttttcataatttttcctgggaaagacactccaaccatttgaataattgccaaatgatttctacatctggacctaattttccatagttcactaatgatagcagaagaatcatgtcagttaaaaaaagttaatatttataacagctagttcagcaaaattgggaaaattgtttggacaccttatttaaaaaaaaaaactgtggaaggacatttactttcattccatgcctttataaacttgctcttcttaacatcttaaaaaaaaatattgccaagttccaacttggccttaagattgaatcaaattagtctgtcataattaattaagagagaagacattttgaaatacactgtttgtttttcagcctcagtctgacatgtcgatgaaagcaattagcaataagttctgctaccaagaaagcagcctagcccaggggacacaatgcatttgtggacagcaattcagtaatgaatgttactctaatttccatttaactatgctatgttctcagaaataaaatatacttttaaattttatttcaataattaaactccttttctctctctgtaattttagtatgaaagtaataatctagagcaatatattcaacttggtgagccagagctgatgagtagatcccagtagatcacagaggtcagctagtgtgagacaaacaccacctccaacaaattaagcaaattaattttttctctactgaacaaaatattaactagtgataactaaaatgccatttttaaattcccccaattctctcaagtagtactgaagctgcttacgagatctgaggaacatacttgtttatcacaggaaactaggaaaggtaattgccatcttttagctaattacaatactttttgaaagcaatgacttgaggccaggcaggtaactaaagcaatacaaaggccataattaagatatgtgactattattgcttagttatgttctctagatctttgagtgcttcagatgaaagacaggaagaagtaagtgtgcttcccgatttatctgcatttacattcacctcagcccatccaatggacgaaggacaggctttataactcagatgccttgggtattactagccttggttttaaacattatttgtaataaagtatgtttacatcccttagccctaagacatagtgtttcctgtttgacctcaccaagtgctcaaattttccttaattttaggtttaccttaaccaaaattgtgatttttttttttttacagttgcaaagtaaataaattttggcttatgcttcaaaatataaatagttattccatgtacttttcacagttaaattttatttattgtatctaaaatttcccccaactgttagaaattagggagaatgtatcacctcacttctagtgtggttgtgaactaaaacatggtgcaagaggcagagggtgaaaattctcaccaagtatacattggacttgaatcagaaagatgttagctgtatttagcagaatacctcaattaaaacaacttagaatatgcttgtttcttttgtcactaagcaagatatagagggtcccagggtctattcattaaacataacaatgacaccatcaatgatccaagtgcttccatcattctccttagctgtgtccagcttgctggcctcaatactcaggtctatgctctctagatcacaagctggctgccactaccacagataacatgctcaccgatgtccacatccaaagacaggaagaagagtatgttcgctacatctcttttgtaagtcccctgcttatctctcccatcttacctccctccacacttgatttctcttggtgcacattcttttgcctctttgaggtcccattggtctgttaggtcccagctaatcccaaagtaggctgtaaattaagtactttatttgaaattttcagcctttgtaagtaataatgggagcacacagagagacaaaaggtaataaaccacattagtacaagtgatacaatctctgagtcttaaacatacaaactccagcagtatatacagaggatcctgtccttatgttgaagtgggaggagtgggaagaaaagagaaaaatttgaaatgggaaagacagggaaggacccttaaacaggcttttctcatatctaaaatttatcaggggatatgagtcagagaaaattaatcaatgtccaaacctaagaattttatttgtttgagaaatcatataagatgtccttcactgaacgatgcttcacaatgcagttcagaaactgcatggttacttggcagacaagtgtctcaggaacccgcatgcttatattgtgggtgtcacacataggacatccaaaaagaggctttgagttttggcatttaaatggtcagaatatgggaaggaaaattgtagccttcagaaacagatgtgacttttgaaagattgccacttatttccttcaaattcagaagttttgttttcaaaaatttatggtttcatcccaattactgcatatctatctttaaaatgtttttgcttacactaagatttgggaggcatcttagaatttgagagctgttcttttctggggattactcgtagttatttttacataagaattcacagaatcatagaatatcagttagaagagaaagtagaatttaaacccaacacctccatttcccagaagaggacatgtaagcccagagaaatgcagtgacttgctgtatgttatctgaggatcattcactatgatcaggtggaagtcatcccaggaatgcaaagatggctcaacatacacacatacataaatatgatacaccacatcaacagaaagaaagatgaaaaacatgattattgcaatagatgcagaaaaagcatttgacaaaatgcaatatcccctcctgataaaaattcactacaaattaagagtagaatgcatgtacttcaacacaataaagtctgtatacgaaaaaaccacagctcacgttatacttaatgtgaaaaagctgagcgtttttcctctaagatcaggagcaagacaaggatgctcactttcaccatgtctagtacacataatactggaagccctagccagaacaattaagcaagataaagaaataaaaaccctccaaattgaacaggaaaaacataaattgtccctgtttgtagatgacagggtggatagatgtctccgtcttatatagagaaaaccctaaatattccactaaaaactggtagaactaagaaattcagccaatttgcaagattcaaaatcaacatacaaaaaatcagtatatctgtacattaatattaaattatctgaaaaacattaagaaatcaattcttaattgctaacacctaggaataaacttaagcaaagaggtgaaatatctctaagctgaaaaccactgatgaaaaacattgatgaaagaagttagagagaacataaataaatgaaaagacagcccattagaaaacatgttcatggattaaaaaatttaattttgttaaagtggccatactaccaaaagctatctacagatttagtacaattcttatcaaaataccaatgacattcttcaaagaaatagaaaaaaagattctaaaattatatggaaccacaacagactcctaatagccaaaacaatgctgagcaaaaagaaaaaatctggaggcattacactaccaaatttcaaatgtactactgaaacagcatggtactaacacaaaaacagaggaatagacaaatggagcagtacagagagcaccagtgcaaaattcatacctttacaactaactgattttgcatgaaggagccaaaagcatacattggggaaaagatgttccttcaataaattgtgcttggaaaattggatatccagtgtgcagaagaatgagtctagatccctatctctcatgatatacaaaaatcaactcaaaataaattgaagactcaaatgtaaaaccctaaatcacaagagtactacaagagaacaagggaatgtgtcatgacattgggctgaacaagcatttttaaaataagacctcaaaaatgcaggcatcaaaagcaaaaatagacaaaagggattacatcaaactacaaaatatttgcataacaaaggaaaccattaatataatgaagagacaacctacagaacaggagaatttagttgtaagcatctgacaaagggttagcattcagaacatataaggagcttaaacaactcagccaaaaaaaaaaccccaaaaaactaaaaaacaaataaccacattaaaaaatgtccagaagacctgaatagacatttctcaaaagaagacatacaaatagccaatagttataggaaaaaatgctccacatcactaactatcaaagaaatgtacatcaaaatcacattgagatatgacctcattacagataaaacggctattaccaaaaagagaaagaaaacaattgttggcaaggatgtggagaaaaagagaatacttgcaaactgttgaatgtaaattagtacagccattacgaatacaagtatgagagtttctccaaaaattaaaaatagaattgccatatgatacagctaacccttcctttggtatatatccaaaggaagtaaaatcagtgtgtgaaagagatatctgcattcctatgtttattgcagcattacttacaatagccaaggtatggaatcaacctaagtgtctaacaatgaatgaatagattaaaaaatatggtatgtatacacaatagaatacgagtcagtcataaaaattatgaaatcctgtcatttgcaacaacatgcatggacccggaggacatcacgttaagcgaaatcaccagatacagatagaaaaatatcacatgatctcactcatgtgtagaacctgccaaaaacaaagagtttatataacagaatctgagagtagaatagtagttaccagagactgagagggtatggaaaaggggagaatggggacagattggccaaataggtacacagttacaattgtatagaagtaagtttttgtgctctgttgtacagtagaatcactatagttaacagtaagatatttatattacaaaatagctagaagtgaggcttttgaatgttctcaccgcaaagaaggataaatgcatgaaggtgatggatatgctaactctcctgatttgttcatgtgattatataacatatatatgtaccaaaacaccaaattgtatcttataaatgtgtagaattccaatgagtcagttaaaaatatttttttaaagtttaaaaagaaaagaaagctggctccttccgtcattagttttacagttaaattcatgccacaaggaaataaacactggattggaagatgcagcacctgttctcagggtgaatatattccatctgaagatatacaattacacatgaaacagtttaatcatgagtcacataagatgctcagcacagtaattcagagaaggattattggcaaaagaggtgaggcatctgcttctgggaggtttctgtgagaagagaacataagaaatacaaaatataagggtattctatctggaaatcataggcattttgaagatttatttttgtctgcaataaacttttgatttattattatttccacaggtaaagtatataacaaataatttaatggattcacatatacctacctcccagatacagaaataggacattactaatagattttaagccatctataagctttctccaaatttcatgtgattatttttaatatatagttctaaccgtctaatatactggaagttaattggagataagtgtcatcaaaggcaagatttcacaattgcttttcatatgtgaatgaccaatcactcatgaagcatgttgtagtacagcaaaggaaccacacatgagcaaaaattatgacttttgtctgattttcagtacaatgctaaagttccagttaaacagtggtttcttagcttaataataggcaatgtaagtgcacttttcccagataaaaaaaaattcctcagaagatttcacctgtgaataaatgggatggcttattcagagggaccaatgataattgggtggtaagaatttaaactcagtcctcctggctccagatacagggctgtttctttatccatcaccatctatttcaaagatatttcaaaagcttacgctctaaaggtcatcctagactggtttctaatactgattttattgcacatatttgttcttgagcaaactaggtaacctatatatgcctcaatttgtttacatgaaaaatagagataatagtattatacatctttgttatggagttgctctaaatattaaatgaaataatggttgtttaatgcttagctcagtgtctgacatcagtatatgctcagcaaatgatagctattattatgttcctttctcttgaagaagatggtttgaaaatctaagagcacacagtgtctgcatttgaaatgtccttgtaagtggaagggtttgtcatgcatgacgtgaatcatgtcaatatcaagtgggaataatcatttctgtgtgccagttatccctgggagtataattgtaactatgtttggcctatggtcttttaaattatatctattatgtaattatagtatattatcttatataattatattatatataattttaaaatgtatacatacatttatatgtatgtatgtatgcaaatatgtatacattcatatgtgtatatataggtatgttttgtcaataagggtgaatcctggctcttgtttattcctgattcagcttagaaacaacccaggctatttcaagggcatggcatatgacaccttgtgttctcaaagccaaaatactcctaatggcaaatctgcaaattctgcttgaaaatgaattcttaaagaccattctagtagatgttttggatgtgaaacttttcatttccaggaaggttgaagagattgttgcaccctaaataatacggtccttgcaaaagctccaggaagagcactttaaagatgcatatactaagatgtgtgttcggtctcctctggagggcactctaaaaaatttgcatatgcaaaccctttgcgtatttaccagcgcaggtgatgagtaaaagtaggtttgaatcaatttagtggcatttttacacagagctttaaaaattggatactgtgaatgtcaacttccacaaaccccacaggcctttctttcagccaagcacaaatattaaagcgaacaagagcattcaaaaagaaatagctggaaatattatttcacgtggaatgcaaaggaaggtttataagcaaacagctggccttctccaaggtactttataatttaatctgtttcatattttgcttttccaagggactttgaaaacttcttcaggaagaatgaagataactgatgccattccttagaactgcagaccattgctgggctttgcgttgactcaagagaaagcatgggtaggagaagggcaagctcattcacctcatcacaggaaaaataattgccagaaacttgtgaagtttcaagttctatttcctacgtaaaacccctgactaccacccttctcttaacttacatgactttttctctctcctagcgcatacgctagtcacattcatcttctttctgtttcttaagtgtaccaaactcatttctccctttccaatttttttctccccaaccactacatttattcccattattcagagtaaaatttgcatctccagtaaagatatcctaggagtctaacataaattaagtcctcatgctatcttcttttatagtagcctggattccttctttataagaattctatattgtattattaccttgattgcctatttgatgactgtcccttcattagagtgtcagttttaggcaggcaggggctttgtgtagtaaattaatgtagtcataggatatagaacgttgttcagatcacagtaatcattaatgttgctttaaccaatgcaaggagagggacttttagctccctcgaaggtacattgcacttggcagtcaaccacctagaaatcagaataaaattaataaatatgaatcttggaataataggaatgcctagtcaaaaaagagtaaaattaagcagtatttgaaaataattgtgacctaataatttatcataggtttcagtatttttcttcttgcttcacttcagttaaactgacataaaagaaacattgtttctcaaatacccagggacactggaaaaaggtgtttgaagataatagtgtgtcaattaaggcaaagctgaaggatccagtcctttctctgggaattgactgggctatctctgcagagaactgcctgaaaagtcacaactaatgccaaagccctgttgctgtaaaggaattaacacaattccaaatccctgcttgtctggagcaacagaatacaaggtgctctcaaaaaggctcatctggatacctcagcatacaatattttatttttattttttgagacggagtttctcttgctccccaggctggagttcaatggcgcgatctcagctcacggcaacctccgcctcccgggtgcgagcgattctcctgcctcagccccctgagtagctgggattacaggcatgcaccaccacacccagttagtttggtctttttagtagagatggggttttgctatgcttggtcaggctggtctccaactcccgaagcatacaatttttatcctttccttattaagtcaagaattttcaccttttcacttaaaggaagtgatggcagcggcagccatttggagtgtcccctgcaaagatgccagccacagcaggagaggcacagctagggttgtgcactccacccagtgggagccaggaacaggcaggacattcagcccctaccgagttggcgggaagggagccctgtgctcccaggcacagctgcatatgtccagttgcaactccggacccaggcatccctgtgctctcaggggcccaggaaactaccccccacagcagtcttggaaatgcctgcacccactcctggcctctccctactcccagtgcctactccgactttggagcaatgttgtggctgagcccgggtgctgtcaccacccagctgggtgtgtgcacactcagggtggtgctgacatgccaggcccctgccgcctcagccccctctggactttgggcaccgatgagcgtgggagggaggccaaggggctgagggcagctcagcgtgggcctgcaggcccccttggaaagaacaacctgggtccagtgaaccgcatgttgatggtgggaggcagaaagattcctgagctgaaagggcgggtctggtgaagccccaccttcaagccagggatagcctgaagcctggaggctgagcttccagttctgggtggagtctgcctcacagagtgataacttatggtgctttttctgcgcctgctgatggccacccatggaccaatcagcacgcaagtcctccctcctgagtccataaaaacccccggctctgccagaatcagacagatattaggactaccagcagagggagggagctacccacatccagtctcctccataggacaacctgtctgctgaaaggggctacccactacaagtctcctctcttctgaaagctggagactcctcaggatgatctgcccgtggaaatgagctacccacttcaggtatcctgagagctgttctgccgctcagtgaagctcctctgtgcctagctagctctccagttgtgtgtgcctccttcttcctggatgtgggacaagaacttgggacctgctgaatggtgggactgaaagagctgtaacacaaacaggactgaaacactcccctgtccaactcacgctgtgtgcgacaagaagaagagaagacttgtggcttttcagggaacccagacctaggggctccccaagccagggatgtaacactcttttgggggctctgtggtttctggcgtctccaagcttttgggtgccaccgcatctccccgtcccggacgcctgtgcctgcagcaagccgcttgcagtacgtcttgtccagctgcagcctcacatggagccggcgcctgtgccaatgcctagagctgcctgtcccgccacagcagccaggcagctctaggcactggctgtgcctggctgtgcgcaatggccgaaccctgtacgcgctcaccagcatattccttgccgctctgcacctgactcgcccttggtaggcgtgggatccaggccagttacacagactgagtgcagcctgccaagctgagtgggcagcaggggccagtgggcacaagcaacacttaggcagaaggtgccaccagccacagaggtttccggctggcaaagtgacaccccaaggatcctgtgacagagtgctttagggcttctctttgccatatccaaattgccagcaacactacttttgcgctttcgggaatatcgctgactgaaataaaatgagagttttattaaaaaggaagaacagtagaggagataatggaagtcagtcagccatgtctgccacacctatgatggtctcatgcagataagctaaaattaaataaaataaggttcattctaacgcaagtactgcaatcccatgacagttgatcagataattgagacagctgctaagtgactaatgggtggggaacagagacaggatggataggctacacaaaggtatgattcacatcctgggtaggaaagagccagaaggcatgaaatttcatcatgctattcagaacagaacacaatttaaaatttatgaattgtttatttctgtcctgttctgtttaatattctcagagcactgttgattatgagtaactgaaatcttggaaagtgaaagcacagataaggggagactactgtatatttaaggtattcaacttgatgctatgagatacatacatataaaatagtcactttagtggcacaatttaacatatctacatctcacacagttacctattttctcccctgtgacaaaaggaactataatctactcatttagcaaaagtcctgaacacaatacactattaactctagttctcatgttgtacattccaattttccacctgtttatcctacatatttgctactttgtatccctggagctacattaccgcatttcacccccaccctatcctgaccctgatcaccactgttttattttctatctttatatcatttgatgtttttaaaaatagagtttacatataagtgagatcatatatttttcttttcgtgtctggcttacttcatttagcccaattaaaattcgatttgtatcagtatctttagaaagcaactcatctgagaagtcttctcttgcttccttcctggggggtcctgttgccctttctttgtgctttcgtagtggcaccatgactctcctctcagctggtatcatgttgcagggcaaacatctgtctgtctcctctcactggatgataagatacttgaaggaagggattgtatctattttttggaccgtcaaaaccacgactataatacctcaataagcatttgctcaatgagtaaatgagtatatgaataaattagtgttatttgcttcatggcctggattcctccatagcagaaccttatctgcatgagaccagcataggtgtggcaggtatgactgattgacttcccaatatctcttctattcttcttcccttttaattatatttcagtcaatggtagtgccaactaaaatattcattttctagttttttttttttttttaaaaaactagaaagtttaaatgacagtgcttgccaatgaatataaggaaatatgtgttggaaatttttggaaatatgttgcttttttaacgcaagcattatcacttcttgttgcttccctctttttttctgcctataatgctgacacagggcaagaaaagaagtctttctgcaagatgagagagagaaatccatgtgctaaggtagagggagatagaaggagcctggttctttgagcagccaggattacctagccctacatgattaaaaatggagcagccaggattacctagccctccttttgaacaagccattataatggatttcttttatatacagcctaataaaatccataactgatagcacttaaaagattgcttgaactaattgctttggatagaacaaatgaataggtatataactatggtaatgagcaggaaagtttctgctttggtccccaaacctaatgcctataggattcgggatctatttctaggtaaaaatgatgattttgtcttgtaccttgctgggattcagtgatcctttgtgttaagttctataatgcagaaatgcccgtggactgctatgccagattcttctatgataatactctctccaagactgtgtcttttaaacatgcacaaattcatgctcaatcccatttctgacttgagatatagataatatgtgtagaagaaggcaacattgaactaaaaatgagaagttttctatttcagccttactcttttgccacctgatggtcaagttatataattttttaatgagtttaaaatcacggcagggaagctgcaaccacctgtcaccaaatttctactgcaattgtgaccaaagcctgaaattaaaactcttttgactgtttccccatttacccttccaagtgcagcctactgagactcatggaattagcatcttaaagaaacccacacatcccttcacactcctgaaaaccactgccaaccacccctgctttctcacaattgttctccaggactgcctgtctatagctgtcaccattattcatgcaacgcccccaccgagcagagatggagagagagattgagtttgctcaccagtaagttgagctgtaaactcaggaaaattgggcttcgcaaggatggagagcctagagctttgacaggctgtgcttctgaggagacatggagtaaaccgcattctctttattcatcacttagtgaaagaaagaaacaccctttgtgaagttgtctccacagaggtatagcacctatggccacttttccttggggacctttagaaacaaacaaacaaggctgcttccccgtcactgtgtagagagttcatgcttttaatcacaaggcatatgtaggtgataagctctcaatggtaaatgtctcaaaaattatatctgtagaccagatgtttgtcacagctactgacccttaagatgtaggcaagattgccttaagtgtaggacacacatgatttcatggcctttgggagtccacagctctcccaaaagatttctgtgaatttccatgtgggtttcagcttccttgatttcccctgctttggggggctggtaatttttctcttttttcttgaattctgatccagaacaaagcttagtcctttaatgctttactcatcaataccccaactgcatacttaattcactcattttacatcagtgaagacttagagatcatgaacaaaatattacatatggaaatcatacagtaatcaacatcttagtctttattagacacttttcctcccgaaggatgtttcagcactctacagctcagtatccaggcctagtcttctcttctttgctaatttctcattttctcctctagtcagcctccttctttgttctagactcaccactagatgctaatcagggagtaatgtcgggcgagaccattgcagctgtgcatcaccagatccttgaaaccagacagacccccaaattctggatttctgtgtgtgtatgtgcatctgtgtgttgttggatgtgtcagtaaggatctctctgttcagaatagactgtgagttttagaaattatgaacacaaggtaccagacattctaatatgctataatccaaaccacattttctagatttacttttacctcctgaatgggatcaaaatctatcatcagattggctttacaccacttacacacttacagagtgactttacaccactccacccactggccacctttctgaagcttgaatgtttgtacagcaccccaccccagcataaaatggagataaaaaggatttgaagttacgacacattgaagtaacatggattattggagcttaagtcatttttccatatcttaaactggtgtacaaatagtctgctttacgaaaacccccacacaagggatgtgaaggacctctttaaggagaactacaaaccactgctcaatgaaataaaaaaggacacaaacaaatggaagaatattccatgctcatggataggaagaatcaatatcgtgaaaatggctatactgcccaaagtaatttatagattcaatgccatccccatcaagctaccaatgactttcttcacataattggaaaaatctattttaaacttcatatggaacaaaaaaagagcccgcattaccaagacaatcctaagcaaaaagaacaaagctgaaggcatcatgctacctgacttcaaactatactacaaggctacactaaccaaaacagcatggtactggtaccaaaacagacatatagaccaatggaacagcacagagccctcagaaataatgttacacatctacaaccatctgatctttgacaaacctgacaaaaacaagaaatagggaaaggatttcctatttaataaatggtactgggaaaactggctagccatatgtagaaagctgaaactggatcccttccttacacaaaaattaattcaagatggattaaagacttaaatgttagatctaaaatcataaaaactctagaagaaagcctaggcaatatcattccagacataggcatgggcaaggacttcatgattaaaacaccaaaagcaatggcaacaaaagccaaaatagacaaatgagatctaactaaactaaagagcttctgcacagcgaaagaaactaccatcagagtgaacaggcaacctacagaatgggagaaaatgtttgcaatctatccacctgacaaagagctaatatccagaatctacaaagacctcaaacaaatttacaagaaaaaaacaaccccatcaaaaagtgggcaaaggatatgaacagacacttctcaaaagaagacatctatgcagccaacagacacatgaaaaaacgctcatcatcactggtcatcagagaaatgcaaatcaaaaccacaatgagataccagctcatgccagttagaatggcaatcattaaaaagtcaggaaacaacagatgctggagaggatgtggagaaataggaacacttttacactgttggtgggagtgtaaattggttccaccattgtggaagacagtgtggtgattcctcaaggatctagaaccagaattaccatttgactcagcaattccattactgggtatacacccaaaggactataaatcatgctactataaagacacatgcacacgtgtatttattacggcgctatttgcaatagcaaagacttggaaccaacccaaatgtccatcaatgagagactggattaagaaaatgtggcacatatacaccatagaatactatgcagccataaaaaaggatgagttcatgtcctttgcagggacatggatgaagctggaaaccatcattttcagcaaacaatcacaaggacagaaaaacaaatgctgcatgttctcactcataggtgggaattgaacaatatcacttggacacagggcggggaacatcacacacccgtcaggggatgggggctgggagaaggatagcattaggagaaatacctaatgtaaatgatgagttgatgggtgcggcaaaccaacatggcacatgtatacctacgtatcaaaacagcacgttgtgcacatataccctagaacttaaagtataataataaaaaaaaagtccccacaccaactccctaagcttataccactgaggaagctgaggactctttattagtgtcttataggcactgctaaaataatatatcataaataggtttaacagtagtctaatctattaccctgctggtgtttgccaaaaataaaggaaagtaaacaaatgaaataaaaacaaaatgagcaagtgaagaaaaaaatctatttcatgcaggttataacaagatgtaatatatgttttctctttacgagagtatttgatgctctttatattaaagattacaacaatatgttatgtgaatacgtaataatgtagctatatttccagtaatatagaataattttagcacttgtctgtgccaggcattttcctaagcattcatataaattacttcatctaatttcaccattcaatgaaatagatattctcatcatccctatgtttcagataaagaatctaaggctcagagagattaggttaataacaaaaagtcatcaaactaaaatgtgcacaactgagatttaaaaacgtagatctgaatgaatatggagtctacttttaacattcctaaaattcagtttgcataaaaaattcatgaagacagctattgcataaacatggcccagtgaattagtaaatggggctaatatatggattatagggtcaaacaaagctagggagtatgtttccaggtagcacatcaatttctgtaaatccttgagaacattgggtactcatagacaggatgagttcttaatctaaaatgaagaaataacgggtgatcaatacttatatacttcttgattagacctaatcttcagcaatatcctaccccgaatttcacctccaacaacactacttttgtggggaagctgttaatatataaaagtccatctgttcacttgagaataaaggaccactctgctcctaatccaatgtctgttgcttttacaactttgaatacaacatcagaggttagctttgatatttcctcaagtctttctggcatttctagtgaaagagagaacctaaaacggagtgtaataaactttattacccatctgcatctcaaatgcaatatacattaactaggatgcacatggatttccaagtgtgattgtattttctagtgtgcctctctgggagggaaactgtctcaatcaccaatagaccatatctaaaaactaacaggttactttgttgtgaccaactctcatttcccaaagtctccacccaacatggaccctattctgttgcatcagttgggtgaacattctcccgtttttgtattttctttgcagcatggacattgggtgtgagcgcgttttttggaaaaaaaaaattcagtgttccattaatgagataatgtatttatttattatgacaataaacacagctgcaaaatggaccataaagaaatagacgacttgcagatttctgtgcccaacctgtcaactgtaattgagaaataaattaaatgatccatctgctttgcatcatctactcctttatttttgtcagtatccatggttttaaaaactaattactcactaaaaaaatccatatagaatttgaatgactttgtaacgcaattttgccatcccccaacatactgtgcttctttctaatacattcaaatccaataactatgatgaactctttcttttattaatagttttcacttaatcatgccaatactattgcattttctctttattagtgtcttataggcactgctaaaataatatataataggtttaacagtaatctaatctattaccttggtggtgtttgccaaaaataaaggaaagtaaaccaatgaaataaaaacaaaatgagcaagtgaacaaaaaaacctatttcatgcaggttatcacacaagattcaatctgctttctaatagtattcagaggtgagggttaaaatagccaactgcaactggaactaattaactatgattgtaccattttttaaaaacttcattgttataattatctcactgagaaaccacacatcagagctgggaaagcagcaataacttctgcttctcacatgctttcatgttcatgcttctctgctccagaactttcgtttgttttcttaaacccccagggacatccctgtgacagccctattaaaatatttgcagcatttgctgtgaggtctggtgagaagacagaaatataaagtgctctttcaaaatgtatttattgatatcttttttttttatgacaaatgaattccttgttaaccgttaaagaaaaagaaatggaaaatatagaaaatcaaaaagaaaaaagtagaaatcatatatacactatcccagcaaatataaccactgctcacattttgttgcctattctaacagcatttatctatttatttgtacagaaattttaaaaacaaagttgagatactatgaggctgttttctaacttatttttctcaattaataagatagttttcatgtctatattgattcacaacatcatgttaatggtcacgtagatacgaattatgttgtcagctttctattgctgtatactttggctatgtgagcattgccagtatttggttctgtttctttctgattactctcctaaagtttagtaaaaggattgctattatacttccctgtaaaatgaagatgctttaacccatttgttagagattcagtggcttagtaacatgaattattctacccactcttagaagttacttttttaaaataatgggaaagatgaaaagcagatattgttaagagtttggggtcaaatgctttattcatgttttctgcctcttcatttcctattgtcatacaagccaacctccctgccaggacagggtcttgagacttctatgatggtgctcactgtggggcatataagggttcaggaagtaaagcccctttctatataccatataccactgtgcatcttcctctctgtagctgtctcttcacacagtgtgaagttcaaccacaagcgtttttatattgcctataattagatggcttgggagaaaaaaaaaagccttataacatagagtttagtttcatttctgaggataacagtagagaggttatatttttgagacatcttttttctaatttctttctctttcttccctctctctctcctcccaaccccctctgtgtgtctttttatatctcagcatagtgcttgccaagatacaaatgctagacaagacagtagatttgattatttcccacagtggttaataaccttctgtgcagagggtcaagaaggcacatgcactcttcgcttgccaaataagcctgatcaataatatccattttttttgctagttaatatgtttcttctttttttaaaaaaaattcctccttttccctgtcttactttctcatttttctggtttatttatttccaaagagactaattgcattcaggtccttgtctttggacctgtttcttgggaacccaatctaagaggactccttgagtcaaactctgctcattactctccactgctgcagagtgaaacccatgcttcttagctcttatagctaagatctgtgatctgcaccatttctcatgtctgtgcccagcccaccctacagtgcacccatttctttaaaagtcagattgagcccctgttgttcccatggcctccctatattaccaaccctgctcttagagttcttctattacttcagcttggtaggtcctgtaacagagctttcctctcataagttatgtgatttggggcaagtaacttaacttcattttggtctccttttagccatttgttgtaataggaaaatagtagtccctaccttatgacacatttgtgacaattaaaagaattcataaagcacttatcaaaagtgtccttcctcttaggaagtactcagaacatgtcagcttttgttacaccagcccccaaccatccaatcctttaaattcaacttcaacttcaaccatctccttcaggaaaccttccttgtgccctcagctggatttgaacattctctctcctgacttcacattttcttgatatttctccattggcattcatttttacaaagcattttaattaaacatattacttttcctaactagactatataaggctaaagaagctatctctttctttctgttagggttggttgaataacacccctctccataaaaatagatgtctactttctttctttctttcttttttttttttttttttttttactttaagttccaggatgcatgtgcagaacgtgcaggtttgttacataggtatatgtgtgccatggtgatttgctatgcctatcaactggtcacctaggttctaagctccacatgcattagctatttgtcctgatgctctccctcccctcgccatccccatccccgccggtaggccgtgatgtgtgttgttctcctccctgtgttcatgtatttggaatgttcaactctcacttataagtgagaacatgcggtgtttggttttctgttcctgtgttagttcactgaagataatggcttccagcttcatccatgtccctgcaaaggacatgatctcatatcttgttgtggctgcatagtattctgtgatgtatattacaggacacatatccagtctgtcatagatggatatttggattggttccacatctttgctattgtgtgaatagtgctgtaataaacataagtgtgaatgtatctttattatagaattatttatattcctttgggtatatacccagtaatggggttgctgggtcaaatggtatttctggttctagatccttgaggaatcgccacactgtcttccacaatgattgaactaatttacatttccaccgacaatgtaaaattgttcttatttctccacagcctcaccagcatctgctgtttcttgactttttaataattgccattcagactggcatgagatggtatcgcattatggttttgatttgcatttctctaatgattagtgatgttgagctttttagaatatgtttgttgaatgcataaatatcttcttttgagaaagtgtctgttcatatcctttgcccactttttgatggggttgtttgttttattcttgtaaatttgtttaagttccttataaattctggaaattagacctttgtcagatgggtagattgcaaaaattttctcccattctgtaggttgcctgttcactctgatgataatttcttttgctgtgcagaagctctttagcttagttatatttcatttgtcaattttggcttttgttgcaattgcttttggtgtctttgtcatgaagtcgttgtccatgtctatgtcctgaatggtactgcctaggttttcttctaaggtttatatggcttggggttttatatttaggtaaaagatgtctactttctaattctcagaaactatgctagttaccttatatgaaaaaaattgattttgcagatactattaaagatcttgacatgggaagaccattctggattatccagtttgatctggcataattataagcaactttataaacaggtgtcaggagatcagagtaagtagtaggagactaatgacaaaagcaagagattggagaaatgcagccataaaccaagaaatgacaacagcctcttgaagtaaaaaggcaagaaatactttctccccaaagcccccaaaatgaacggaacttgctgaaaccttgactttatacgagtaaaactcatgtcagacttctagcctggaagtataagaaaattaatttgtcttattttaagccattaagtttatggtaatttgttatagcaatggcaagaaactaatacaccactgatatggtctggctctgtgtccccactcaaatctcatcttgagttataatccccatatgttgtggagggacctcacgggaggtgattggatcacggaggtggttcccctatgctgttctcatgatagtgagtgagttctgaggagatctgatagttttataaggggttcctcccactttgctctgcacttctctctcctgccaccttgtcaagaagggtatatttgcttccccttccaccacgattgtaagtttcctcaggcctccccagccatgcagaactgtgagtcaattaaacctctttcctttataaattagtctcaggtatttctttatagcagtgtgaaaactgactaatacaaccaagcaataggattttttgactactgtagttgttaaataaatatttgatgagtaaattaattgcaaacatatcaaaagcagtgaaaagatagagttcattaagtaatcatttgaaaagatcttaatcaactctcaagaaaaaaaagaaactactaatttcatagctatgttattctcccaggaaataaaacactgagtctcatctacccatctctatcagaggtcagggtggattctactgtggtttatcattctaaaacaggaaaaaatgaataatgacaaaagagaagacagtgatgggttttttttggttttgttttaatggcaccacaaattcctaggcaaatgtgtcagttgaattctacgctatgtttatgaaacacagctcatctccagggagctaaaatctgcgcaaggaaatattgttgtcactcggccacgtgactctttcaattaccttctctgcttctggatttaaaaatctgttcatggtacacacaacacacacacacacacacacacacacactaatcaccatgttaatatggtaatttggagagttacatggaagagcttctgtcttgtaattgaagagctgttcctcattcatctacatgggaacccagcactctaagtgcaagacactgccaatttctgagactaggcctactagcattgcaaagtaaaaattaggacaacatttccatcaaagaaatggagtagacccattttttttttgtttgctcttgcatttctccttcttcttctatgtttcttgggatttgctttccctggagtcacacaatcagtcaatcaatttgtatatatcaagtgactgactgaatgcctactagctacctcttacccagcactgctcatataagcagaaaaatctgccatgatatgcattaagggcctggacaggtcagttctcaagcttatggtaagaatgaaaatacttaaggatggaaactatgtcttgaatgctgctctattgctcaaataatatctaaagacttcaacatttcctttcctaagcattaaagtccataagatgctgtccagatgaccagggttctccactggttcaggccaaattcacaaattgcactgtttcaatgttttaggcaaagttcttctttctcactaaatgtaaacatctcttgggaaaatctatgggctgagagtccaaaaacccacattagaatggctattatcaaaaagataaaagacaacaagtgttggcaaggatgtggagaaaagataacccttgcacactgttggtaggaatgaaaattagtacagccgttatggaaaacaggacggaggtttctcaaaactaaatatagagttagaattatcatatgatctagcaatctcacttctgggtatatatccaaaaaaattgaaatcagtatgttgaagcaatatctgcacttctgtgttcattgtagcattattaacaataggcaacaaatggtataaactgaagtgtctatcaacagataaatggacaaaaaaatgcttatgtacacaatagaataccacttgcctttagaaagtagaaaatgttgtcatttgcaagaacatgcatgaacctgaaggacattatttaagtgaaaataaatcaggcacacaaagacaaatattgcatgatctcatttatgtgtagaacctaaaaatataaaagcagagaatagaatgttggttactggaggcttgggtttgacaggaagtgaggaggtggaacagggaatggaaaaattttgaccaaagaatacaaagtttcagttagacaggaggagtaagttctcaaaatctattgcatagtatgatgatgattattattagccatagttagtaatgtatatttcaacattgctaaaaagatagattctaagtattctcactacaaaaaaatagtaagtatatgaggagatggatatgttagcttgatataatttgtgccacaatgtgtacatgaatgaaaatattacattgtaccctagaaatacaattattattcatcaattacaaataaaagtttaaatgtaaaaaaatccacatttttaaactaactctgtggtcattcataaggatgctttgggttaacattagaaaacctaatgtcaactggcttaaacagtgaacacctttatcatgtgaagagtttgccagttcaaggatcattaagcagaagcttagcagcagcatcccagcatgtgcttcttccatctatgctttttcagcttcatagtgtttgtcttgtacatcaagctgccctccctcatggtcagaaattatttactacagttccagtgtcatactcatatgacaacatctcaccaagggtgcataactgtctcttctcatgtgtttctttttaagaggaaaggcattttaccagagactccaccagaagatctaccctcaccctcctttggtcagtcacatgggtagcctaaaaccaatcacaagaggaaaggaaaaagagaaagaaaagaaaaaaaatggcttaagttaatgtaagcaatatgtattccctaagtcatatgtgaatgagttaacacccaagtctggctttagggtaggtaaataacagtgtttattacactacactttggattagttgtataaatctatataaggctcttaggtaaattaaaatatatatatgtataatggaagcgtaattgctatcttttaattttagtgtcactgaggaaatctaattggcctggtgtttacaatgtatctgctaattgtgagtcactgatatagatctgcaaagccttcaaagatgactgaaacagtttctgctatagttttacatccttttggacaatctgaaagaaatgaaaaaaatagctataaaacaagcacattatataaagccacagaagaaagttaaagatttaatttggcctaagttgaggaagacatctaatttaggtaagagaagagtaaaggagtcaagatacgcttcatagatgaagtggcattttagacagacctggaaggtttggtcgaattcaacagatgaagacgatgaggcctagctcctcagagggaggaagggcatgagggagatggacagttgttgtagctgccttttagctttggtcatttttttctgaggaagaataccccaattgttatctgtagaggcatctggcctaccttttcatgctttttccgtctagatgacttcatacacaccctagcccctggagtgtgtgtaatcataggcacataatttaggctcatcattctattttcctgtccataatagttggttcaggtcgaatcagagctatcatcgaggatcttttttgaattactgagaaaatagacatctttgccactggatttgaaatggggattatgcaggcctaaagaatctacagacattttgccatcacatagatctgagactgagtcaacaactagttagaaggtggagatgctgagacctggcaatatcatatgagccctcaatttaaccacatgaagtaaaccagcattaatctcttgcattacttgggtcagtaaatttgttctgccagccaagattttttcttgttttctgtagctgaaagtcagacaatatagaatgactcaatggctcctcttgtttagttgggatgactaaagaaagcttgactatttctgagaagtttagtattaacaatccataagagaggatagaagttgaaagaacaggcaggccctaccattaataaaaacatagcttttcttggatgggcaccttcccttagcagataatacttgtggtctactgaggaaggttactggaatttatgtattggtagctggtactttttggtaatgcaagctgactgttgccaacagaactaagggctctgaatacaaatctcccagtgaaacactttaaaaataggtttcttgtgttaaataactttatgaatcagtgcaaatgctagtctccttcttgaagaaccataatgagcacacacactttaaatataatgagaaatcttgctatatacactttaattaacttaaatagaacctggaaaagattaatgctggaagccttttaataaggaatatataataatattctcaggaattagtacacaggataagttcttgcaagatcaaatctacacctattgtacagagtaaagactcagatataaaaacaatgcatctgtgcttcgttgtatgaaatggttttatttcaactggggttgccaccggaaaaaaaataaaacatgctttaagaaaatttgggatattttttggctccctatcctacttccttagctttcatagaagcagtgcctgttagaaggggacaggatctgagcatcatctatttaatgcgaaatgagaaaacaatacacaagtaagggtcagtgatttgtccaaagtccccaacttgagtccttggcagagccagaaataggagtctgacctcctgactctggccagggagaatatcatgtagcggtttgttgctaaaagccttggaattaggctgttcatatttcaatcccaagctctgtgatcttagatgtgtaatttattcttcataagcctcagtcaactcatttgtagactgaggttgataataattgtaccttggtaatagggtcattgtatgaagtaaatggcacaataacatgtgaaagcacctttccaaatgcctgtcttatgccaggtactatcaggcattttgcccaattactgccttatatctgggactatccctagaagggctccacataagtttgaatctctgatgttgctgtcttgaaatttttgataattttgaacaaaagattttgcatttaaaatttttaccccttaaattatttatctggtcctgctagcctaatgtttgtcacatagtaggtgttccacaaatattagcatagatcagaggatagattattaacatgctcttattatcctttggcaacataaataactctttaatgcttattacctccatcttttttatgagatttaaaacctctttaaaggcttttgtaatttattacaatattagtgagtttagtgatttaatcatcattccaattagttggtgtgattatataaggctttccaattatagtgagatttaatgtttaacaacctaccatacccctaggagatgagttgagaagaaaatcagactctccattacataaaaccatcctcttgtgcaagggcaggaaacttctacttggcatatagaagatacacagcctgttgagagggtggctgtaatttctctttgattatatggtgactttttgctaatctggctataaatatctagtgagactagcccaaatttacctatcccatcacttctcaaagtacattttgaaaagtatgtcccatttaaaacaaaatgaaacaaagcaaaaacaacaaaccaacaaataaaacttatctaataaaaggtacttgtaatcaaataatttggggaagatttccctatactattccgtacatagagagtctcattgtacatgaatatataaaaggctgtgctatgggccacaaccacttaattttcacttaatacacactaaacatattatttaattctggatttttttcaattaaaacctattaatagaagaaacacacccagaatagtggagtaaggactgccaaaaaatctactccaccataatagcaatgagaacattggcaaaatttataaaaatctgctttttcagaactctggaaattaacttaaggctcacaaaactttcagaagccctcattcaagaaaaatgactaaatctcagcaagaacaataatctttgcaatgtcttaatttgtcttacttccctgcccctcactccaggtttgagattagccggaaaaccagtagcctcagaaccatgtaatctgtgaaaaccagtaatctgacattcataggatgggtcagaatgagtttggtgagctccttttattaaaaaaaaaaattgtcatcaccagagaattgtcactgacatttctgggagctcattggaaaaataccattcacaaagtttgttttatttatcctaaatgagagctaactcacagaggaaattcttatccccatgtgcttgtttaaaattaccactagcaactatttaacattttagttacttgaattgatgaaggagttgggtcaaacaaaaagctagataataaacttaagctaaaaatctggagaataaaatgactacagggagttttaaaaagctcttatagagaaaaaaaccccggaaggccacagatatatagagagttgggctcatgcctaggaaaaacttgagaaggcttttatctttcacctatggataatcttgaggctttgtacaagaaagaagtgaagactaatgaagctgtgtaaactactgcatagtgttgaagatatgccccaatacacagaaagcttctcagcaaagtatggtacaaaatttaataaaattatttaataattagcagaccactaaacttaccaaacaaagacttcaatggctatacatgacaaagcatgcagactttacagaatcagtccaggatcattattaacctaatacatagatataagaacaatagacactaaggaagaaatctgattccacagttgtcacatttaacaaaaaatataaaacataccaaaaagcatactgtatgaatagaaaaaaatcagcaaaaataaattattcctgatgattctccaacactgaagttactagaagaaaattttaaccagcatatgcattttttcaaagaactaaaaaagtctacaaaattaaaaagaaaatatgaaagtgtgacctattagagaaaataaatatacagattgaaataatattaaaataaaataaccaaagggaaattctgcagaacaaaggtacaatattagacataaaaaattcactagaagatttcaacagaagatatgacctgacaaaataaataatcagaaaatttgaaaataggtcacttcagactattcagtctgaggaaaaagattattcttgtttgagaaacaggaagcaaaaggaatgaaggaaatgaagacaacctcagaatcctgtgggatgtcatcaagcatactaacacatgcataacaggagatccggaagaataggttagagagaaatgggggaaagtacataaaaataataatgaccccaaattatcaaatgtgatgaaaaacattaatctgaatattcaataaatttagttggataaacagagattcaacctagatacatcttaattaaattcttgctattcaaagacaaagaagaagtactaaaagcaacaatagaaacatgactcataaaacacaaaatgtcttcagtaaaattaacagctgacttcttatcagaaactatggaagacagagaacacaatgtgctgacaaaaactattgtcaaccaataattctatatccagtgaaacaagcattcaaaaatggcattcccaaaaaataaaaaatgaagaggattcatcaccagtaaaaccattatacaaaaactatttcaaaagagtcctttaggctgacatataattatagtagaaagtaactctaatcaacacaaagaaataaatagtaccagtaaagatactagtaactgcatagacaaatataaaacattatgtataatttagtttgttacatttttcatcattatctgattttaaaaatttaaacttaacaaaacaatagttatatatgtgtgttaatggattataatgaataaagagatgatatatataaataatacagcaaagtggggaaatgggtatgaacctataatgagacaacatttttttgtatactattgaaattaagttggcattaataatacaaatgacattatttgaaattaagatgttaattttaaccatagggcaaaaacaaaaacagtttgaaatatagtaaaataaataaaaagtggattaaaatggtgtactagataatctctttttaacaacataaaaggcagcaatagaggggaaaacaacaaaaggtataaaaaatagtaaaaaacaagtaacaaaatgacaattgtagagcccacattagcattaattacattaagtataaatgaataaaacacttcattcaagaagcagattcaaccttgctgtgtatggggacacacattaactcaaagccacaaataagttgaatgtacaataatgaaaagtaatgtactatgctgaccaaagaaaattagagaggctttagtataattggcataaatagatattaaataaaatattgctaaataaaaaaggacactttttaatgataaaggggcaaatctatcaggaaaacttaaacactcatatatgcactattaaaagagtctcaaaattaatgaaataaaaatcggcataatatgatgggcaaggaaaattcaacaatagttttagaaactaatattcaacttagaatcatctatttcaatttcaaacgtttttattgctgtatctttatgttcattgattcttcccttagtgtgtccagtctactggtgagcccatcaatggcgttctttatttattttagtgtttctgacttctagcattcatttctgcttttcttttagagttttttctctctgcttctattacccatatattcttttatgttgcccacttttttctttgcagcaataagcatattaattacagttatttaaattctcaatctgataagttctacatctctgctatatctgagtcttatttttttacttgctttatctcttgagattatattcaatgccttttagtatgtcttgcaactttatgttgagagctagaaatgatgtattaggtaatagaaatggaggtaaataggcccatagtatgaggatttatgtttatctggctaggatttacattgtgttcattgtttgctatagcagttggtggctgaggcttcaatttcctctggcatccttatttttgtctcctctgttatttctgagtttccctaggaaatgtttattcaagtcttatatttgcagttcattttgttacaatcctctgttgttacgcaagagaattgttgatgtggtggtaaggtgttggagaatgtacgagtcagtttttatgctgctgataaaaacatacctgagactgggcaatttacaaaagaaagaggactattgggcttacagttccacctggctggggaggcctcacaatcatggcagaaggtgaaaggcatatcttatgtggtggcagacaagataagagatcttgtgcagggaaactcccctttttaaaaccatcagatctcgtgagactcattcactaccacaagaacaatgcaggaaacacccacccccataattcaatcacctcccacagggttcctcccatgacatgtgggaattgtgggagataaaattcaagatgagatttgggtggggacacaaccaaaccatatcatgccactcctggcccctcccaaatgtcatgtcctcacatttcaaaaccaatcatgcctttccagcagccccccagagtcataactcatttcagtattaacttgaaagttcatagtccaacatctcatttgagacaaggcaagaagacccttcaacctatgagcctgtaaaatcataagaaagttagttacttcccaggtacaatgggggtacagacattgggtaaatacagtcattctaaacaggagaaattggccaaaacaaaggggctgcaggtcccatgcaagtcccaaatccagcagggaagtcaaattttaaagctctcacatgatctcctttgactccatgtcttggatataggtcacattgatgcaaaaggtgggttcccatggtcttgggcagctccgctccatggctctgtagggtacggcctccctcctggctgctttcacaggctggtgttgaatgtctgtgacttttccaggcacacagtgcaagctgtcattggatctaccattctggggtccagaggacagtggccctcttctcacagctgcactaggtcgtgccccagtacagactttgtgtggggcctccaaacccacatttccttctgcactgccctagcagaggttctccatgaaagctctgcccatgtggcaaaccagcatgggcatcctggcatttccatatatcttctgaaatctaggaggaggtgcccaaaccccagtttttgacttctgtgcactcacaggctcaacaccatgtggcagctgccaaggcttggggcttgcaccctctgaagccaggctccaagctctacattgcttcttttcaaccacagctggagtggccatgatgcagggcaccaagtccctaggctgcacacagcacgggtatcctgggcccaggtcaaaaaaccactctttcttcctaggcctctgagcctgtgatgggactgctagaaagacctctgacattctctggagacattttccccattgtgttgaggattaatagtcatctcctcattatttatataaatttctgcagctggtttgaattttaccacagaaaatgggattttcttttctattgcatttttaggctgcaaattttatgctctgcttcccttttaaaactgaatgcctttaacagcacccaagtcacctcttgaatactttgctgcttagaaatttcttccaccagataccctaaatcacctctcttaagttcaaagttccacaaatatctaaggcagggccaaaatgtcaccagtctccttgctaaaacatagcaatagtcatgtttgctccagttcccaagttcctcatctccatctgagaccacctcagcctgggccttattgttcatatggctttcagcattttgggcaaagccatttcacaagtctctaggaagttcaaaactttcccacattttcctgtcatcgtctgagccctccaaactgtttcaacctcaacctgttacccagttccgaagtcaattccacatttttgggtatcttttcagcagcacaccactctcttggtaccaatttactgtattagtccattttcatgctgcaggtaaaggcacacctgagactgggcaatttacaaaagaaagagttttattggacttacagttccacgtggctggggaggcctcacaatcatggcggaaggtgaaatcatgtctcacatggcagcagacaagagaagagagcttgggcaaggaaactccactttttaaaaccatcagatctcttgagactcattcgttactacaagaacagtgcaggaaagatatggccccataaatcaatcacctcctaccgggttcctcccacaacacatgggaattgtgggacgtacaatttaagatgagatttgagtgaggacacagccaaaccttatcagggggaaaaaaaaatggttctacagtcttacaattattctcagtctttcagtgagcttctgtccctctgtccccagcttgtgaccatcacaaatgtctcaccctaagtgagcgtgaaaggctagagtgtggagtcaaatattaccctccctgcatatcaattaggttctgataaagtagtttcctttgaaagaaggtgagaagaaaactctgtaggaatatttcaaaatggttacttttagtatctccctgctagaagcgtaagaggattgttttctgatcttcactttgagaataagtcccctgagattaggtcccaggattttttaactctcaagctacttgacagtcattctttagaaatttgtcagttatggttttttttttttttttttctaacggtttctggctccagcatctttagatcctggtaaactataatttgtctgtgtttgcctagttcttccattttcaggaaattattttgtcctgtgacttcagttctctgatggatctaatcagttgctgattttcagtgtgttcagtatttttcttattgtaggatgacagcaatcacttctttacatgttggagtaaaaggtcagaaatctagatttttaaatgacataaagaacaactaggcagaaggctaaaaaggaaatagaaaacctgagcccccaggtaagtccactagatataacagacaactacagaaaaattcacctaacaacaacaaaacacagaatcttctcaatgtacacggaacaactgccagggaagactacatgtgaggccacaaagaggcatccataaatgtaaaatagttagaaatcatacaaaatatagtatatgaccacaatgaaataaaattaagagtcaaaaggaaagtaaaatttggtaaattacaaatataaagaatttttaaaaaatattctcctaatcaataagttaaagaaaaacacagttaattagaaaatagtttcagatgaataaaaacaaaatcacatgtcaaacttataggatgtagataagaagtgcatggagggtagttggtagctctaaacgtctctaaaagagggaaacttctcaataagataaaggatgtctatgaaaatttcagtgctaacatcatatccaatggaataacaccgaatactcttcctctaagatctcagtcaaaacaagtctttctggacccactgtttctattcaacattttactggggattgtagggcaattaggcaagaaaagaaaatgaatacatccagtatagaaagaaagaagtaaaattatttatactctcagataatattatattgtatataaaaaattccaaggaaaccacatgcatgcacacatatatgcacacacgcacacatatgcacacacaaaagtataatgataagtaattaccaagttttcagtatgaaagccaacgtacaaaagtcaattgtatttctatgcattagcaattcaaaacctggaagtgagatttaaaaagaagtctacttataataacatcaaagagaataaaaatttatgaataaatttagtaaaggaggtgctggatttgtacactaaaaagtacaaaacatggttgaaaaaattttaaatgaccacaatcagaaagatgctttagtatacatgaattgagactttatattgttgactctacattactccttcaattgatctataaattcatagcaatacccagcaatgttctagttaaatatttacagaaattggtaagttgttctagaattcatacgaagatgcaagggattcaaaacaaccttgaaaatgtagaacaaatttggaagattatttgtcaatttcaaaattgattttaaaggtacagtatttgaaacagtgtggtagtggcataaagatggacatacaaatctgattacctatcaataagtctttaaatttataggcagttggttttcaacaaggatgccaagacaattctgtgggaaagaatagtattttcaacaaattgtacctggataactggatatcacattcaaaagaatgaagttaaatttccttcttccttaaaccatacataaaaattatttcagattgaatcataggactaaatgtaagggcttgaaaacttaaaatacattaaggagattccttagagacctaaaagtagaactaccatttgatctagcaatcccactactggatatctacccggaggaaaagaagtcattacatgaaaaaggtactctcacacgtatgtttatagcagcacaattcacgattgcaaaaacatggaaccaacccaaatgtccatcaatcaatgagtggataaagaaactgtgatatacatatatacatatatgtattaatatgtatacacatatatgtatatatgcatatatgtttttcatgtatatacatatatacatatgtatatatgatggaatattactcagccataaaaaggaatgagttaatggcatttgtagcgacctggatgagattggagactattattctaagtgaagtaactcaggaatggaaagccaaacatcgtgtgtactcactcataagtgagagctaagctatgaggatgcaaaggcataagaatgacacagtgtacttcaggcactcaggggtaagggtgggaagggggcagggataagagactacaaatagggtgcactgtatactgctcaggtgatgggtgcaccaaaatctcacaaaccaccactaaagaactgactcatgtaaccaaacaccacctgttccctggtaacttatggaaattaaaaaaaatacgttaaggaaattatgagggtaaatctttgtgatcttgcattggcgatgatttttagatctgacaccaaaatcacaagcaacaaaagaaaatataaattaaacttcaccaaaatttaaatcttctgttcttcaaaagacagcattaagaaaatgaatagacaaatccaatgcaaatcgaaatcgaaatcacaatgagataccacttggagcccactaagaaggctacaattaaaaagataataaaagttttggtgaggagtgggagaaattggaacccctatacattgccggaatgtaagatagtgcagctattttgaaaaacaatttggtaattcctcaaaatgttaaacggacttaccctgtgacccaggaattttgtgtgtgtgtatattttatatatatgtgtgcataccatatatatgtatatgcatatatgcatataatatgtgcatctatatatttcatgtctatataaaataaaaatgtccccacaaatgttcatagcagcattattcataatagccaaaatatgcaaacaatccagtatctaagagctgatgatggattaaaatgtggcatatgattagaagactgacactacctaacttcacgacttacaataaagctgcagtgatcaagacagtgtggcattggtaaaggggtcaacaaatccatcagcggaacagagtagagatcccagaaatagacccatacagtctagtatctattgactaatagatatttgacaaaggagtaatgacatttcaagagaaaaagaccagacttttcaataagtaatgttggaacaattggacatccacactcaaaaaaatgaatctaagtacagactttctacctttcacaaaagtcaactcaaaataaatcagaaacccaaatataaaataagaagctattcaactcctagaatataacaaagaagaaaatatagatgaccttgaatttggtgatgactttttagatatagtaacaaaagcatgatccatattaaaaatgcagtaagttggacttcattagtaatataacttctgatctgtgaaaggcacttttaagatagtgaaaagataaaccacggattagaagaaaatattttcaaaatgcatatctgataaaggaataatattcaaaataaataaagaactcttaaaacttaatggtaagccaaaaaaaaaaaaaaaaaaaaaacccacacaatgataagaaagcaaacaacaaaattgaaaaacgggcaaaagatctgaactcagtttaccaaagaagatagatagatgtcaaataagcatatgaaaagatgctcaacattatatataattagagaattaattgcaaatgaaaatgaggtgcaactacacacctattagatcactaaaagccaaggcagggacaccaccaaatgctggtgaagatatagaacaacaggagctctcattcattgttggtgggaaattcatactagtatagccactttaaacattaatttggcagtattttacaaaataaacatactcagtccatatgatctagcaatcttcctcttggtatttacccaaatgtgttgaaaatttatgtggacataaaaatttgcatatgaatgtgtatagcagctttactgataagtagtaaaatctggaagcaaccaagatgtcctttagtaggtgaatttatgaacaccttggtacatctgtacgatggaatactattcaacaataaaaagcaatgagccatcaagccacaaaaaaaaaaaaaacacagagtaatcagacatgtatattggtaagagacaggggccaatctgaaaaggtacactctgtattagtccaactgtatgtacttctggaacagccaaaactataggacagtaaaaagataagtggttgccatggacatggatggaggagggagaaatacatagttaggtcataggggatttttaagatagaggaactattttgtatgatactgtaacaccagatagatacattttttcaaaacacatagattatacaacacaaagaaaaaattaatgtaacctatggactttagttaataataatgtcaatactggtactgtcaacaaggtcaatattggctcatcaaatgtaacaaatatatcacactaatgcaagatattaataattggagaaactgtggagggaggggaggggtgcatgtgggaactctgcactttatgctcaaattttctgtaaacctaaagttactcaaaaataaagtcaattaattatttaaaaaggaaaaaatgtgctatctttattctatggagtgttattcagctacaaaatgaaacagcatactgatggatgctgcaacatggatgaacgttgaaacatgctcaatgaaaaaagccagtgacaaaagacattatatgattccatttattatattaatgtccagaatggacaaaccaatagatacagagtgtagattactggttttcagtctctaaaatagggagaaatagagagagactgctaatagatttatttgggggatgataaaatgttataaaaatgtttggaataacaattgaaaattctgtgaatatactaaaaacattaaattgtacatttaaaaagggtaatgatatctaaattttatcttaatataattaatacaattgttaaaaaaaatcccccaaacaatattgacctaacacagtacaatttaataactggaacttcagtgtaattttattgaaagttaactaattcaagaaaaaaaaaggattttgtgcttagatgactaatcttttaaagatacagcagcaccaatcactaaaaacacattcaatttagaaaatattgtagttttcattggtgaattaatttgttaactgtattcaaaataaattgctaacgtgtcattgaagatttacaaaatattaacaaactacaaatcatattatcatgtaagacttgggaaatgttcatttatattaataatatggattcaaatctttatatgaaacaaaatgcatctatatttgattatggtggtatagtttctcattcgaatgggatctgagatgggagaaaccatattctacaacagtgctgtccaaaagaattttctgagatgacggaagtgttctgtttctgcattgtctaaattggcaggcactgcctgcatgtaggtactaagcctttgaatgtggttactgcaactgaggaactttatttttatttaattgcactgatgtaaattaaaatatatatttaaataccagctaggggtgctagtactgaaatcagctgagaaatgggaggagaaattcagtggcttctttttttctgcttcctcaattgctccccctcttcctaccctccttaccgtgattaaatagtatcagtcataaaacaagtgctaaatgaataggctaaaaaacaagtgatgatctttttctaaatctgcttacacatgtatttgctgtattagtaaaataatgagttttgattttaaattccttcatttctaatgcatgctaatcaaaatttagataagtgtgatataaaggtagcacttactatcagcattagcaagtatcagaaacatttagaaattcaaatgtttttctaggaaaatggtagaagttaatcaaccaatctcttcaagtaatgctctcatgtcaatgtattaattaaatcaaacatgaattattccctttcttatatataaacattctatctataatataaattagttaacagtggcacagaattaataacattcaagaaattcagtattttgttaagatctaagttatactgtttccctattgatatagattgtaggttgtttttatttggatttgctttgtttttattcccctgagtatacaatgacattcgctatctgatgtcagcttgagacttctcagggttgtctgtgtttatatagtttataagattgctgttgcctttcatgcatgtgttaggacaattgtttcctttctgccaaacctaatcaaggaattgttttgtctatcttctctctttctccaaaccacagcccactcaagaacagtttagcccctgaagtgggcataatattattcttgttcataaacacagttattttaaatcacgattgagagctgtgtgtcttatattaccatcatactttcatctgtgggaaaacccttttctctattacaaagactaatacctttcgatataagagatgacagcaacccaactctgaaataaaatcacttgtaacaagttgcctttggctaattgaggtcagctgcactgcatgttaaattctactttatagacagagagaggggaagggagaaggagacagcgggggtggagggcacggagagagggagaaggaggagagttaggaggaaagtgagaggggagagcgagagagcctgagaaaattctgcttgacacaattccttgtgcagcattgtgtatctcagggatgagaggaagattcaaactgcacctaccattgagagcttctgatttgacttggatacggagggaggatagaatcttgtaaaattgtaacagtgtcatgctagtattatttgtcactaccttgaattcattaactctttcccatgcaccgttccaggtattaggagtgagaaaaatgagatggccgctttaaaatttacattctagaagatgagttagaaaataggtgcaagatctaagtttattactgtatcaccttgcttccatgaagcaatttccttacccattacgttttgctatgtagcaaaccatactcaaagttggtagcttaaaacaacaaacatttttagctcacaattatgggggtccattgggcagttcctctggttgaactcagctgggctcattatgagtctgcagtcagctggcagtagctgacggattggctggcagttggataacctaggatgaactcattcccaagtctggcatttggcaggttgtcagatgtggcaaagatatgggcctgtaagcttcagcttcctcacacactgcaggaatgcaaaagcagcaatagccaaagctgcaaaatatcatgaatcctgggttcagaaccagaacaaggtcacttttgccataggcaagtcaaaatgccacagcacagtaaaaagtgtggaagatttaaaccccttgttttaataaggggtactgcaaagtattgtggcaatttttgacacacaactgcagtctccattgcaaatcttttagcattctgcaaccattattttccactaattgttatttctgttcattctcaagaggtgataatatttttaaattaagaaaaaatgaacacagtaaattatgtttctgtcgagcaatatgtgcataagagattaagcgaacaggcaaatgcccaaatggcacacaattatttcatggcagattaagaaagcttcagcaggtgctatttttaaaaccaagatgctcttctgtagtgacagatgctgctgctctggggatgtctttcaataacagaatactttcaccagaaaaagaatttaaactggtatgattgtgtccccagaacaaaggtactctaggcactagaaagccctaaagatactgcagttattgatcttggtttgctctttcaacgcatccacaaagaagagaatgtacacgtgtcacaattcataacatttgcaaggcactttggtgcaacagttcagaagcatttaataatttaagtttcattgattatgacattgcttccacggtatattccccaccaaaaccccataatcagctactattcaggaataaaatttttttcaattagcctctaggaaagaggggtttccaccacaggtctgggaaatctgcaaattttaaaatgcaatgtaactaaaacatacataatgtaacaggagtgcagtctgagtgaaatgatctgaaaagagagtataaagagtagaaaaatcgagtgctcaaacatagcagaatcctaaaagatcctagttacaatagtcatgtagctttctacagcatagagaccatcccctacttgatacctgcatccctgttatgaggtccatattgtgaaagcacttaggggggaaaaataattgtaataatggacagctcactagttttgtgtttgtaaagtttttaaattatctacttatgcatttatataactttttaaagtccacaatttaacattctctctgctagcaagaaaaacaatgtctggaggtattttgagttgtcacaagtgtggaggagagatgctactggcatccacttgggagaaaccaaggatgctgctgaacatcgtacagtgcacagcacagcctcccacaacaaacaatgatcaattccaaaatttcaatagtgctatagttaagaaacactgaattacattagaaagcatgtgaaatagactctactttgagaacaaatgtataatgtggctatacacaaccaaaagtcccagtgtgtaatttgttattattaacttaacaggtgtgatggttaataccgcgtgtcaatttgattggactgaaggatgcaaagtattaatcctgggtgtgtctgtgagagcgttgccaaaggagattaacatttgagtcagtgggctgggaaaggtagacccacccttaatctaggtgggcaaaatctaatcagctgccagctaagttaggataaaaggcagaagaatgtgaaaacactagactggcttagtctcccagcctacgtctcccatgctggatgtttcctgccttcaaacattggacttcaagttcttcagctttgggacttggactggcttccttgctccccagcttgcagacagcctattgtgggaccttgtaattgtgtaagtttaatactccttaataaactcccatatatatatgggagatatgtatatatatctcctattagtgctgtgcctctagagaagcctgactaataccaggatatggcttcactagtgaattctaccaaatatctaaaatagaattaacatcagttcttctccaactcttccaaaaaattgaaagaggaaggaacacttccaaactcattttttgaggctgacataaacctgataccaaagtcagacagtgacactagaataaaattacaggccaataaccctgaagaatatatgtgtaaaaatattgaacaaaatgctagcaaactctgtcagagtaagggtttagagagaaggactcatagaagatcacttagttctaaaagttcttttgggaaagtaactttcttcatttaacttttattttaaattattttagataagttaaataacagagagttacagatagtaagttcctctacatcttttacccagcttactgttaacatcttatgtaaccatagtgcatgtatcaaaaccaagaatttaacattgataccaagctaaaactataaattatttggatttcaacagttttgccactaacggcctttttctattctaaaattcaatctaggattccacattgcattgaattatcacgaccacatgaactttctcaatccgggatgatttctaagtttttccttgtcttttaggatcttgacactttttaagagtactaagagtttcctggagtgtctttcaatgtagatatctgaagatatctcatgattagattggggtgatgtatacttttagaaaagatcacatagggccgggtgcggtggctcatgcctgtaatcccagctctttgggaggctgaggagggcggaacaaaatgtcaggagttggagaccagcctgcccaatatggtgaaaccccgtctctactgaaaatacaaaaattagccaggtgtggtggtgggcccctgtagtcccagctacttgggagactgaggcaggagaatcacatgaacctaggaggtggagctggcagtgagctgagatcgcgccattacactccagcctgggtgacagagcaagactccaactcaattaaaaaaaaaaaaatgatcacagaagagaagtctcaatgaacccttctcattgcatcaaatcagtgcattatacacacatacgtatgacatgtcctcagcttgcagacagtctatagtgggaccgtgtaattgtgtgtgtgttttgttattatagtgttccaactttggtcatttgaaatcctttccatttggcctctgcccaatttctccttagtttctttaagtaatattttcccttcctgtattatattgaatagaaatgagtcacttaatctgaccaatactcaagggaaaaggaattaagcttcactttctggagagaaaaatatcaaataatttgtaaataggttaaagccaccaaagaaaccaatattttgtcagagatatatccaagctatgcaaataatctatatctgaaaatatgcccattaattttaccatttctcagtggatcttgcctgaagtagttattactgaggcatttcaatggagattttattttttctacaaattatttggaattcttataaaagaaaaatattctttgtccaccatttatgtatttattcaatcatttgtttatacaaattttgatgcatacgtatttatttcatgtgttgtaatcaactattattattcattttattgtttatatgatggagctttatcattctgacatacctctatcctttcttttacctaaagcatccatttacttttttggtcccacaagatattgcaggcttattgtgttttccctcctccagctctagaatgagccatttctccaaggatctctgatcccttttattgaagaatgatatttagaaatcaagatctggattctagttatgttcattgctactgtggtgtcattacttctaggtcctgtcaaagaagagaaataggaaatacgctggcttatactaacccacacatatcaaggcttctgtttttttggtaacatcactttgtggaggtatgactgacttgtaaaaagctatgcatatctaatgcttacattagattaatttagagataaatatgcaccatgaaatcatcaccactatcaaggccatagacatctccatcaatttaaaaagtttccttctgcttgtataatcatcataattaacactattgattaaaaaccctttacataacatctactgtcttagcaagttttaagtatacaatacagtagtgctagctataggtactatgttgcatagtagagctcaaaaacttattttatgtgtcagataaactctacagttctactatttccacttttccagttccatttatacattgagataccatatttatttttgcataataaacatattttctttgtctctcttgtatatgtccttagatgtttttattatatgtgctcgaaaatctttttctgcaaatgccaacacctaggatatcttaagatcagtttgtattgacttttcttcccctttaggctttgagtcacatttttctgttccctgcatgtttagtaattcttttattgcatatcaaatactgtgtattctatacactagtgattctggatgtctcaattgtcttcctctaaagaatgttaaattgtcttatggtaggcagctgacttgtctagttttgaactgcaaactctactgctcctgtagtaggaaactgctaaaacttctgcttaattccctcatcctgtgttcttatagcatcccacctgaccccttggaatttcttccttgtaaaaacatctcaatgtcagacatggagacaggctgagtttataaataaatttgcaggcttcttcctcaaagtctttctgttttctgggactttatttaatttttagtatatctgttggccccagactcagtcctctaatgtctcaacccagtaggactcttgttttgtgttctaatcactctatgccctgagccagagaggatacccaaggtaaactgttgtgtcaatctgaataatctccattataatttctttaaggttcaacttctttccagattttgctaactttttcttgcctgctcatgccttcaaatagattttaaaaacatatttatcattgtgtacatttattgtttatggaagggttatgctaataaaatcaacacctttattacaagaattagaactccctttagtagacttttgcttataaaatcatgttctcaaaataaagaaaaaaatgaattttttctaatcttgggtcacatcagttgtgttttgtacattattatttattctttaaaatatatcactgtagattttgcattttccagggctatttggaggtgcttaagtcaaaatttactgcttctctctattatgatgtcttattattttttaacatataaaacagaaaaatagccagccgtaagagatgacttttaatataaataacaattcttacaatgccaaaatatcttttacaaaaggtggttataaggtatcattcttagattaggcatttcattatctaaagagagtatgcatctgattgatgaacacactgagacagattcatttacaccgttaactcatttatcctctttaaaaagtataattttcagagagtattatactatattggtaataataattacagctgtattgtcaagttcctgtatacctggtcttatttttaggactagacatacattatttcgtttaatttctataacttaaggtgtgtattgaatctgtctttcataaattaccatacttttgacaggaaaatgaaatttttccaatgtctccaataaagggagaagtagaaccaggagttcagagaggagcaaggagattagaggtggaaaaatgccacagagaagacctatggaaatttacaacatatagaaatactcaagaaattatattgcttttactgaatagtgacattagcaagatggtagaataagaccattttagccccaaagaaacagatattcacaaacaccgatgggcaggaatacccctttaggaacccaggagtccagaagatagcactctattttagcaaaaacttgaacaagagacactttttttttttttttaaagacagggtctcactttgtcacctaggctggagtgcagtggcacgatctcggctcactgtaaccttgacctcctgggctcaagtgatcctcccacctcagccccctgcaagtggctgggactacaggcatgcagcaccttgcctggctaatttttgtatttttttgtagagacaggctttcgccatgttcccaggctggttttgaactcctgagctcaaacaatctgcccacctcagcctcccaaagtacctggattataggcatgagccactacatgtggccacaatacactttgaggagaaataagaatgtcaccgaggggtgtaggagttcttggttcttgtcttgtgagaaagaatttggccaagagacaattagtaaagtaaacaaaggtttatcgaaggaaaataaagagcggagagtttattgaaggatagacgatcccagagaggagtgggctgacccgactgggagcagaaacactagcagaaaggctttagtggtagcagagttcatttaaagagggagagtagtttgcttgaaagagaatgggctggcagccccaagttcaacattgtggtttttattatattggactctttctttaagctcctgcttctgtcgtaagtctttgttttgtctttgtctagtttcattcttcagcctttagtccccaccttttccccatctagttactgccccagatttgtgggattctcccttactatcagctgatgcccgtgtgcaggcctgatgttggatacaagtccagcctaatggtggcattgctcattactgccatcccaggaaggtcatatagccattcattctgtacttattgcacctgcgtatctcttaggaatttcttctttgccctctttctctccttatcagcatgtagctagctgcattctgataggttaactgcagagagagcaattactgggcatcttaaggagcattttgggggtgagtttttctgcatagatatgtcccttcctctctgctcatatctagcatgaatatttctgatactgtctggggtgtgacattttccagacctcctctttttaggggcttctcttcctactcatatctagctgtctgcctactctaacaagaatagtttcagtttacttgcatcatccctctcacaagacagcacagctcaatgtcatgagataaaccaagtgaacaaacttctagctagactaagataaaagagaaaagactcaaataataaaattataaatgaagaagagattttttggatataacaccaaaagcaaaggaatcaagaacaaaaagaaataaatgagaccacaagaaactaaaatgattttgtgtaataaataatcaacatgagagaaaatcaactttaaagaatgagaggaaatatttgcaaaccacatatgtgatagagttaatattcaaatgatctaaggaattcatatgactcaatagcaaacaaaaaaccaaataactcaatttaaaaatggcctaacctcaatagacacttctcaaaagaagacataaaaaggacaaacaggtatatgaaaaggtgttcaaaatcactaatcatcagggaaatgcaaatcaaaaccacaatgagacatcaccttacacctctgaaaatggattttatcagagacaaaagcggtaagtgttggtgaagatgtgtataaaaatgatgccttgtatgatgttaggagtaatgtcaactggttcagccattatggaaaaaatatgaagattcctcaaaaattaaaaatagaactttcatatgaatcagcaatctcacttcggaatgtttatccaaaggaactgaaatcagggtcttgaagagacaatcacagtcatattcattgcgatattcacattagcaatatggaaacaccgaagtgttcactggatagatgaattgataaacaaagtatggtataaattctagcactttgggaggctgaggtgcaaggatcacttgagcccagaggttgaggctgcagtgagccatgattcctgcattctaggtgacagagcaagacaatgtgcttaaaaaagaaaagaaaagaaaactccagaagaaaataacatgtgatatatgcatataaggaaatatcattttattttattttttattttatttttgtgttgttgccatttgcaacaacaaaagagataacaaaatgttgccatttgcaacaacacaaaaggacctggagatcattatgctaaatgaaataagccatacacagaaagacaaatgctgtattatctaacttatgttacagtctcaccaatgcaccacaatgtagcagtctctcattgcctgaggtatcaccccgagtcctttgtctcatgaccaagaaggttaaggagcataaacaccaagggtgaggttggagcaaaagtttaacaagcgaaagaacaaagctctttgctgtggagagggggcccagaaggctttcacaagatgaatgcaaacgctttttttatagttgaatgcgaaggctttcacaagaaaccaatgaggggctgggcatcttatttgcataagatgtgaatttctggtagctccaccccatcctcctagtgcgcatgaatgcctgtagcttgagttactccatattgctttgttccccttactgcacatgtgtcagacagaattttccattgtgagcatgtctgggcaagtcacctgtgtggcccttcttatcttgcagctgtgggcatgtcttaggcaacacctcctgtgcaagttcccttatctgtccctgcagggtgttcttttgcttgaaataattcaaacaaggacacaccctaactgcctgcctaactggtttcttcctttctcctctctgtcttatacctagtatataaaacagtcagactcatagaagcagagagtagaatgacgggggatggcggaaaggaatatggggagattttggtcaaggggtacaaagttaatacaagatgaatatgttctgctgatctaaagtttagtatgttaactataggtagcatgtgagacttgattgtaagtgttctcatcacaaacacgagaaaaaagttaactgtatgaaatgatggatgtcaaaagtaaagtagaggttcctcttcaaaaactttcctccccatctaattaggaataaatagtaacatctcttagaaacaaaatttattcaaagacctgtgctaacattcttaaatatctactagccataataaagaaatcaatgtactttatgttcttagctcccacaatttagcctaaatatttgccttggcatgcttatactgttctaagcaagcatttggtcatagcctgttcctcttccttatttgaagatgtttcattgcctttctcagcattccacaagttacttcctccttcctttgctctcctctgcctttgtctcttttaaaaagttctaagttgctagccaattgggacaaatacagaatgtggggtcctattccagccaatggaaactggacacaccagtaggatgatgtgtcaagttatagattaccctgtctcctttgttcagtgtactctcatggcaaaactgctggtgagtgtaccctttctgcagaaagtataaaaatggccttgctgaggaaattaaatttatgttcaagtgctatttctttatggcaccagagaacaagcatttcaaacatggacatgttaattatcttgtttgtggtgattttttcacaatgtgtatgtacatcaaatcattaggctgtataccttaaatatatacaatgaaaaacaaattaaagctttaccagatttcacaagacaaatgacagctagttcctcattttaaatcaatgtaataatgaacagtccagattcatgattaagatctaaatgttatttatagaacaagcaatgagccctgtgattctgtaattaataattttttacatatacatacatatgataccacctttccaaaagttatatcagtgagaaaattttaacagtaagctaagctaacccaacccccatcttgcccttcctttaattattcctgggctattgggccaggctaactttgtaagacatttaggctacagtttaaatgataataggtcttgcccaaaactcaaccacttttgtaaagctaatgggaggccagtaggctgggggaaggaggtgaacctgagtcctgctaaagcacagacataaatgatggtcagtcatttactcctgaggttctgcgatatacaacttccccaattactccttcaaataacatcactattgtatatgggccttttgagatatctttccaggtttttgcaagtttgacacccatggctccaccttgactgccagtccagctccagtggccccagccagaagcaattcagccctcaggagagctctgaccaccccccaccatgagttcatctccaccccaaccaattagcagcaagcacctgttacctgactacctccaccccttcccctaaactgccattgaaaaacccctaacctatgagctttcaattagattatttgagtatgaactccatcttccatgtggtttggctggcctagtgcttattaaactctttctctataacaatgccatggtctttctttatgcagtgggcaggaagaatcccatggttggctgtgtgtatgtgtatatatatatttgtattttgttcccattttctggcatgtaactactaaaacccttgttatccaaagggataagtgtctttttgtatgctaatgagatgactgaaggctggggcttctggatagccttgaattggagtctggttgccagagaaaccaatcatataattagagggctggaagtttcagtcgtaatcctgacctccatggaaaggagaggggctgaaggttgagctcctcaccaatggccaatgatttaatctattatgcttatgttgacaaaaaagaagccaaattctgcaaaatattttaagaggtttattgtgagccaaatatgagtgattatggtccatcttacagactgaagagttcctgagaatatgtgcccaagatggttgggttgtagcttggttttatacatcttaggaagacagaagtcacaggttaagacacaaaagggatacactggttcggccttgaaaagtgagataacttgaagtgcagagaatcaaagatcttttgattggcaattggttgaaagagttaagctttgccttaacctgagaagttgaaatcagcattaaaaaaattatgtgttaagataaggggtgttgggcaagccaagattctttttatgtaaatgaagctcccaggtagcaggcttcagaggaaatagatggtaaaagtctcttacaggactttaaaaagtgtcagacttagctaaatctctcctggatcaggtaatgacctggaaaggaaggggattctctacaaaatgcaaacttcccccataagagatggctttgcagggtcatttcaaaatatgtcaaagaaatacattttggggtaaaatactttgatttccttcagggcctgctgtcacgtgatgctaaaccatggtcaggttggaattaggtatcttattgctacaaagagtcgattgtcagtcttaaaatcgctgatctctattttaatgttaatgctggtcagttgtgcctaaactccaaggggaggagggtgtgatgaagcatgttccacctctcttattgtcatccctgaaatagtttttcaggtttcttaggcatccccttggccaaggtgggggggtggcgtctattcagtcaatagtgaggcttagaattttatttttagttcatatctacttaatgaatccttcataaaaccccaaaagggacaggtccatagagcttctggatagctgaacacatggaggtatctagagggtggcattcccaaggaggccaaataagccccacaccctttctcccataccttgccctacacatctcttccatctgtctgtccatctgtatcttctctaacagtctttttaagaaatgagtaacaataaataaaatgtttccctgaactcaagcaaattaatcaaacccaaagagagggtcatgggaaccttgacttacagctggtcagttagaggtataggtcacaacctgggacttttcgttggcatccgatgtgggggcagtcttgtaacactaaaccctcaacctgtgggatcttcagagctctctgttgacaagctcaggaaatgtgcccacaactcaatctgagtcactgctatcacatgttggaaaatcagcatggattctgtcaaaaactcaggcttgcacttcttatgtgcggacatgcactcattactttattaattcatttaaacatctatgttttataatagccagaacatttaagctatatagcttatgatggcacactatttattttacatttattggttaaacaattattctagactaacaatttttgaaaaggtttattttacttaagaaattctaagtgatatctaaatatctgatcattataggatatttcaagacaatccatgtgttacagtatatttgtctatgaggtataagctcttttaaaacttagttctctctcaattatctcagattttaaaataaatgatttttcttttcaaagaaactcatgcttcggatttattccaaaaatattttaagcttcaatctctctccctctctctctcttcccccacttgtctttccttaaataagaaaggattaaggcattaattaaaatatgaaagtctatagaagacttgcccacctaacaatacaaaatgtctaatcatgaaaaggaatattttgcttacagaatgactaattacaaactaaatattaatgcaagcatattctttttaagtgtattgtaaggtttgtttaaaattcccttaaattgaataatttttatactaactgaagttcatgtatttcagttacatcaagttcatgtaactgaacttcaagaataaaatattgtgtgaactctaaaacctaaagtgtggaactgtattttactttgaatcatagtcctatctctacctcgttctatgggagagagattttataacatattagataacctccatgcatgtaaatgtagttcagtttgatgacatttctcttagggaaaatttaaaaatagtacaattagttaaaccttaccttttagggcaagaaaaagggatagagttcttaattctatagaaagccagagggatatagatcatataagtacaagttggctattatttctttttcttttctgctttctgaaagtgaaataaagctgtatcgatgaaacaaaggagaagtcacatgttgcataaatctcttttacattttattctggttggaaaaccaactatcagttacttggctttctacaatcatctacatttttaatttacttttaatatccttgagcttattccataagaaacacaaaactaaaccaaataacctaaacaaattaaatgtctattctttgacatgcaaaatggattgaggtcttcggttttattattatttaaaatgtcagcaatgttttgcctgctgggagcatgcattttctatttttcaatctttctcaaaacaacttattgcatgtttcatgaatcatgatggccagggatcttagttgatgtttttcaaaattaaaaaataaacaaacgtggtgctcatggtggcattttcttaagtggctgtggcacatgtagtgttgtccagtgtttctagaaaacaatgcaatgaaagaaacattcttgtaataattattctattgtgtgtgaccttcagatgcagaaataataggaattcattgagggagcaatctgagttccctaacagattaattatccattaaatctggaaacataaataatgatatggttattattaatttcaacatggaaaatgtatctgataacataatgtagatatgcctaatttcgatccttggggatacctgtatactcagttcatgggctgtcctttcattttctgtggcatcatctatgacttatttattattatttttctttctctctctcccctcccatgaactccattttgagagttagcatcatattaccatcatcatggagatagatataatatcgggaagcttttccaaactaagtgggctgcagaaatcatcatggtggacggaacacagcctagcccacccacaaaaggctttgtaatccctgaccctctcagctactgagcagcatgtactagtggcttaatagcatctacttttctgcatacagattccagctcccagtggacgttcagcccctaatagaagtagataactaatgtgaagtggttcattaacactgtatttactatgatttctggcaacccaaatggctttggctctaataatagtataatactgcctcgttccactgggtttcaatgggttctcttccaacccattttcaatttagttgttctgattatttatttcagagtaaggcaaaatctacaaaaaacatcagtaattgtttttccaaattacaactttgtaagattgcctcccagaagacatagggaggacagggtgcaatctctatgtaaaaagaaaaatatggatgggaaaaggtaaaaattcagtatgacttatcacatactaaaatcaaaacaatgtttctgagaaagtaatgctatgttaggaaataaactggaaagattttgggggcatagtcttgcatacacttcagccttgggatccaaatgtcaaaattatatccatatctatatctatgtctatatccgtatctgtaacatctatgtttttactctgcagtcttaattcctttccaggctgcacatagagggcactcagactttttttttttttttttttaacctgggaaatctaatattttatttctggatgattctttagaatccaagtgcttgattattattattattattattttggatggagtgtcactctgtcacccaggctggagtccagtggtgccatctcggctcactgcaagctctgcctcccgggttcacgccgttctcctgcctcagcctcccgaatagctgggactacaggcgcccgccaccacgcccggctaattttttgtatttttagtagagacggggtttcaccgtgttagccaggatggtctcgatctcctgaccttgtgatctgcccacctcagcctccgcaaagtgctgggattacaggcgtgagccaccgcgcccggctgattattgtttttaacaatggaataatcataatacagataatcattttagatcacaattccattttccaagccgtaaacctagactgtagatagagactgttgacatacacaaagccaaaaaacaggcaggaaaacaaagggacaagaataagtgaataaatagaagacaagatggtagatttaaaacacagccttattaataatcacttaaaattaaatggtttacatagcccaattaaaagactatcagtttggctcaaaaagcaagacacgggcatttgtggtcttaataaaatccacttgaaatacaaagaaagacagaaattggttaaaaggatggaaaagaagagcactctaacactaattatatcaaagctagagtggctatataaatatcataaagctagatttcagagcaaaggatattatcggaataaagacagccattttgtttttcttcttttttttttttgagatggagtctcgctctgtcgcccaggctggagtgcagtggcgcgatctcggctcactgcaagctccgcctgccgggttcacgccattctcctgcctcagcctcctgagtagctgggactacaggcgcctgccaccactcccagctaattttgtttttgtatttttagtagcgacggagtttcaccgtgttagctagaatggtctcgatctcctgacctcgtgatctgcccaccccgtactcccacagtgctgggattacaggtgtgagccactgcgcctggccaagacagccattttcaaatgacgttgataatgacagtttattaaacacatacaacaaatctgaatgtttgtgctcctctgtgcaggtctctcctctcctgtattctgccctgggaactctagctgcctttgcttccactgactctcagctctgctcaactttaggagactgccagcctctactgggtggggaccttgccataccatgacttagatatgctctcccagcagtaaactgttaatcatagagttcattgtgtgcattcttattttcaggggtcattgtcttctgacgcctgatgtccaatgtcttgaaaactgttgtttcatgtattttattttttaagttgttttgtgcagggaggcaaatatagctctactttctcctttgctgcaactgaaatctcctatttatttctaaatttattttagtgattcatttgctcaacaaatctatactgaatggtggagactctctctctctctttctcacatgcacacacacacacacacacacaaacacacacacacaccccacatgtttgtcaccccccaaaatttataaatttacttcttgaaagcaaattccccaatgtgatggtatttggagatggggatttttgaaggtgatcagatcatgaggatggatctgttatgaatgagatccatgcccttatataaggtgcttcagagagctctttcccccttctgcagtgtgaagacacagtgaagagaaggctgtgaaccaggagtgggtccccagtagacacaatatctgctagcacttgtatcttggacttcccagacttcagaactataaaaaaataattttgttgttttataatctttccagtatatggtatttttattatagtagcccaaatggactaagacatgtatatattctctctcataaagatatgaaagagataagagagagacagagacagacagatgggggagggcagagggagagaggaagagagagagagagagagagagagagagagagaaacctcacacactaagctagtccccaagaataaagaaaaactgaaatataggccctggcattgtaagcttatagctctgtggaaaattaaaaaaaaagaattagaaaatagtgtaatatagggtaaaaaaataaacaactaagtaaaaatcattgttttgtaaggagagtatgataggagatgatgtttgagcctcctttggggtctagggaaagaaatgtgagtgacggattctaagaggaaactgtgctcgtgtgcatagttgcagaatcatttgaaagcgtgacactttaaaaaaaattaagtcccttctttgtaaatttagacacgggtcctgctatgttgcccaggctggaatgcagtggctattcataggcacgatcatagcacactgtagcctcgaactcctagcctcaagtatttctcctgccttagactcctgagcagctgggactacaggcacatggcactacacccagcttggaagcatggcactttaaatggacatggaatcaaagaatatacttgggggaaattagcatataatgccagaaagctgacagatcatgaagaacctggtatgaatcctaaggcgtctgagcttcatactctgagatttaggaagccatcatgggattttaaacagggaagaaacaattgatttgcattttagtaaaatcatactgataatgcagagatatggataataagaaactagactgaagtcaataggtttgtggttcttgtagtaattcagttgggaaaaaatacattggtaacttctgtggttaataaagagttgacagcttgagaaaaaatgtctaatgcaaattcaacatctattggtgacaattagatgtgagatttgagaaaaaaaattaaaggaatttctgtgcttggatactaaagatagtgatgccatatacggggatgatgaatactgaatgagattgtggaaggagaagagaagttctggatagaatgtgttgatttatggagctaatggattttctgctgaagatgaacaggagattgttagaaagaccaagtagagatactcttttaaaacccaagccagtcattttttcacaagtagtagtggtatatgtttcacagcagagatgaggcaaaagatggttctggagacatgaaatcgggaagggttacaggagagtaaattagaaagaacagggacatggtgcagggaagagaggggagagatgacacacaaatttaaaaagttcatttttcacaaaccttgtgcttggttttgaaggctatgaaatcagttcaagttccttgttctcaataggatatctctgctaatttttatggaaacttggattcatattaatggggttttacagaagagtgcaatgggtttggggtagctgttttaatgccacaaggggcaggcatctccagtgctgttgtttataatggctccgtatggccaccaatgagcagcatggtggatatggatgagaacctctatcataaaggttttcaccaagctcctatagctcagtggttaactttaaagccccatcaccactcaaatcagctgtcattgtatatatcactatccatgtcacccttccaccttgaattttttcgggactaagctgtttggaaccaggccagcaagcaatgccagaacacagaactctcgaggagaaccaagcacattctcccagaaaactcgcagctcatgaagtcaaggggaatgatggaagaaaggcacaatcattataaatggtgagtagagtgaagagaggcagatttcttgcctcagagccacagcggggacatcagtcatcttgtagctttccccaaaagcttggccagcaacaatgacacctgtacttaaccaccaagatgatatatgatctaatttcaaccttaaaataggggcttgctccagagtaaacaagtcacaactgttatatccaccatctttgcccttcttggttgtttggtaagctggaaatggggggtgggggggctagaatggctattgcttattaatatgcagtagtaaaaagcttaaatgatagaaagaaaacaatcaaacctctgctttgattccttcctttcttcttcctgcctttgtttttccctctctttcccccttttcccccacctctctctcttttattcttttttcccctctttccttctttttggtttaaataaaaatcgcatcccagatgggattgaaataaagttctccatgcttgtaagtggcagaatacaatttctgttcttaatttccttgtagagaatttaatgagaaaaatttgggaactctgtaattcccagtagtacaatgtactatgcttacaagtctcactccatctagaagcaaagagctgctgtgtgagcaaaaagaatgggaacactttacaggtatcctgatgtctgcatgacaaagaactagaacaagagacaaaatgagaaatgtagcaatagacaggcttgttcaatataaaattaaaaggtaagggcagctgattctgagcaagtgctttgaaccaaccaggaatcatgcctcaaagtcagttaaatccacaagctcccaaacagcacttctgaccacaaattaaggacagtcacgtaagtataatatagaaagaacagatgagcacccactagtctccttaacaacacaaagattggtgacaaatgcatcataaatatacatcataaatagagattattaactatctcagatctgaagcagtaaaaaaaaaaaaaaatcaccaaattcattattcatctgtctgtccatcaagggcaatattttgtttgcaatgtgatggtctagcttaattaaggcattagtgtccattaaaatgtgtttttgttttcacatttttgttttaacttcatgtattttatcacttcaaatcaagacttccctcaagttctgtttttacaattaactattaattttgagcatgtgaaaaataaatttttcacaggagaagaaagtagacccctgctttgttaatttgctgaatgtccctctttccctttaattcatcgatttactgaatgttcttcttaactcaaggtacttgacagagtttcatctgaagcttcactattttgtgacttcagaatatgcatgatctgggttatctatcactgaataaaagttgttgagggttattcaaattgtccatttaagagtgcaaaagaaaggtatatctaatggaaaatcacttgcttgtcttccatgcttttattaagcaaacgcacaactagcttctttagtactccaggcaatttatattctcaagcgctatttgttgcctgtttaaaatatgtcttcataataaagaattcaatggaatcattggctggttttcctggatacttaatcagtgcacttatctcatatacagtcattatttcctcagcttgctttttagaaatacaatgtaagggaaaaagacacaagaaaatctctagttgagtgttactagtaggaaaaatgcagagggtcattacaatcttgataaataaaaggcccttaggaatgaggcccccgtaaactgcccattccccaggctttctcctgccattggttggcatgtcttccatgggtcaagtgttttatttgccttcattccattggaagacttttatctaagtgtagtagtgatgactgaattctggctcttgtgcatgacaaaggagccaatgtcatcagaccatgaggctgttctgaggttaacttctatggtcagtcttgaggaccctatgtcccctctgtcatgagtctaccaccaacaggactctcattgatttttcacaaaaatataatatttaaatatacctggatgacagaaatactggaaagatgtagtctatctcttttctatctatagaaaatttcaatatactatacaaagcatgtgtgtttatatttatatttatataaatataaatttttatatttcattcttatttcataagtgagatgttcgaaaaagcaaaagattaaaaagaacttgtagatggacatttacctttgttcatttctcccccctttgtctgggcagcatgacatttattaaactagagttctaagttgtaagtcagcttccctgctttcatcctctttgtgaatgtttcagaatttagacttctacttaatgtagtaggatggatagcattatcacttgatagacagcaacctaggctctcctactattggcattttttatattccttctaattttctgctatatgtgaagttccctttactgcttatattcttataatgcgctcatttttcaaatattcttattctaagatcatattttcagggtaacagcatttacccagaggagttatttgaagagtgaacagagttgtgtttcaaatgcagccttctcaagttagttcccttcaactttgctttctgtcatgtaggacctgagtttaacatggctggagaaagaactcagatacagcagactagagtttacagttataaatgaaggggatagttataaatgaaggagagagagacagagagatagagaaagtgagagagggagagaaagagagagagagtgggagagagagacagagagaagagaagatgagagaggctcagctagtgaaatggaatgcttttagacactcttaagactctcatttcaccaagcctctgtttcatttttttcacaactctccagttaagaaagcaagatgaatatctaaaaattaatccaagcacatattgttacagtagattgttaggcagacatgagcagggaaggagagggcccccacccccagaaatgttcaggtgaccatcaggtgatggtcaggtggttgttaaaagtctgtctaaaataataattggttgcagccagcaccagggaaaggcaggctcccaacagacagaaaacacctgaaactgatgatcagccgcttccaggtaagttctcaggagttgggcaagtgggctcaagcatgtgcattaagaggcaaaatggtggagtttaactggtatatggccttcctctaggacactcaactggtaaaggaaaacacctcaagtgagcctgtgctcaacttcagtaaacacactgtgcacgctcacctcccaagtgctgacaggccactgcacatgcagacagcccaccccaagggaagaatcaagggagaagtaacgcaaccccagaagcatgccaatgtataagacccaagtctaaggtcaaactgctgacttaaatctttcaagtcacccacttggccttcttccaagtgtactttgcctcctatcattcctgttctaaaactttttattttattttattttattttatttttttaaacggagtctcgctctgtcacctacgctggagtgcagtggtgcgatctcggctcactgtaagctctgcctcctgggttcacgccattctcctgcctcagcctccccagtagctgggactacaggtgcctccacgacgccaggctaattttttttttttttttgtatttttagtagagacggggtttcactgtgttagccaggatggtctcgatctcctgacctggtgatccacccgcctcagcctcctaaagtgcagggattacaggcgtgagccactgcgcccgaccctaaaactttttgataaatgtctctcttgttctgaaacttgcctctgtctctcactctgccttatgcttcttggtcaaattctttctttcagaaaggtaagaatttagattgctgcagactcatatggatttgctgctgcttacaatatcacacatgatttacctaatatttaagtgtggaaacactgggcaaaaagacaatgaaatgcatcagtagagaaactctaaagataaatgaaggaaaacagtaacagcaacaacaacacataattttagacaacctgtgctagactatgatccttggaggacatgaggaatcactggaagaaatggttttaaaagatgtaagacagaaaaaaatgtccagagagaaggctttcatgaataatagggccattatccataggcaaatcttactttaatagtgagctattaggagtgtttatattttcataagattcgtattttacatttttttaatcctttgccaataatgagatgataaataagaaattagggagacagagaaatacgagaaagacacaataggcaacgaagagggaagaagctaggcagagacatacagaagccctctgttatctactaggatatgttccatgactccagtggatgcctgagatcgcagatagtcctgaactccacatgtattatgtttatacgatgtgataaataagagggctccgaagtgactaatgagcaggtatggtatacagcatggatacactggacaaaggtacgattcacatcctgggtgggccagagcaggacagtgtgagatttcatcatgctactgggaacaatttaaaagttctgtattatttctggaattttccacttaatatttttggattatggttgaccttgggtaactgaaatcccattaagcaaaactggtgataaaggagactgttgtatacatattgatcagcattgccttaatgtttccctcagcttgattaaactttggagaggattccttccgtccctagactcctgacttcctttttcttagagcatttactttagaaactcatacttataaatcctttttctgcgcctttgagatgtagatcattttaaaagcatcttgcgcactttgggaggccgaggcgggcggatcacgaggtcaggagatcgagaccatcccggctaaaacggtgaaaccccgtctctactaaaaatacaaaaaaaaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaaaaaaaaaaaaaaaaaaaaagcatcttgccagttttatcatccaggaatgtcttcctcaaaaacctagcatcatctctttgaagtataatcatcaaggaagagagtggccatatctttcattttctgtgggagctgagggctttaacccaagttgtacaactacctcaggtagtaatgaagatatcagaaggtttactttttctttgggtaatgccaattagcaaacatagatggcctatgatcgctccctcatcccagttcttaaaactccacttctttttttagttattattatttgtttgtttcagtgagttaagttcagactcatttttggtctttttcctctattgcaatagccttcaataatgtccttcttgcctaatattgcccagttcacttttggtttgacatatataataaagataatcccatctgcctttttcttcctattttcatcttgatgcaacagagaatgaatagactttgaataaatatggaactggcctctgctttgtaacataccggctgtatccttagacaccatcgttgagcctctctctcttaatttataaaacaaactatcatgcatggttattatgagaatacatgcaaaatttctggtgcaaaaaaccagtaaacagtccctgactgcatttttaatcaacaaatatgttgtgtgccctaaggcacatgttctaaatgcaactcttaagtacctttcagttgttgtatcagtgaggaatatgctgacaacggagacttactttttgaaaaacaaaaaaaaaatgtagctttctcatgggcaactgcctttctggaattagaagaggttcagtgttaagatggactacttggagtggatattgtattatcatcttcatgtcacatagaagtcacacatttgtgatcaaaaacacacttattccaaataaaattggctttctatctggtattttccctgtcctgcattttattttgtcagaaatgatggaattgtacacacacacacacatacatgtgtgtgcatatctatatctacatattatgaaaaccaaagtaaataagttggttatgaaagtggttcctaagctagcatgctgattttgtataagtgactatatccatatctgacagatgtaatgcagcagtccagttttactcaatgtgaaaggcagagacagttaaactctaacatgatctctatgtagctttatatttttgtttatagcaggttattttcctaggtgaattttattctagcagtgtaaaaatggacaaatatatcataatatagttgttcacctatatgaagccttaattctattactgagtatgtactcaggggcaacctgtctttgggaacatggcaggttctgtctctttctgtcaggagaggtttgaaacattgactggaagttacctagaagccctggaaatagtggtgctgtgtaactgtccctggctgtaacacagaagtgttagaatgatatggtagatattgcccttagtgaattactcctacaacttttcaaggtatttaactaacatagttaccaagtgacagatcaaatatccccctggtagagaagtaaagttagatagcttacctatcaatagtaatgggcttatattttttttaatgagccgattttttccttcacaatggcagagctaaactcctttattaaacattaagtttgcaagagcccacccaaggcttcctacaaaacttgatcattcttggcactttatgacttctttccttcttctccttctgcttcttcttccccttcctcttgttcttcttcatctcctccccctccccctccctctccctcctcttcttcttcctcctcttcctcttcctcttcctgctcctcttccctctaaagcctctttcttcttctctaccatattgataaaaaatgtgtttaccatgcaacagatacactatatactaggctaagtagtttactggcattatctcatttccttctcaggaaaaatgtctatgaagtaggcaatctcactgtagccattatacaaatgaaatagagtgagttctgcaacttgcagaaagctacaaagtttctaagtgccagaaatgggaatgtctaaatctaaagacaggggctttaaccactgtttcataacacttctcatctgaatgtgtcaatgcagatgtcttggtacaagctgatgtgattaattaacttcttgtttcatccttgaatataatagcaaaaattagttacatggtggtgcgtgcctgtggtcccagcactcaagaggctgaggtgggagggatccctggagcccaggaggcagaggttgcagggggctgacattgcagctcactgcactccagcctgggtgacagagtgacatcccatctcaaaacaacagagaaaaaaaggaaaagaataacaatttaaaataataaaataagatggtagtagcattaatgtactgagagtaggactggcttaggaatgcacaaaagaaatattcttaatcaagagtaacaaatcagcgtcagcattgggaagaaaatccagagaattaatgcctaatctgtttcaataaacaggtaaaagaaagaaaagtaattgctttcggaaggtttattgggcaagggagggggttaagcaagatacctatgcctttcctactattactgttaataaatattttaatgcaattttatattaccattcatgaaaattaatttttggaaggaaaagaccaaaataacaaggagttaaaaataaactggaaagcctggaacttcttcttccgaccttgatgctatagctgaaactggacttaactctcctgctttcaacaaagagaaaacaacaaagtaagtgtaacaacttttttcaattgtcagccaacaggccatgcaagactctgatccctgatggaaagataattagcataatgtcagtcctataattatcctggctagcgataatttctagatcacaatttgagaagcagagtgatgtaacttagtaggtttgctgagttgaactcagagtttagagtgcaggaagaatatcagaaatctacattcaagtccttgtgatcttagggttaactactaagaaacgtacgcgaaactccatgagactgagcaaagaattaacaagaaactgaaagctaaataaatccaagagttcacaccgggattggggattttcaagttttaaccaactagaggggagagtcgttatgaacagctggcatattcagtaggaacccaagaagcatttgtagtgtcaaactagctaacaaataaaggctactctaaacttatcccaatgaagccaaaattgatcttgaaagaattaagcttttccataagtaatttaattgcctgctagatcaaagttcagtgacctgtaaatgtagaaagaacataaaatcaagcatacaacttcagaaaattcggtttgcaacaatgaaaaatgactaatcatgagaagaaatttaaaatatttaccatacccaagagagaaattaatcataagaaacatgctaaaaataagaggtattatgggatttgcagagaaggatgttattatatttattataaataaatccagtgaattaaaggaaaaacaaagataatgcacagagaaatgggtaattttaaaagtaacctaatagaatttgtagagatgaaaaatatcatatcttagaacttaagaaaaaaatcactggcatgtcagcagattagatacagcagaaaaagaaacaatgaatatgagtaaatagttacagaaattatgcaacttaaatcaatcaggaaaataaaaggattaaaaatactcaaggataagtgacattatcagattttctacacatgcgtaattagagaaggaaaagagagatggtgatgctagggaaaaaaagccaacactgttcaaattttaggaaaaataaaccagcctacaaagccaagaagctaaaataacctgaatcaagaaatcaccaagaaagggcatattctaatcagattgctaaaaatatagataaagatgaaaaaattaaagcaccagaaggggaataaaagcattacttacaaaagaataaaaataaaataaaattacatctgggtgacatcagtgcaaatgatgttgtaaggacatcagaaaattctctcctcttctccataaggtaatgagtacagttgcaaaaactgtcaagctcaaattctttcaaaactctagaaattaaccaaatgcttgtatcaatttgtggagcatttatttaagagaaatgactgaacattagtaagaatggtgaactttgtggtattttaacttgtcctatcccctttccctctctccagctctgtggtagccttgaaaactaatggccccacaatcatggtgaaaactaaggactaggctgccccgacaaggggcagaacagggttggagggagctcctgcaaaaacccattctcccaaattgttcacatttagtcagtctgacagtttcctattaagcttcagtcacttgtcttttttttaaatctacaaaaattgtatatttttgtgtacaacatgttgttttaaatataaatacattgtagaatggctaaatcaagttaattaacgtaagtactgcttcacatattttttgtggtgacaacactcaaatgctactctgtaagtgacttttaagactgaaatacattgttattaattataatcactacattgtacagtagatctcttgaacttatacctcctataaaaccgaagttttgtatcctttgaactgatcatctcaactgtcttttctttgatctaactgcaagctcacttgttgtgagcacaatttaacccaggggtgtctgtatttgtgtgtgtgtttgtatgtgtgtgtgtgtgtgtgtgtgtgtgtacaccagttgtttatcatcacatttgcctgattggaagtacaagctggggccaaaacagctcactaaataaaaaaggaaatgtgaaaataatagtggaaaacgctagtgaaatggatgttcatagagggctattttgaaaatctgatatatttttgggaatgtagaagaccacatgcacagacacatggctgtactcatgcccagaactatgcacatgtccatgaaaaacctcaagaagactctacactgctacttctgtctgaccttgaggctctgtgcaatcaagaagttaaggctaagactgaattgtgaacttcctgcccaagcattgagagcaagcactaacacatgtaaagaggctcttggcagaaactagtaggagtattggagtcttcaatacaccatattcaataatgtatagaacaactcctaagaagatcaatcaggaaaaatgatgactgaggttacactatacaccaattagattaacatatctataggacactccacccaacagcaggattcttcagaataaaccatacgttatgccataaaacaattctcaataaatatacaataattaaaatcatataaagtatgttttccagccacagtgcattgaaatgagaaatcaatgacaaaaggaaattcagaaaactatgaatatgtaaaatcaaataatacacttctaagtaactaatacgataaaaaaaaggaaaatcagaaaacactttgaaatgaatgaaaatgaggatacaatatatcaaaacctatggggtgcagcaaaatctgtgctgagagaagaatttatagctgtaaatgggtatattgaaaaataatgaagtagtagtcaaatgacggcacagaaattattaaaatatgtccattcagctgaaaggaaaatgataccagatacaactcagatctaaacaaaagaatgaagacagccataaatgttaaattggaaaatatatataataaaatgaactaatttttctaatttatttaagaggcaattgactttaaagaaaaaataatagaggggtttataacatatgcaatgataacattatgaccatagggacataaaagaaggcttaggggaaaatgcgagttacattatatgtgaagtggcatgataattatttgaagatggattatgataaggaagcatattataaaccctagaataatcactgaaaaacgattaacacagggttataggtaatatgaaaatagagtacataatataaaattctaaataatagttaattattccaaaggaaggcagaaaaaaatgatataaagaagatatagaaaggttaataataatatcaagaagatggacttaaagcaaactgtaccaatacttacattaaatgtaaatgaattaaacacagtaattaaaagtcagatagtttcagattgtataaaaaggcaagttacatctacatgtgttctataagaaatgatctttaaatataaaaccacagataggtaacaagtaaaagagatgagacaagatataccaaatactaatccaaagaaagctgaggtggctatattaacatcaaagaaggctttagaatgttatctattaaaagggattaaaataaggataattcataatgaaaatagttaactactaaataaaacacaaatacctaaatgtacatgaatttaatagcagagcctcaaaatacatgaaaaataactgacagaagtagaagaaatggaaatatttctatccacattgagaaagaggagacaaaaaataagataaatagcactatcaaccaagttgattgacattacatttacaaaacattacgcccaacaactgcataatacacatttattttaaggatatgtagaaaatgcaccaaaataaaacatattgggtcatataacaaacttttcaatgaattttagaaacattgaggtcatatagagtaagctctctgtcaaaatgtaattatattaataatgaattttttaaaggtattgggaaataaagcccaggtatttggacattaaatgatgcacttatgaataacccattagtcaaaatggaaatcacaagggaaattagaaaacactttgaattgaatgataatgaaatatgatatatcaaaattgtgagatgccactatagccataattacataaaatttaaatttttaaatacacaaatattttaaaagttacaaacacacacatatatacagacacaagtccaatgataacataaaaatatgtaacacattaatattcaagaaatgaacattaaaaacacaataaagtatcactgcacatcactgaaatgttagaagtaataaaatggaaaatttccaaactctgcagagacacataattaactcaaattctgatacattgctggtttaagtacaaaatgatacaattatgctggcaaacaatttattaagtacttttaaacttaaccatccacttatcacatgacaaatagacatgaaaacatatatctacaaaagtcttgtaatgcaaatattcctaagaattttattcacagtagccccaaactgtaaattgtccatgaacgagtgaattaaaaacattaaatattcataaaatactactcaaatacaaaaagggataaactgttgatacactgaaaataaatgaattttacaaatattttgctaaatgtaagaaaccacataactcataaaggcctgaacttgtgaaacaactttgtaggaacagagatcagatctgtgattgccaggggtagggatgacggtggatgactgaggagtaatactgaatatttttattatgatgaaaattttctacatcttggtttgtttggagccacaatatgtacctaacctactgtttttaagaaactgtgctttgcaccaatggcagatatgagatataactaataaaaggaatccctttgtagaaatcaaaatgctgaaaagttaggcagcttgaccaaggttatacttggagagtaacagagccagaatttgaactaacatagttagtttacaatctttacaatctttttgggatttagcaaaaagaatttacaatccttttgtgatttagcaaaataactctggctacagagctcaaggaggcagcattaagatcagagatactgaaagctgttgtcataattttgatgaaagaaaatgaagatctataataaaaggagaccttttattagcattcaagcagattacagtccattcatgcagattacagtacagacctataatcttaaagttactattcaagttaataaatgccatgaatagtgttatagaattgtgatggttaatttttaatgtgtcaacatggagaggtgaaggtgcccagctgtttggtcaaacactagtataggtattgtgaaggtactttttagatgtgattaacatttaaaccagtagattttgagtaaagcagattatccttcattatgaagatggtcctcatcagatcagttgaaggtcttaagagataagattgaggtccccacaaagaggaagaaattcttctccagactgccttggcctcaagactgcaacattaactcttgtcagaattttttgcagaatttgaacttgccttcccctaccatcaatcaactgagcaagttacttgaaatctatctatctatctatctatctatctatctatctatctatctatcatctatctatctatctatctatctatctatctatctatctatctatctaaccatattatagagggagacagagagacatatcttattggttctgttttctctggagaaccctgactaataaacaaatcataaaaaaatgacttgttctgtcctgaggcattagcaaagacatcacaaagaagataattgggttggggcacaattactgcttctaccctatgccggtcagtgttctaagtattgcggctgtgctatttcattgacttttcgtaactcctactctgtgagtgataaaatgcaatttgcacataaaaaaaatacagctaagaaaaataagtcacaaacattaacatagtgtacccaagatcatttggtaggtaagtgatgaagccaagagattctaattcagaccatttcattcctaacactcttgagcactgcctttcaaggactcaccttgaaggatgaacagctgtttaccatacgcagcagaaaaggaggggtatggtggacacaaagagcagtgacaacgaaaagactgtatagaatggagttctgtgagttcagaataaatgacaaaataaatatatgagggaggagaaggtgatataaaatgctgaagccaggttttgaaatgctatacaatgtcttggtgaataatctagaccagctttgataggcagtaggacattcctagtttgtttttaagatggcagtttgacattatagagataactaacacttcttgagcccttgccaagagcaacacattactctaagtaatttagacatatatgcattgtctatacttcataacatccttgcaaggtagatgctatttgaacctccatttcatagatgaagaaaggaagatcctgagaagttaggcagcttgaccaagtgtatacttagagtgtaacagagacaggatttgaactaacacagtctgattgtagaacttacaatgcttttgcaatttagcaaataactctggctacagagttcaaggaggcaacattaagagcagagatactaaaagctattgttataatattgatgaaagaaaatgaagatctaaacaaattctctgaggatgacaagaaattatgctaaattagaggcagaaattgtgtctttgactacatttcctactcatcacataaatatttgttgattgactggcttcataaatcataagctacaggtctcctaatgagattgtcttctttatctttaaatctattgctgaaaggtttctgtgttataggtaaggtaattccctctttgttccatattcagctagcctgccaggaatcacatttatagataaaatggcttctttcatcccagagctgacaagctaaattatattattctttttaaaaatatttacaaatcatgcaaaaatgtatgctgaagaatttaccactataagcctctcacctctacacacaaaatataatgtcctagccttttcccaagacttggggagggcttcttctgtttatagaggccttagggcatgaccaaacctgctaagggataacaatttctgcaaccagcattctgtttgcattatgacctcatttggtgctgcaatataatgtgtacataccattttcaatttgtctagaaacactatttggtgtcctggcttagtgtaactgccagaattattcataactcaggaaccaggttacattttcctgcatagactattcaaataataagactaaaggcaaataggactggctcttctttgcccacatttttcattcatacccattgctaattccttccctcattaaaaatagaaatgttgtcatgttatgttgttgcagggggtatcacagaaagaaagtgatcatgaacccatttcctggggatcggagggcttcataccagtggtatgtatttcaggtgaacaccccaggatgttgtgacttctttgtaacaaataagtgagtggagtttttatttaatagaaaatagagaggaatcattaaaccaaaatggtccttacaacaaaagctaaagatcccggaaatctaagcttgctgtgactggttatatagattgcttattgcacaaagacaataagttaaggggagggtgaataggcgctggaagacattatgtgttccatttgataagtcctatggctatgaggcaaccagaagggatatctttattatttattaattttttatttgtataaatttatggggtacaagtgtaatttcgttacatggacatattacatagtggtgaagtcagggctttcagtgtatccatcacctgattactgatcattgaacccagtaagtaatttctcattatccccctccaacccctctctcttctaagtccctgttagctatcactgaacactctatgtccatttgtacacattatttagctcccacttataagtgagaacgtgtgttatttgtctttctgtgtctgagttacctcacttttcacaatggtatttgtggacaagcacaggctgaacttggtgtttccatatcattgtttatttgctaataagttagtatatttttacttgtaagcactaaaaaatttaaccaagaacaagattgtggttgggtcatagaaagaacacaaccattgagattcttaagatcatccctctgtctctgtctctctctctctcttttatcctcatccccatttctctctgcatcaacctcattcttctctactacgtcatagaagctttcttcttgaccaaacacatgattattgagagcatctgcctttcacatcttacagatcatagggagaaactgacctaacgatttcccttgttccaagatttaaaaaatatatttgataggtgactcatttgttgaggtaaagtcagagtcctatcctgaaccaatcaagtatggccagcagttttatatattcaggagggtttgggggagggagggaaatcttagacactataacttgagctagggaggagtatttcaagaagtagatttctatgccaagaagggaattaaattcagacaaaacacttacatgctcattgagggtacataaactaggaaaattccaaatcattcacatgcatgaatttaccttcatttaaagaaaaagacaaaaaagagtagtgtgctatactcacccaactgcatcaatagctatgcactgtggtccctcattgaaacccaatctggaagttcttttctcacattttattctatttatatcccagctacccctcttcctgcagcaccaggctcaattcatgtctcacctccaaaaagtttttactgagttttgtattctctcttttctccattactataactttgacaaataggtttacaaattgatttccttaatgatacaatgttttgcattgttcattaactttttgggctcatggttcatctcccctacagaactttaagctccataaatcttttataatgacaattatttttacactaacaactaagattaccttaattttgactcctgctgcttatatcataatactgagtgtactgttgagaaacacatacatagggagagatttggcaaatataaggttgaacactaactgtgcaaagtactttgcggatttaagatccccaaagcaagtaaggggatggtttcttttctgagacacaaatgggttactgaacactgaataatatgttaaaggaaagctcaaacacttagcatttgtaaatggtctaacacagagcttggagggaccagtattctctttctcctcttcttcatttaaggaacatcttggaaagcagaagttattaataaaatgtacagaggaaaatgcgttattttccataagaaaatggagtttatgaacataaatttccaattctgaggcttgtcaactcagaccataaaagtggctggcatataagcttactaatttggactaattaaatgactagccatttgaatctggcgagagccccaattataaagggtatttaaaagccacaacacctaaaatctgaatttttaaaatatcatcagaaaacactcaagggagagattttcctggaaattcgctgttgagacataacttaggttctaagagattgaaaaatcacttgcatttggaagtaacttttctcttttgtacttatttacattattgtttgttgaatttatttgttgaatactttctcacatctgtgtgtattttaaacttgaagaatccatttacatttaatcttttattggccccatgagtaaaataaagacacagttatgactctctttcaggggcaaacaaagaaagacttaaaaatgctccctaacttgcccaggttgcagtgtgaatgaggaatacagtgggaacacaaatccatacacacgtatatctttctaagacccccgatgaggttactactgacctgaaaggcagcactactaagtcagcaagatatttttaaaaagtcttactgtattctgaattgttagagagaaaaacatgttgatgtacccagaagaccgaaaaaaagcaattatggggacaaaaacacccctctcctctagactaatacataaagatattatattaggtgcaatgtttagtagatgtttgaggcagaaagaaggggagctcttttctgctaatttgagttaagcttgtttgtaattcaagttattatttctttttgtttacttgtttctattaaaaagatatatagatgatagatatataaatattctctctctttattctttctgaactggtaagatcagataactggaaacaaatggataatctttgtagcttacaccctagaatcttctctcctgtgcccttcatgtactccacttctgcagagctatgtttatggaggaaattggattcactgtttgcctacagcaacacatttagctggtggctgtgcaggtccaattaactcttttaacaatatgggtcaaatgaggttattggattatgtttgtagccaattataattgttttggttgaatactctctcttgtaaccttatttacacttaagaaaacagcatagaaaaatatttcattgtgtggaagaaaatagcctaggcaaatattggaagaacaatttctcttttctagatcacgaaacatgacctcttatttatgtttgggcataaagtaaagccttttttgcagaaataaaaataaaagtgttagatataaaacactttgaacacacattattcccatcattataattatcattattatctctacctcaccatgaaaagtaaagcctttaatgggagggacacaatgtgataggaagaaaggaacccaagagggagacgaagtagaccagggttctagtgttggctttgcggctggtgagtcatagtctctctgaacttaatgccctccatctagaaagtggaaataataagcttgttaccacaatgattaaacaaaaaaatgtacatgatgtgttttaccaagtaaaaataatacaatattggttataaactagtgttgaataataggaatttcttctgcagttattttaaactgtattgcaaggagattttgttccatatacagtcatgggccacataacaatgttttggttgacgatataccgtggtggtcccataagatcataacgaagctgaagactttctatcagtaatgtcttagccattataacattgtagtgcaatgcattagtcacacatctgtggttaatactagcataaacaaatctagtacgcctccagtcatataaaatgtcgcacatacaattatgtgtggtacatcatactaagtaatgacaataaacaactatgttactgttatacgtagtgacttttttctgtcattttagaatatgctccttctacttattaaaaaagtatgctgtgttattctagcagcaggaatatctagtagagggaatatgctcctcctacttattaaaacagtgtgctatgttattctagcagcaggatcatatttctcctatttactgtgtctcttaattacatcattttcttttgtgcttgatttaatctcattttgttttgttcatcagggcctctgagtataaaaagcctactgctaatattgccagtaagaagctacaacaagtgattgacctgaaaacaaaattagaagtgattaagaactacaaaggtagaacatcaatgatgattactgctcacctgtcagacagatctcattccactataactatgatcttaaagtacaagaactaactaatagaagctctgagataatctccttcactgaaggcaatgagactaacaaaaatttgggaagggcctatatcagatatggagaaacttctaatcatgtagactgaaggccagacacagaagtgtactcctcttagcaccatgataatcatgaccaaagcaaaaagttgtttgcagtgatgaaagagaaggtttgacttgactgtgttgttgaatttactactaggtctgggtggtttaaatgattcaagaatcattactcattacctaacaggaaagtaactggtgagtttctaagtgctcatatgaaggcagctgaaaaaattggggaaattctagataagctaattgtagagaaaatttacctgctggagcaaatctggagtatggctgaaacatctctattctggaagtgaatgcatgaagggactttcatccataagaccaagtcaatgccaaatttctagctctctaaggacaggataacagtcgtatttggaaggtagtgttgtatattacacattgagccctttgtggtctggcacggtgagtgttacagggcctgcaagcatatcagtaagaacatattgccagtgtacaaccggagtaataagaagtgatggatcagtcagctccatttccaaaattcccttctgaattgccatgtcagcaaaatggagaagtactgtttggaaaataacatactttcaagattttgcttattgttgagaatgctcctgcacatcctcctttattggtgatcttcatcctcataccaaagtgatgcctgtccctccaaatgctaattctttgacccaaacagtgggtcaaggattcatagtgatttctaagccttattgcctgagtaggacctctgcccaggctattgctgcaactgaggaagacactcatgcaattctggcaggattacaacatctatgattgcatcaagaaacttgcttgggcttggggtgatatcacccagggatgtgtgaatggcatctggaagaaaatattcaagagttttgctcatgactacagagaatttgccaagagtgagagggttgtaaaaattgaaaaggctgtgattgagatagcaagtaactttaacctgggtgtggagaaggatgatattgaggagctcctaaagggggttcctaaggaactgactaatgagaagttggaattggaataggaatgcattgctcaagaagaggcaagaggaaagggaagtgcaggagaagaaaaagcggaataacccttaaaaaaaatccacaatgaagagtttagtagaagcttttgcagacctcaacaagctccttaaaaagtttaaaaacatggaccaccaacaccaaaaggtcatggtgtgttatctgcttacaagcaaatctatgattaaaaaagaaacaaactaagcaaaccaacatgaacgtatttcagaaaagactgacacctcctcaagaagagccccagacaggtctttcaggagggattccagaagaaagcattgtaatcatcggagatcacaggtccgtgcatgttattgttgctgaacaccttacagtgggacaagatgtggaggtggaagacagtgatactgatgatcctgacccagtgtaggctgaggctaatcaatgtttatgtcttttttttttaacaaaaaattaaaaaaactgaaactaaaaagcttaaaaaataggaaaaatcctatggaagtagaatataaagaaaaataatattcttgggccgtgcgcggtgactgacgcctgtaatcccagcgctttgggaggccaaggcaggcagatcacgaggtcaggagatcaagatcatgctggctaacatggtgaaaccccgtctctactaaaaaatgaaaaaaaaaaaaagattagccaggcatggggtgcgtgcctggagtcccagctaccagctactcgggaggctgaggcaggagaatcgcttgaacccgggaagtggtggctgcagtgagctgagatggcaccactgcactacagcctgggtgatggagcaagactctgtctcaaaaaaataaattaattaattaaaaagaaaaataatattcttgtacatctgtatattctgtttctgttttatgctaaatgttattacaaaagagtcaataagttaaaatattaaagtttataaagtaaaaatgttataaccagttaaagttaatttattgttgaagaagaaaaaatttttagataaattaatgtagcctaagtatacagtgtttataaagtctgtggtagtgtatagtaatatcctaggccttcacattcattcagccctcactcactcactcactcacccagagcaattttcactcctgcaagctctgttcatggtaagtaccctatacaggtataccattttttatctcttatactatattttaactgtaccttctctatgtttagatacataaatattaccattgtgttacagttgcctgtagtatttagtacagtaacatgctgtacaggtttgtagcctagaagcaataggctataccatatggcctagggacacagtaagctatattatctaggcttgtgtaaatacagtctatgatgtttgcacaacaatgaaatagactaatgacacatttctcagaacatattcttgttgttaagcaacacatgactatattaaaactgttcctagggaatgttaagaaaaatgctgttaactaatcatttttttcttctcctgttgcaaatatgctatgaatgcgaatagggttttctaaagacaatgggaaagtccatgacacataattgaaaaagtcactatgattaggtatatcaccagaagaccaagtggctctgtaaggaactaaagttaaatgccaacaaccaagcaaatgagtgattctgagccccaggacatgttttaaaatataggtttcattattatacagttatggttaagccaaaagatcagaaaatgatggtcattgcaaaaataatctgttacttacagttcccaaaaggggtgggcgtgccgcaacacacagagccatgtgggaaactgccatggtcagtcaggaggaagagagagagctgggaaaatggacaagagcctttaatttggcttttgcagtgaggaacaggtgagctatagtaaacaggtttaggattggctagtttgaatacttttagtaaattatggggcataggggttatccctagttgcctggtacctggcgctgggatgatttgggcaggtggataatgacactgactgtaagagcctaaaagagaaaatgttgggttctgtgggctctggattggttattttgcatatgaaaagtgcactcccttaaaggcaagtcttttagtatttctaggaattgactggctctgggaggggcagtctttccaaattcatcaaggccccagctgtcaaaacattagaagcacatgcttaacctaggatgaatccaaggaacctatcatcaggtatttgcagttgcatctgttgttcagcttacactcaaaaatggcaatagctaacttttctgacaatctttgtgaggtgagttttatttgtatctccaatctgcaaataggtaaagagatacatcagtgaggttaaataattcacccaagtaaaatagattgatttgattcaggttatatgtgggcgagaccaaagcccatgttctttctgcgagccaagaatgacttaaggttattattcacagataggcctgtgtgtttgtagcacctactccagacatcatgtccttgagaaaagcaaagaataatcatagaacaagcacatatagcattgcaggggcatgccctgtgaactcagatgctgggaagttgtcttggggaggagatgcattatggtacgtttcatttctggtaactctgagggtgactgagtgttcaggagggcaagtcaactctaaagtggagtcaaggtgaaaaagtgccatgtctgtggtcaatatcttagaaagtttacggatttccttgtcctgctgacatggaagagcaggacagtaagatcattctatttccaacatcaatccagaagcctggtgctttctctctcatgtgccactggcagtgtgccatttttgacagaccaaaagagcagtgagctgtctttaagatccaagcatcaaggtctatttcttagtatcagacagtttagcgattaagacactggactcaggaataacacaacctgggttcgtagcctaacttcgacacttactagcatatgatcatgaatgatttaaaattttaaatccacaccaaaacatggggataatgactagacttactttgtgggactattgtgaggattaagtggggagaggcacacaaagtgcttcatatagtgtcttacacaaaaatgcacttgataactttttaatatttttattaatgatttttaaagtttagtacaaaatttatgtgcagagtggatttcaatttcttttggtattctgtcaagacttgttgaacacaactgtaacaaagccatggaactatgagaaagcaatctctctctctctcttcctccttccctccatccctcactcttaaacacccacacacagatatacacacacacacttataaatgagcatctactatacatttgcttggagatctttcagtatttacatccaagtcagtgttacactcacgttgtgttgcatcatatttcaggcctactgtatattatgagtatttagccatttcctgattaatgaatattcaatgactagatgttgtccaatgattggatggttgtacgaaatatggtgagaagcagaagatgaatctgacaaggtaggaaaaagccagatgacgcaggactttcatgatatgttaagaaactgtgatttcatattaaatacaatgtgatgacatctatgagttttaagcagcatgtccattaccaccagtattttgttacaccgttgctgcattgaataactatacatacatctttaaatgagtatgcaagtatttctttaagttagatcgctagaaatagaatgaccagcttcacacattttacattttcagagatattaacaaaatactctgcagaaaggtaactaattgctcatctgagccagtgtctggaaacccacaccccacctggcaaacctttgatattataatgtttaaaaaataatttgctaattgttggaagagaaattgtacaatggttttggatcttgtagcggaattatattctggagttgatacataaggaaaaatataatcaaaatagtcctaggatgttccatgaatcatgcttgaagtatcataaataaaatgtaatttggggggtatacaaccctctattgtaattcttatgtaccctaagcacaagaaacactgagccagaaaaaataaagaaaataaagtttatattgcaggtgtctaggaattgaaatccttctgcttttaagacaactaccaaattctagggtgagtggggtcagggcacgtaattctgaagtaaattatttctacttgtcttcagggtttattctattttgtatttattaagtctgtaatcttacccaatgttaagcatttttatctttgtaaaaattattaagataatatttaaaatacctatcagagatctagattaagaagtgctgtataactgtttctgactttgaatctaaattgtgccaaatctgatacatattcttactgctctttgaaaagtcagaaatttgctttttaaaaactgacctctcctcatgtgttaccaagtaagagttctttccctcatgtttgtagctattacttttagtaatactggagggaagatgaacatgagaaggaaagattgatgttaagttccactgtcagcattacattaaataaacatataatgacacaatactagatctcattgtttactaacttctgctgatttccactgagtttgataatatttcatctgtttataacttattatgatttcttttccaagaattggtggctcacgttctctgcttctattcctgttcagctcatattggtttgttttgtatttcaaatctttctccactttatgcttatattttttatttgtttatgatgctttttgatatacgaagcattttattctttatatactcaaatatgccagtcttttcctttgtggctttttggttttgcaaaatcttaggacataacgcctttatagcattcatgatctttatccattttattattttaaaaaatttgtagggaaacgggagtttagtgaagttaaatggcttatctagaaagacaccaattctaagtcatggagcaggactgaaacccaggcttcctgagtccacattctctgatgcctcttttcacccttggttgtttctttctttgggttggacagaaggtagtggctcaatatacttccatgtcatctattcttaaaatagcgtcttggtatgtataattttattaggcctctttttgttccaaaaaagatatctgattcaagatagtctaatagaaaatagaaaacaagaattcattagctccttattttgatagtccaagagtgaatctgttctcatgtatagttttatatatgggcttgatacaagtaggactatccattttatctgttgttttatctatcatctatctatctatctatctatctatctatctatctatctatctatctatctatctatctgtctaatctctgtccttgtcctaattatttctgctcctctctgcatgtcagctttattctcttctgatttcgataaacttttctacacagtgggaaagataactgctagaaattccaaatccagtatcttacagcttatgctctaaaaggcaaaaaggtggccgggcgcggtggctcacgcctgtaatcccaccactttgggaggctgaggcgggtggatcatgaggtcaggagatcgagaccatcctggctaaaacagtgaaaccccgtctctactaaaaatataaaaaattagctaggcttggtggcgggcacctgtagtcccagctgcttgggaggctgaggcaggagaatggcgtgaacccgggaggcggagcttgcagtgagctgagatcgcgccactgcactccagcctgggtgacagagaaagactctgtctcaaaaaaaaaaaaaaaaaaaaaaaaaaaaaggcaaaaagtttccatcagaaaaccacgaagacaataaccctgattatgttcttctaagtgatgtacaagtttctgaaccaatcactctgtccatgatgggccaggcttcttgattgacagacccaccaagatgtgtgtggcatttccctacaggaacacgtgcaggaggaagaagaaagcaagcagggcattaaaagcggtggttgtcaatacccatgacagtgattttcccaatatttactgtacctgagcagtggcaaaatcacctacaccctagctgctctgtctagatgaaaggtgactcatcttctatctccacatggaatctgaactgtagtaaaagtatagttatattacaaagtctctttattgacaagtcctagtatccctggaataaatcccatttggccatggggtgtatgttccttttaatgtattgctggatttggtttactagtattttgctgagaatttttgcaactacgtatttcagggttactgacctgtagttctattttcttgaggtatctttgcacggctttggtattaggatgttgctggcctcataaaattagtttggaattgtttcctcaattctttcaaagtgtttgagaactggcattaatctttattttgtcaagaaaatttaaaaaattgttatatgagttatacaaattgtggggggtacacatatgatattgtgatatttgtatacagtgtgtattgatcacatgagggtaattgggacattcatcacctctaatatttatcttttctttttgttgaggacattataaatcccatcttctagttattttaaaatatacaataaattattaactcaaatttttctatcctactactgaataccagaacttattctttctatttaattgtatttttatccaagttctctttatccccctcttctcttcccagcctttggtaactactattctactctcttcctccatgagatccatgtttttcactctcacatatgagtaagaacatgtgaaatttgtctttttgtgcctggcttatttcacttaatacaatgacctcaggttccatgtgtgttgctgcaaatgacaagatttcattcctttcaatggctgaataatatcccattgtgtacatataccatattatctttatccatccatctgttgagggacccttaagttgattccatatcttgactatagtgaatagtgctgcaataaacatggagtgtagacatctcttcaacatactgatttcctttcttttggacatatacccagcagtggaattgctggatcacataggagtttcatttttagtttcttgagaaacctccatactattttccataatggctacactactttacattcctgccagcagcatatgaacctttccctctctgtgcattcttgccagcattttttgtcttctgcctttttgataatagccatcctaactggagtgagatgaaatcttattgtggatttaatttatatttccctgttgattagtaactttttttttttcacgtcttttggccattagtatgtcttcttttgagaaatgtctattcaggtcatttccccattgttaaattgcactttttttttttttttttttttttttttgctatagagctccttttatattttgattattaatcccttgttggatgcataccttgcaagtattttatcccattttgtaagttgtctcttgacttttttcattgtttcctttgctgtacagaagctttttagcttgatgtaatttcatttgtctattactgcttttgatgcctgtgctgttgagcacaaaaaatctttgccaaggccaacatcccgtagtattttctcaatattttcttctgtagtttcataatttcagtcttgcttttaagtgtttcatccattttaagctggtttttgtatatggtgaaagacgaggttttagtttcattcttttatatatagatatccagttttcccaggaccatttattaaagaggttgtcttttccccagtgtatgttctttgcccctttctcaaacattaatccgctgctaatatgtaagtttatttatgggttttctattctgttctgttggtctttgtgtctgtttttatgacaatagcatgctgttttggttagtatagcttcagagtataatttgaaatcagtgcaatactttggctttgttgttttttgcttaggattgctttcactattcagggtcttttgtagttctacacacattttagaatttattttaaattccgcaaagaatgtcattggtattttgatagggattgcattgaatttgtatattactttgattagtgtagagattttaatattactttttaaaattcatgagcatatcttttcacatgttctctttaatttttttcattcatactttgtagtattctttgcagagatctttcattgtcttcaatttctttcattcatatttatagttttctctacagagatttttattctggttaaatttgtttctaattgtttttgaacgtattgtaaatggagttgctttcttaattacatcttcagattgatgttagcatacagaaatactactgacttttgtatactggttttatatcctacaactttgctaaatcctataaatttactgaatttgtttgcctaattgacatttatagaaccctacacataatggcaaaatacacattatatggaattccccatatatattcacccaaataagccacatactttaaataaatttaaagattgaaatcattcagaatatgttatctgatcataatggatatatagaaaatatattaacaatgaaaacatgtgggggagcatatttgaaaattagataacacatttttaaagactgtaggatgaagaagatatcacaaaaaaccacaggaaaatattttaattgggtactaatgaaaaattcaacaaaatctctgtgagttggctaacaggtaaatttataactaaaaatgttcatgttggaaaagaaagaagacctaaaattaatgacataaggtttcatcttaagtcataaaataatgagcaaaatagatgtaaaatttctcaaaaagttgagcagaaattaataaaatcagaaatacagaaaattatcaaaaacaaaacctcattacttggaaagataaacaaaaggaataaacctgtaggtagactaattactgaaaagagagagaacaaaaatactatcatcaagactaaaagaaaggttaacaatgcataccttagagacattaaaaaataaaaaaatttattaaaacatttatgccaaatattttgaagacaatgattcaggcaaattctttgaataatgttacttactaagatcaacatgagatgtaataaaaactgaaaaaaatactaatttttatggtattttcactggcaaattatattaccattcaagaaataaatgacacctatgacacataattcaataataaaaagacacatgaactgattataaaatgaacatagaaaattgaatagaaatttttctggagaagatacaattggctgacaagcacatgaaagatgcttaatatcattactaatcattactaatcagggaaatgcaaatcaaaaccaaatttggatattacatcatactcactgacacaattataccaaaaatacagataatagcaagaataataagcaagataaaaaaataacatgtgtatgtagagaaattgaaacccttatacgtagctggtgggaatgtaaaatggggcagacactttggaacatagtctggcagttccctaggaagttcaacatatgggccaacaattccactcctttggtaaatacccaagagaacaaaaacatatgcccaaacaaacttgtacacacatgatcatagcagtgctatttataatagccataaaaaggaaataatgtttatcgactgatgaatggataaacgaaatgagatatgtacatacaatgcaataatgttcaggaatgaaaataaataaaatacacatgctaaaacatgaatggtccttgaaaagacgatgttaggtgaaagaaactaggcataaaagaccccaaattacattattatatttatacaagaatttcagaataggcaaatctacagaagcagagatattaatggttgcttagggctggggagatggatgaccggaagaaaccgtaaaaggctgatgatgggtatggggtctcttttgggtattatgaaataaaatgttgtaaaattgattgtaatgatggttgtcaaacttaatgaatatatttttaaaaccttgaataaatgtcttcttttgaacttacagtataatttaaaaatatatatatatatatataaactttgaataacacatttcagatgggctagatgattaatttattatgtcagtttggttaggccattgtattgagatatttagttaaacatgtccggatgttgttgtgaaggtatttttagataagattaacagttaagtcagtagactttgaataaagagaattacctttaatccttaatgtgagtggaccttaaccaatcagttgaaggtcttaaagaaaagctgatctctccagaggaagaagaaattctgccagcagactgactttggactaaaacaacaatattagctcttccgtggacctttgcactgccagcccaccttgcagatttttgacttgccaggctctacaattgtgtgagtcaattccttaaaattacacacacacacacacgacgctatagcttctatttttctggaggaaccttactaatacaatgagaaaattgtatagtatttgaattacatcttaataaaataatttttaaaagcccttaataaaataaaaagcaagccatagaataaattatttgcaatacatacatctcaacaaatatgtatattaatatttatataaaaatcctccttcaacccaatgataagaaaaacaagctaatttaacaatggacacatatttgaacaggtactttacaaaaactaatgtagaatgagcaataagcacttaaaaatgctcaacctcataagttatcagattaatagaagtaaaaccaaaatgaaatatcaccatacaaatattagaatggcaaaaattagtcattaatatgacatttttgcaaggatgtagagcaactggaactcttataaactaataaaagtaaaatgatatgagtgatttgcaaaagtcttagttatcatcttcaaaaactaaaaatgcacctatcatagtgtaatccaggcgggcggatcacgaggtcaggagatcgagaccatcctggctaactcagtgaaactccatctctattaaaaaatacaaaagattagccgggcgtggtagtgggcgcctgcagtcccagctactctggaggctgaggcaggagaatggcctgaacccgggaggcggagcttgcagtgagctaagatcgcgccactgcacttgcagcagagcgagactccgtctaaaaaaaaaaaagaatgcacctattatgtaacagccattgcaattctgtttttacccaagcagtatttgtataggaatgttcataccacctatattctcaataaccaaacccacaaataatccaagtgctcattaacaagtgaatgaataaacaatatgtggaacaaccatacaatggaataacatccaataataaatattaatggactatctgtaaagtcaataagaagaattaatctcaaaattgttatgttgagtgaaagaagccaagcacaaagtaatacctacggtatttgcttacattctggaaaaagaaaatatatttatggtgatgcaaaggagatcaatggttgcctgaggttagaggtaaaggggtgtgaagagacatttttggggtaatgaatatgttgcgtgatgtgtacaactatgatgatgttttcacagttgtatacacctctcaaaagtcaacatattgtatattttagatgaatgaattttattatatcctttttttatctcaagaaagctaattttaaaatgaggaaactagtctgcttttttgaaatatttttatttgtgaattccattgagaatctaataaaagctgcatacttgaccaaagtaaaagtgcatacctttaaattactgcccacaatatcagggagtagaagacctggtgaaactcatcttaatttggaatgagaattctacatggggtaatgaaaatccatgcttagggaaattggtgtcgagactatacattttggcagttactgtggatataatcatcttacattccttctgttgtcttatatgtgttaattgagcctcttcaactatagtattggctaaatatatttacagcatacacacaaagaaaaaccttcaaggaactataccatgcttatactaaataactttcaaggaaaacccaacttaaggtaatttcaattactgtatttccacaaagtgtttcgttaaatatttaaatagattgtaattttaataaatttttatttatatatgtttatcaatctgggaggaaattcacacaaaatagcatagattttgttgtagaaaatatgatctatatatttaaggcttaggagacatggataagaagagcacagtgaattgaatgtctcatccagtatacctaagattagttttgtgctaaattgataaaatgcaaactagaaaaataaagagaattctctctagtttatagcaagttattttgcatgtaacatattatttcaaatttattaaatcacaaaatatatttagtgtgatataccagagttttcatatactgtatactgaaaatagacaggcaaaatcccaaatcaaagtaaaacgttatttaaaatgatactgtacactcaagagctgttaggtagttttacattcttcacgtattgtcttattatattctacagtaaagatatgcattagggcagaaagacttagaccaagaatagtaggatattctgtggacaaataaataaatgtatataaccatgtcagaaagctactggacatactcataaacatgtttttccagaaacattcttacagaaaagtcaaaggattctgagacatcaggccaatgctgtgacagagaatttgactaagtaactaacagacagagtcaagatcctggcacagtttctgggataactgagtataggtaatgaatatttagagaagactgacttgctgatatatatttttaatgggtcaaatgtggcctttttattttgacatatttttaaacttaaaatcttaaaaagaagtataaaaaataaaatatattatacactttagccatatttaccaagtgttaacattttgatgtgtttgttttatcattctctgtctctctggctctgtctttttatctacacatttataatacacacacatgcacacatactttcttttctgaaatacagtacaggaagttggacacatacttttccacccttaaatgtgtcagtgtatatatgttaaaaacaaaatcatatcatataactaaagtacaattagctaaatcacaaaaatataatagcatttaataatcatctgtaatccacagttcatattcaaatgtctccaagttttacaataatatttttaataactttgtctatatgtttgtttccaggttcaacatataagtcagtatcacacatagcaattagttgatatggctctttagtcttctatattttggaaatatttcacattacactcggctttcacacacttgacattttttgaagtgaatagtccacttattctgtagaatgtctatccatttgcatttgtctgataattcagtcataagtacattcatattatgtactttggcctataaaatcatgttggtagtgattatccttctctattaggtagcatcttatactgatgtgtcccagtatttgttggtgatgttaactttgataaattggttctcatagtttccccatttttccatttcaaagttcttatgttctgtattttgtttaataaataatttgtggggagatgttttgattttatataaatgtcctcttcccaaagaaattttcactcacaactcttagaaagtatattttcaggcatatttacatctatttaaataatgtcataaggctttatttatcatttcacttctcagagaaattaaccttggcccaaaaaatttaaaaagtaaatatactcaacacataaaaataataacaacaaaaagcccattaaatatgtcctaaaatcagttacaaaatacagttaagctggatgatatttcataaccctttaaattctaagattctataacattttcaaagcatagggaatgcccaatatcccaaatagttctccttacactacacagtgaaatccctccaggataatccattatgatagttataattgagtatatttataattcatcaactcaccacatctataatataataattcagttagtgttctatcacaattttaataatcccctttatcctccttctatattttaggaaactaagaattcaggccatgtttactttttatatctgtacttgtcctgctacatgggccctactgggctctcaataaatacattcttaaggaatgaatagacaaacaaactgaaaacttcatatggttgcctgccttcatgtctccagacaaaggaagacatcagaaggtaaaactcattaaccaagccaagcgcagtagttctctactgtaatcctgtcactttgagatccccaggcaggcagatcgctgaagcccaggagtttgagacaagcctgggcaacatagtaaaatcctgtctctacaaaacaaacaagcaaacagctgggcatggtgatgtgtgcctgtagtcccagctgctcagcaggctgaagcgagagaatcacttgagcccgagagcttgaggctgcagtgaactgtcactgtgctactccactccacccagggcaacagagtgagaccctgtttcaaaaaacttaaaattaaaaaattaaaaaaacctattaaccaattctaaatgtatcacaaaaaatggaataaaactaggaggaaaacaaagaagcattctgaagcctgattacttcctaatcaccaataattcattggtctttccatattttgagtatggcattaatcttacttatgcttttcattaaacagtttaccctatctttggtactagatattttgggaggaatatttgattctttcaaaaattagggtcattccctaagcggttattggagtgccgctaatttcctcaaaccaagatcataccctctcgtccaagagcacttttcatatctaactcacattttgtgtttttatgaataaatgtttatatatgggccacagaaatacatgactttctgaaacatggttatttttctaaaaaaaaataaagaaacggaaacatatttcttttttttttttttttttttttttttgagatggagtctcgctctgtcacccaggctggagtgcagtggcacgatcttggtcactgcaagctccgcctcccgggttcacgctgttctcctgcctcaacctcccgagtagctgggactacaggtgtccgccaccacacccggctaattttttgtatttttagtagagaccgggtttcactgtgatctcgatctcctgacctcgtgatccacccgcctcggcctcccaaagtgctgggattacaggcgtgagccaccgcgcccagcccagaaacaaatttctaaccaaaatcctgtcttgaaatcttgcacatttttttttttatttcagtgattttcttaggattcagtagttttgatgtacacaaactgtgtttcttttgtttgtaccaggatagagttaagaataacataacaggcataataaccaacaggattttttctgcctcttgtgtgcacccaaagatatagacaaagttttattcatttatatctctcggtatccttcgaagttttactcatttatatagtgtagtccccatcaggggcctcacatgccctttaacaaatatgccgcaacagctcttccacctgaatttctgatgcccaagaagttgcctaagtgcctgacaaccccctctctccccaaggacaattttgtgtgctaggctcatagcttccaagaccctctaatgatctcttcctagcaactcatgtcatagacagtgtggcttgtcctgtcaggctctgctgccaatatgtgatctactgcaatcttggagcccctgaaatcctggaagtcttaaagcaggttgggtcctggctgcggggattttatttgtgttaactttgccacctgattgccaagtaggattttactttattctccaatgttttacaaaccatttaatgtaagcaaatatttttatttttgcttaaagcacatcattctttaggacccagataggagtccatgaaggctggactgggggaaactacctagcaaaaacgatgctctcctcagaattaaccctctttcctgagaatgagacttagtttgtaagtccaactccctcgccataaatataaattctctctcgtgatgcaacttggacccatatacacgtatataattggtgaactgtcccattgccagccatgacttgtcaggcatacatgtagaatggaccttaaactcaagctagaggtatacctgcttataatttagtaatttttcaggcaggaaggactagagctattgatttaattccttttttttttttttttttttttttgagatggagtctcgctctgtcgcccaggctggagtgcagtggcacgatctcggctcactgcaagctccatctcccaggttcacgccattctccggcctcagcctcccgagtagctgggactacaggcgcctgccaccacacccggctaattttttgtatttttggtagagacggggtttcaccgtgttaggatggtcttgatctcctgacctcgtgatccacccgccttggcctcccaaagtgcggggattacaagcgtgagcaccgtgcctggccgatttaattcttccattctgggtggaaacattctagaaaggaagtatcactcagtttcttctgtgtaagaacatagtgtttacccactgaaggatatagagaataaggaaataacagatctgtaagtttctgtgccaatcaactctgagtcgaggtggacggagagggtagtccaagtgaaacaatattgagaaatctgttctaggatgtgacaaagtaacatcaaggggtgtaaggatctccttcactcttcaacttttaacatttagcaggtcattctaaggcagaagacataattgtgagtcacagacactaacccatggtacaagaattgtccaggtgtgttctctaaaatattaattgcatccagcaccccatgttgtataattctctgattagatccactctggcttatctcttgattctacagccatgaaacctaacagttttgggtaaaaagcacctcttgtatccttaacctctgcaaccctcacctcccttgccatacccccatcaactgagggaagtgccccatgggcactgctaaatataataaatgctgatgatgccatcatgagactgtatttatgaccaaggtgtcgtggttctgtgactagtaagctcccattgaggttcgtccagtggccttatcatctggctctgctgacatctctagccacatctctcccattcggctccttgaactctgtgctcctgccatgctcaactacttaatgcttcccactgtgccatgatctcttctgtctctgtgacctcttccacctctgtctctgcataggacactttcccctctttacccttttgtcacctctcaatcttcatcgttcttctttccgatctgagctctgaggtctttccttcccagaaagcttttccagtttctttagatgagattacatccccatcctcacccctgttttccctctcatatcacttttgtaattgtgtgtttctcttcccgtctagcctgtgagctccttgaggagacaggagcgatgtctcacatctatctcccaagcttaggcaactgcccaagatacagaggcacaataaatacgtgttgaataaacaggttatgcctttaccactttattatttctgtaatttctgattgagtggggcacttcacactctccacctttgtgatgctgttcattttaacaggtgttaacagaaaataaattgctattgatgcaattgttacttagaatgtaagactggcctttaagcccagctctgtgccaacaaaatgcaaggacagccaactgttgggaagaatttccaggaagaaaaccaattagtttcacatgctttgcttaatattttatttgcatttcatgcctcaagttttaagtgaatctgtattggcaacccacaataattgctagctcacctattgtttgttcagctaatggtttggttaaaagtacaaacaaaactgaagtcagagagatgatgaaaggcgtgcaagaacgggagaaaggaagaaaggaaagaaaggaggatggctgagacggggggaaggagggagcaaggaaggagaaagggaaaataattccaaacaggtttcaagattgagctgaccctgccatctaaatatagcatggcaacatggacatattgaagataaatgatttactgactggcttagaggaaatcagataaattatcttctactgactcctgactagccaacctcagaaacaactctcttttgagaaaggttttgtgataagagatacattagctattttttgtttcacctggttacagagttctcaagctgccttaaatatcatagaagaatttcacgttgaagttgctgattttattcagcctctttgaacatgtcaacatggatattgtccttgaacacacagctccacatgcccatgggctgaagaagatgctgagaaatggattctatatgtaagtataatatagatctggtgctttgaatacagcatctcttagctgcctcacatcatgggaccagtggggagaaatgtgtggcagagtagaaaataattttcttagtttcatgatttattggacaactctatataggcttctgtgcagaatatgaggtagaaagaccattaagtccaagaaaacagggactaaaggtctagtggtatgcttaggattgaacacagactgggcacattattgatatttaatagttataagctgaattaattaacttcctatgattgtcttgactctgtaagggagaggtattgtctcctgaaaaagtgtcacctgtagatacattttactctctcacctacctcttcttcagcctgttgaatagcaactttatccaaggtaatttttgataaccctgtattgccaatgtggccatttcattgtcagtgatggacctgcaaatctctcaataaatcactttactttggggatgacaatcttattgtacaaaaatcctttaaaagccttggtgggctaatcgatgctgagcgaaccaagacaggaatccagagtaggctgtgggcattgaggaaagtgacggcctcatcacaagacagttattgcaggaagaggaaagaaaatcagagcagaagccagagctgcaatttcgtttgtgcaaaatgagtttttattgctgtgaaaataaaaggtgattctaatgcttgccttttttcaaagtagtaacttaagctgtacaaagaaaaggggacttagtcataaattaaggttacagaactttaaagcacattaggaaggcatgaggggaaatgagaatggagagtcactctatgtgaatcccaagttgcatagacactggtccaagccaacccctaggacctattcagtcctggcctctcaaggggtaacctggtttgggaactatggattgcttccttaaaaatatgccatttaaattaatatttttagaaacaatagaagatagccttgaaaagggagacaggaaaagagatgagaagggaaatagaagattaggaacccaagctgagaggctgaggcagaagaatgctgtttgaactgaattgagcaaaagcgaacagtaagagaataattgtggaaactccatgttctgatagagtggacacgggcaaagctgaccgctaactttctccgtgtgaggaaaacttctttcaaaggatgagtatttgacattaaatttacctcttatctcattcagaaatatctttggcttctaatgtgttcaatcttctaatttggtgatggattcatttctttagatctccttcatgctggccagaacttttgctcactgcctttgtaccaggcatgagcacttactcacatatgtccttctatcactttctgtttctctcatgtccaattcctccacaacttcccattaatgcctgctttttctatggttccatgttatgatttcccattgctttattatttaatatttaaagtgagcatataatttatcatccaaactagaaaacttgagaataaggaacaggcataagccatgcctgtcactgggcaaacctaaatatgtgatcagtctttccataaagtatatttcctgtgggcatatatgtggcaacttattactacaatcttttgatttttctttaaccttttcaaataaatttgacttgtgccttaatctaaaatgtcatctcccatagaacagagactctgtattatttcttcttttgttccaatcattgcatgacactttgctagcaggtgcatagcaggtacacagtgaacacacagtgtgtgaatttaaaacaaaataaatgattcatggctgatgatcacacagcagttgtcctcagttttaactgctcataatgattacctgggaaattaaaaataatcaaacttaatgatgtcttggtcccatctccaaatattctgatttaattggccatgtgtctagcttggacaccagggcttttaaccattaccaggtgattctgaagtccagccaatattacagacaagcccgagggacttcatttctcaagcattgtggtgatgaaaacatatactctgttgagtgtagaggccaggaaggaagaaccctacaaaaatcacacaatatcaaaaaccatgtcagaattgcaggattattaagcactcagactttaaagctagatggatgcagattcaaattgaataggacacaacctgctggacagaatgacaaggacacagtaatccaattcgctacctctgaaaagcactaaagagtagtaaattgtcctagatttcttccaatcatttcaatttacaatattctgaggcccggcgcggtggctcacgccggtaatcccagcactttgggaggctgcgtgggcagatcacctgcggtcaggagtttgggaccagcctggccaacatggcaaagccctgtctctactaaaaatacaaaaattagccgggcatggtggtgggtgcctgtaatcccagctactcgggaggctgaagcatgagaattgcttgaacccaggagacagaagttgcagtgagctgagattgcacccctgcactccagcctgggcgacagagcaaaactctggaaaagaaaaaaaaaaagaagagaaaattctgacctgtggtcagacataaatgcaaaattgctctgaaaacataatcattaaactcctatatctctagtaaatcatcctttgccccgccccattgtaggagtatgactttcctttagacgttaaaacagggcagtgtctaaagatggctattttatttgactgctaattatgagactttaaagcaagcaacagaggttaaagtccttccaagattttccattgattactggtaaatctccacaactttgatgttcagctttcatgatgtgatccctgctcttccttccagttgtatcccctggaatctaccccatatatactccagctgttcagaattgctgtcccgtgttttttctcacttctgccaatgaatccctcttttactgtgccctcatcatgcttgactgcagcagacagaggcatcgattttaaagtgtctcctcatacctgcatttttggtttctatatctgttttttcatggaatgtgagacttgcaagggcaaagacaggtttaatgcgcctctacatcttgaaaaaaaaacagagagcaggcctataacaagttttccaaagggatgaacaagtgaaagaaggaataaatattgattttgcaatgttactgataaaggcaaacacaaaattagatcactgacatctatgaggaaaatatgtttgcctagtgatgaagcaaaggaaaagtttctacccacaaattgaaaatgttgatgctattattttgttagaaatgagtttgtttcctttgcttgggaagaaagcaaaaattgtcaacaaatggcttccttactaggcaaaaagcagtttatttgctggtctgcctgaataaaaaagggaaaataagtttggttggtggaggggcttaaagttttgctgttacaacagaagcagtaacatttaattttcactgagagaagacaggaagaagagcatggcttgaaattcaatggtctctatcatctactaactgctggccattggaaaattaaacatgcctctgaactcctgttttctaatctttgaactggttataacaacacatgccttcatttgtctaaattgtaaattaagtgaccaccttagttcaacatatgtggcatataaatcttccattttccctgctatttccctaagtcagaagtgagcaaagccaatctgtaagaaaacaaaaatgaaaagaataggttattttgattttttaatgtctggtgattatattgtttaattgaaattccatggaagcaactaagattatacttaaatacataatagcaagtgaataccaaatgaaaacatttttaaagccagaattttacactaaaaagatcaatttagtgttgtataaacataaacatgagcataaatacatcaagatccatggattgatcatttgattgaagatactgtctttctctgctgagaaaacagtttttttcctccttattctcttggttggttcaatatttaactctgatcatccaagagaaatctttgtggtacctgaagaagtataatctgtaggagtccctgctttgaaggcaaaaaggaaaataaaactatgcttatcaaaaaaaaaaaaaaaaaagaacaaagaacaaaagcagaaaagagcaaacacaagagacaaaatgccttgttaattgtataaatttgctaaggacaccataacaaagtaccatggttggagtggcttaaaaaacaaaaatgtatgttttcatagttctggaggctggaagtccaagatcaaggtgtcagcagggttgagtccttctgagggctacgagggaggatttatttcagtctttcctctacggtttgtagacagctgttttttttcttatgtcttcacatcgtcttccttctgaatgtatcctgtccatattttctcttcttatgagaacaccagtcatactggactagggctcactctaatgaccttattttaatttaattacctctataatcaataccttctttccagattcagtaaaactctgaggtacttggggttaggatttcaacatgaactttttcaggggcacaatttagcccacacaatagctttctcctttttacaaagtataaggatgccaacaaatgcagttgttactcattttcatcttagtgtgtattttagtccactaaatttaagcacttaaatataaatttaagtgaatgagctattttaaaagataattttcatgtcaaaataaacctgaaattgtgaaaagagattttatccttgcttaatagactacctaaattataaatgatatcaagtgttcactatatgttgaccactgtaaataaaattcctcttcagaaatcacctcatttaatcatgtgcttactgcaacaatggaaattaagtgagattattagggacccctaaatctgcaaaaatagagtcgtggcaatggggtgcagtaattcctcaagtggatcactgagactgctggtaagcaggatcacttctatgtccatgccttgattcctggattatgttcagcctttaggggccatagcttcatagaacggttactgttctgtaagacttttggataatttttgcttgctaatgctctgtgggcagggaatgacaagccatacccagaatatgtatcaaatccagtcaagatgaattatgcaattttcaggatggaaggaatccaatataatcaagttgccaccatgtgaattgcttatctcattgagagatggtgtcgtattgtaattcaccatttgtttctgttggaggtggacatttggcagtggcaagagctagacaagctttggtgattgctagcccatgttgttggggctgcgtgtagcctccattcctgctattgtagctgcacaatccttgtagactttatgcctgcattagtgtggtcaaccagctgagctgttttgtttacttgattgtttagtaatttttctatggtggatgcattccagttgatatcagcatgtgacaccaatgaacttctcatttcttgcccgccccacgatgtctaatataggcctctttcgtagagatccttgtctctgatcctccactttttccctttctaggtccttgactaactagtcaagtcctttggttcaagagtttatacatccatatctagggacacattttcccatcaaaagcagatgatgagttattgcacttgaaggcctgccagttagaataatttttccctcactgccatctttcagggccactattgcatgtctattgcattgtcatctattttcagcatgcatgaacatattgagctaattcacccatgaatcaaatccaacatttcattgtatttgttggctggttaccatagatattagcagagaataagccactataacaaaagtggtagatgatatgggtgtctgggcaggcgaattgatcagctaacttgtgccctactcttgcctgatctgggagatactgtttttacctaatagtgtccaagctcatgaattgctgtgtcaaagagaagtcagctcatgatgagtggttacggccatgtagtcacacaatatcgtggcttagctcaagaaatataggccatctacaatacattctagttcttttactgaggttgaacataaaacccacatggcattttttcctatcacagataaatgtagtagcaaagaatatccacggcaatgtgacagagcctgcaccacatcctttgtatgctctaggatccactcaaaataggtagtcttttgtgtcatttggtaagtaagttgaagtgattgcattcagtgtgaaatatactgcctctagaacccaaagagggctatcaggttgtgcttctttctcagcggtgtgagatgcaagaagcaataatttatactttattttggagctgatattctgtcatactcagaacattggactcctgaaatttccagttttgtgtctggttcctaaactcttgtagggtttccctcccaacctggagggcatgtgtctaaccaagtcttccaatctagtttctacttattgattatctggtgtgattaacataatgttattaatatagtggaacaacatgatgttaggcataatctctcagtagtaggcatcacgtgagactttattgtaccagatgacaagagaataaacatagccctggaggataaatatatatgtatactgttatttatcctgcataaatgcaatgtatttctggtactcatcattggtggggatggagaagagtacattttccagatcaataacctcctactatgtatctgaggcttttctcaatctattttaggaaagatacctcatctgcacagtatcagcaattggatctgttacatgttggagtgtgcaataatttattggcatcttcctatgtccatgtgactttgtggtagggttattaaatatggatacaacggggatcatctcccccttcatcctttaggattttaaatatgccactaatttctgttccttgcctcagattcagggccaggactgggatgcatgagcttgaaagtgaatgctttcttaaatgttgtgccctaggtacttcaccggcttcatcatagtcctggttttacttaggatgcaatattgtttttaatttaaaattttggtgtacttggcttcccccactatgacagtccttgccacatgtgccagtgaatcagtggaaggtcctgccaacaaccacatgcgtacctgccaactataagtttgaggaccaaggaaaagatcactgggtgtgatcattttcttgggtctatggacccaatgtaagctggacctgagccagaactttacttatgacccagcccacaaaccatactctaatacaagtgccatatgatgtttctgaagtctggattttaatgtcgaattacattctctgtttaacacttctcaaaatttattgatatccccctttcctgagtgaaaaatagtcaatgtttgtgatcttaggtgtctttggaaccaagtgactacattagtttatttactttttgtaatattacatggtctttccacctgaggacacaatcccttcaccaatcaatgtataatgtatctgaaatttggctccattccctaaattgagccaaggactgtgattttattactaaggtgatgttccttagtttcttgtttattttgtatttcttttgattgtataggttcaacaatactcttatttcctgcccatcctcttgctcctggcaaatactttgttctattaactctctgcactgttctctatgagttagcctgccctggctgtcattctgacattcatcatgatctttgtgtctactttactgatgtttgagcactgcaacctggctcctgtaattttggtatcccatcattccattgctattaggcagccccattctgtaacagcacctcctttcattagcctgacctaaagatgacagtcagtatgagtttctcaagattctgggcttgtctctctagcacattccttatttctctggaagagagtcctctgaccatttcacagaacaaatccaactggcctttcatagtatatacactctcatatttccacttctctgagccctttaatcctttctttcaacaccgaattcaatagctctggcatttgtacctcaattattatgggtcatctccccgtcaaagctttcaagaactattctaccagcaaattagcacccagagtccttgctgggtattaaatcctgtatcttgggatagtgctcatatgtcagtaacctattcttgtctacctgtgtgttcttctccctaggtaaagaatcttcaggatccagtctcatactcttctggctactgccagtatgatccggcttggtttagcagctcctgtagctctgtggggcagagcctactttaataggctaaggcttccctgactagtttatgttgtgacttaatcctacatgttggttatgtggccagtagggatggtgagggtagattcttaaaggagattgacattgtcttgtaagtcagaggactgttatttttcttcaaacaatggggacactagtttttgacaggttccacttctgcagacccagtttagggatctgtagggattcaaaatttaagaatttatctacccagataaccttaccccaattctcagggtctcaccactcctcgatttatgagtttatctacccaaataatctgatctttattcttagggtcttgcgactcctttgtagtcagagctctgcctgacagagcggacttaatatttttgagaatccaaccttctctggacttctgtttcccatataactgtgtattgcacttgatcctcagagatttttctgtcctctgattgcaaaaacaatcacccttatctttaaactggtgattaatagcccttagcatctcattgtctttcttcaatacattgatcaactctgcacacagccatcctatctctattgtcctataatgactactttcttgtacctctcaaataccagagatactgaacctgttggtgcacttcctttcacaattatcccatcccatttcactgctggtcaaagttaaacacatgtactgcgaaggggctatcagtgctccatctttcatcaatgatggagtttttactaccagctggtaggtgatcatgctccaaaataccattttagaatgttcactttgaccacttatatctccaagtgtcaaagtcaggtttcctggaaaatagactctgaaatgcagatgggcatgctggtgttttatctgggagtaagggatgcaggaacagacaagagtgaaaggtgaactgtaatccagtcataatagaggcttcagctaattaaatggagtgctatacatttgagatgtcccttcagagatatccctaattaaggcaagagtcagacgtttgtatacctacattggcttgtccttagatgtgggagggaggtgccatggagagaagacaggcaaaacagatctctttgggcaaggatagtttattgggagaaattcagctgagatacaccagcagcaatattccctgccgttggattaggggataccttagtcctaaaaggccatctcaggggcacaccaccaatatatagtactaataacctaatactttctctacctgcttttcaggaaatttcatgtttagtagagaatagcaagaaggtgtaatagagaagaagaagcaaaatgtggttaatattaaaatagcttaactaatttccagaatagtgattgcttgttctgcatatcttaatgctaaagggaaagacagaatgtggtacagtacactgagtttttgaattctagaaacctaggtttaattccatgctagctactttgagcaagtaactttatatctatgtctcactttcttcctctgtataaaattgtactgatacctctcttgaagaattgggaaatttgcctgagtccaaagatcttaaaacctctgtctcaagtttcctgctatactggtaggaggaacttaataaattgaatttctttcctgcttctaccatcatgcagctactctgtcagcagtggagatgggtttgcattgagccgtctactccctctaaacaagtactcagagagatatgtagatggctggtcttgactgtgtagtacatgcattttctgatagtaaaacttaggcttttgtctatatgaagccacttgcctgggaagcctcactccacaatttcagattcattacctttatgttcagttaatcatctgtgcccatccaaaagtaggagatagtctggactcagaaaaaaaaatagtactgacacgtgtgcactttttcatgtgttaaatgctcttggtaaaagtccctacaactttaataatcgggaaaatgcagatttgtattacaatttcggaaccattaatgactggagttaagcgtaggggacaatgcatgctaaagaggattgacccaattttggatctcgaccagatattcacggaaagacaactgttttctgggcaggtcacacctgttttattagcagtaatatgagcctttagggtatcacacagaaattaaacagttaaggataaatgacctaagaggacttaacaatttaatcctaactaaagagcaaagagaatgcaatctagaaacaggattgcaagcagaattgtgggttaatgaccttgtactttttaatttaatggagcacacatagtcctgggctggaagtaatgaattataggaaataaatacatatactagaattttatgaataaattattgtaacactaattacaattaaattgccttgttttaatatgatttagtaattaagccacaagtggcttgctgcctggtttttgcctgaacaggcaccaaataaaagtatttgactcagcaaaaatatttgtgaatatattttcaaactttttattttcagtaagtggacattgataggaatattaataacgtaaaagaattacttcgttctttttgtttttcccttttaggatatgcatctgcgtaggaaaaacatcactataataagctgggtaagcctgggccctcttgcattcaagaaacactgtcattgctgacttagttctctccccaaggggagaattgtttccaaatcattcaattccacctgccatctattcctcagtactaaattagggcaactctggtcagaaatgaaataacaactgtccccttatctagatatgtgtaagcctctcttggtttcacccaggtcagttgccttccttctgtgtactcacaggaagctgtgagctagatcatagttagatcaaggggacaattgttatttcatctgtgtagcactgttcttaccacattccaatcacctgcgcatgattctgctactggtctagatcatatttatcttgtatctccagatgttgtcatatattaggtgatcaataaatattaatcccttgaaggaagggaagaaggaagaaaagaaggaaggaaggaaagatgaaatgggatttaatgtgcagttgagtaaaatcactacttatctatttgtattgttcattgaaaaaattcttagcatttgccttgagcagatatctataagaattaaaaaagaaaaagaaacatacacacaataacagtaggaaagagtagggagacagaggagattaaaacaattttctgtcttcataaaacttagagttcatctgataaaatttatacacacaaaacaagcaaatgaacagacaacgacaacaacaacagaactcacaataacaaaattacttgtcaggcactgcagtggtaatcatattactttttttctcactgtaagactacgcaatagatgctattgtccttacaattttagagataatgaaacaggtaaaaagagcttaataaacttcttaaaggcctctcacaatataaaagatggaacccattttttaaccaagaaaatctggtttcataacccatgcaccaactaccacataatatcattgtcaaaaccataaatattatatgttcaaaggaggaagaggtcattgatacttaatgattgtggtgaccggattacaaaatgtgattacaaatcacaaaaatgtcaagaactgtaaagggtctgaagttttaccctacttgcaagctatcaagtaaccagccagagtttaatttaggatattagtagaagataggaaacatctgggtcaaagacaatggacagtttatttcttgtagcaattgcagatgccagaatactagcatttacactgtttcctcaatccctgacattcttaggggtatactacagcagaagatccctaaggttagataatgcaatttttaagcagagtgttgtaggaaaattggcccttttgtgtcagagagagatagtattctcatagtccaaggatgtaggcaaactgctgtttgctatttctatcttccaaaactgttcattatacaagcatccttgaaatttgaaaatgttgatataattttatatcattacaaagattctttacagttaaacatactgaaatttgataaaaaccactgtcaaagagcaattaaaggaagttgctgtaaacattgtataaaatatttgtaaaaaataattatacagttactaataattttaatccagtaattctagaatgggaataaacactaaggaacttcagaaagcctttgtacataaagacattcagtgtagtctgtagtaaaactgaaagtgctaaagtatttgtaaatccattggagtatcattattgttttttacttgtctaaataacatttggaaatattcatgttataagtattatttacatataaaattctgtttttccaacttgttttaaatatatcaacatacaacaaatatggtattttatttttttattcttacattcgtatcatattttcgtaattctctacagaggtatatattagttgcatgattaaaaataataagagataccaaagaatttcactttaaatacacatttatcacacactgcttggcattgtgccagattttcaagggattaaagggaaaacatgacatataatttgaggttaaggaattcacaatttagtaattaaaaacagaaagataaaccactactaagaatgagtggctcatgcctgtaatcccagcactttaggaggctgaggcgggtggatcatgaggtcaggagatcgagaccatcctggctgacacagtgaaacctcatctctactaaaaatacaaaaaattagccaggcgtggtggcacacacatgtagtcccagctactcaggaggctgaggcaggagaatcacctgaacccaggaggcggaggttgcagtgagctgaggtcacgccactgcacttcagcctgggcaacagagtgagactctatctcaaaaaaaaaaaaaaaaaaaaaagtagattgctacaaattttcaaaaaagctgcaagtagcctgatttggccaacaagtgtaaggagctgattgttcaagggaaaagcagatgctccatggaggggacgtatatttgtcctgggccttaaagaaagagattctcctgcctacgatgtcctggggtagggtcagctggggagctctgagagtctccaaccttgatataacaagtgaagggagttctggttcaaagtaagttttgatgaaatgaaaaatcatcttcctgcttggagaacagatgtactcatctacgctaggatacagaaaaaaaaaaaaaaaaggaattgcaaggagactaggcccagggagggagagttggcagaggaaaaagaggctatgatttatagacaaagatgccaatttacgttctcttgctaggggaaaaatcagtatcagtatcaaatagagtagctgcttctttaaccagagtgaatggggggaattagatacatcaaaggatacatgccttttttgggtgtggcgggggtggcagtacctttccataatgcgtggatttggagaatagaggaagggcagataaaatgttttagagattttgagatgcccagcaatggcctgctgtcctactggattccgaattaattgaggatagactaatacactggttttcttggctaagtttccacataggatataacatttggcttctccccaggtctgccaagtggtctttctaacaagagttgagcaagagttagatacagtgtgcccctgtcttttcttgcttagcaatacactaaatttgggaatgataggaagatgtgggttctaatttggaggcacaggtcttggtatttgctcattttcctctttgcagaagtttcataaggaatattttcttcgtttggtggtgtttaaattttctatctctgattgctttaagcaattgtgactccatggaccaggaaaagaaatacttaagcattcatctcattttatcatagtaaaatccctattcagaggaaattagtttgtccccagctgaaagttggaatcaatagccattctgtgcaccaccactttagtgaacaagatattttattaaattagggtagtggatgatggagatgtccttggatcttatcaataatgaataagctgttgtttaaaggaaacaatatgggtcctctcctggcagaactcaggctatatctctgtagggacagattttctgagtaatctgatgatcagatttggccttgctgttccaggcaccaatctaatgaaattacaatcttttgtgctcagcctgactcactgaggaggacagctcccttcaaagaaggccttcaggtgacttgcaggaagcccctggagaaaatggaatgaaagaggacaaggcttatatggagctaagtgaaatatgagaataacttacaagtcctggctagataaggttttttaactattacatataaacattattattactaattataactattaataacagtgatttcagcgatttcattgtatcacccatgatttaatgcgtatgccctgagcgccagatacagtgcagagtgacatatttcaattatcctgcaacaacctcatgagaaagatgctattaacatcatcatttgtttggatgagaaaattgaagcttaggaaattagtaactgtgcgaggcaatatgactagtaattggtggagccagaatttaagtccaggtttgttttatgccaaagctcatgatcttaacattacacaaaagcctgctaattccttcatctaccatcccacaataatgaggtatacttgaacctgagccacataaactcatttctttgctaaaggagtatcctatcctatgacagaaaagaaaaaaaaatcagcagctagttattggtaagatttgggagaatatcaaaatttcactggcctaacaatctatcctacctgttttctataggcctgagatccttttgagttaccacaaaagactgtgttcaaatttcaacttgtaatgtgtaagaggattcaggggcagtgagagaagagaaacaactcacttcaccatcaacagagctaaactgcttcttaggactatttcctgacatcacatagtatctgacaaatttgaaataagacaaaacattaaggagaaagggaaagtggaaaaaaatcctccattaaataaaatgtaaatgtgagaagggtaagtttgttgcttctttaatttcccagaaagccaagacgtcgctcatttggttaaggtaaaatctccccacctctacattttagttactcttaaagttggggcatactatttatacaatatacaaatttctctctaataaaagcaataaaaacagtaatgtctgttaagcattttgacgtatgttatcctgttttgctcttacaaaaacatgtgagagggtattttcatctccattctcaggatgaggacattaaggctaaaacagcaaatgtttcacctaatgtcatacaactcaaaattagcagagcgagttccagactatatcttcagctataaatattctttatgttgtaaggttttatggaaactgagacagatagaaagaagtcaattatgaaggcaagatggagaaagaagaaagatatgaactttgactcctttcagctgggacatttttcctgctcatacccagatcttggaatttgaaatgaaaaagattgtgtgtacataattgtggcaatttcaaaacatggacacacattcctcaatattccttccattaagaggtgagatctataccccgaactatggatgtatttatattagcttttaccaattgggtatggcagaggggcattatgtaactttcatgtgtaagccacataaaacatacaatgacttccttgttcactgacagagtcatccttagggccatgagccacgacataacaagtctgtctactctgatgcttccaagctggaaaggtctcatgtagggtctcctgaccacaggtgtagctgaacccaactttccagccatcctcagaaaggtgtcaggcctatgagtgaagccattgtggactctctaggccactctgtctgccagccgtataccagaagtgacttttgtcaatgccacatggaacagaagaatctctcagccaatgcctgcctaaattcttgatccacaaagatgtgagctctaatgaagtggttgttattttacgctactaaaatttcaagtagcagtgataggtaactggaacagtgtgtgcctgtgtgtttgtgctaggagagggggatacaggtaattctaatggccttgtcccagacatagaaattagctaacagggtgctaagggcagatgacaatcttgattttaggatgtggctcagagccatccttggtttctttttctcatccatcttggctaccttagagcatagtggcctgagtggttttcagatcacctcattgagaaggctggggtctgtgtagagataaagaagtatgcctttcttacttattagagttttaaaagttttttatttttatttctttttcaattacccagcagtcaggaaaagcatgttattaaattctgccttcaattgagatggcttaaaaggacagatttttatttttttcagtgaaaatgacagatgccatgtttttcactacatggtgttccatttaaaaaggagcaggaatttagaggtttttggcagggccaaataataattactattattattattgataatgccaaattatcattatcatcagcagcagcagcatcaaatgtcccaaataaattaatcatcagaagaaaacaataagccatataatcacatttcctgcttgtaacagtgataattgctccagaataaaacctaggctttgatgatggctaatcattgctagttagtctaaatctcagagaaacaactctaaatctccttatactaggcaatccagcttgaagctgagtagaaaacacacacacacatacacacacactccgtagtggcagcttttctttgatggtgatgaaagctgacatatggcataggtcccatgagacaaatatttgaaaactcgatctgtgcctttaaattgcctctgcacacaagaaacttaaacctaagtagggagaccactcttagacaaatgtcgtagtctagcttatactgctgtaacagaatacccaagactgggtaatttataaagaacagaggtttgcttgccttgtgattctggtggctggaaagtttaagattgcacagccgatctagtgagagcctcaggctgcttcaattcacggcagaaagtgaaagtggagttgctgtgtgtaaagagatcacatggcaagaaaggaagcaagagagcaaaaaccaaggaggccagattcttttctttttcttttttttttttttttgagatggaatttcgctcttgtcacccaggctagagtgcaatggcatgatctcagctcactgcaaccaccgcctcctgggttcaagcaattctcctgcctcagacttccaagcggctgggattacaggtgcccaccaccacacctggctaatttttgtatttttagtagagacgggctttcacgttgatggccaggctggtctcgaactcctgacctcaagtgatcctcctgcctcttccttctaaattgctgggattacaggcgtgaaccaccgcacctggcctcagattcttttttaacaactcgttctcttgcaaatgaatccattcctctggaggaagaacttacccctttaggagaaaggtcttcatctattcatagaaaatccaccttcatgacccagatacctctcactaggcccacctctcaactctgctacattgggggtcaaatttcaacatgagtttcgttggggacaaaccacatccaaacatgtaacaactggggaaacaggctcatgactcctcatacacaggaaatgcaatcagttttaggtgcttttgtcttggtctgtagcactgcccaacacagtgtgggtcataagaaaataggttccatattctggctttaattcccatcttggccccctagtttctgagctatcttagatatattttatctctctaaaactttatgttactctctgtaaaataaggacaatgatatgagctaccatatggcatctttttgaaaagtaaatggatttaatgcaggagaagaactaaccagtgtctgacttaagtaaatgtctaatacgtgttaggcaaataaagataaaatggcaaggatggatatgatcaggtggagcccaataattcatatgagaagctacctcttagggttatgccaggtcagagcaaaggaggctgtctggaatttgattgcgaatctacacaggctactcaagaggaggaaagaagctagagacatctgcagcagaggggaccagatgacaaggaaggttttaagcagatggtgggatgtagagcctggaatcatttcagatatgacatgtagttggctgagggcacttcaggtcccctggcaattgatcctagtaaggctagagttttttaggggtggcagtggaagggacatcaaaaaataaagatagccagatttatttttcaaaaattttacagaaatctccatctttatcctatgactcatttcttcttttgtttttattttatcttgtttatttttagagacagggtcttcctctgtcacctgggctagactgcagtggtgcgatcaaaactcacggaagcctcaaactcctgggctcaagtgaccctcctgcctaagccttttgagtagctgggactacaggcacccgccaccatgcttagctaacgtttttggattttttgcagagatgggatcttgctttgttgcccagactggtctcacattcctggcttcaagcattcttctcgccttggcctcccaagatgcttggattatagacatgaccatttattctgtcctcttcaggcttcatcctcgaaataggactttggctcttgcagcctttgccatggattggatctattaagtgatgcttcctaagtttaacatgagccagagagtctggaaagtacattaaatttattttaggaaactaccaatctatgccccttaatgtcagctccccgttctcataacctcagagtgcatgtccagatgccccaatcctacctcttcttgttcttccaacaaacctatgaagaaatcagcaccagctaaatataattcaagaagacacctgagtggaatgtcttgcttggaaagaagactaagtcgatgggatccctgaagttgagaatttgaaggaggaggcttggagggaaaatcttaaggggatgtgagaggtgctctaaagtcaagattgggactcacagtactagactacatgcacacagagttacaaagaattagattcccaggccggacacagtggctcacgcctgtaatcccggcactttgggaggctgaggtgggcagatcatgaggtcaggagatcaagaccatcctggctaacacaatgaaaccccgtctttactaaaaccacaaaaagccgggcgtggtggcgggcgcctgtagtcccaactactcgggaagctgaggcaggagaatggcgtgaacccgagtggtggagcttgcagtgagccgagatcacgccactgcactccagcctgggtgacagagcgagactccgtctcaaaaaaaaaagagagtctcagaggaagcatatgaagaaaatagaatgaagcagatgaggagagaaatccagagaagccatgcgcaaagcagattaagcttagagaagtcaatgttttgcacttcctgaggcccagcattcagccttcctagtgttctctccaaccaccctcttcagttcagctagtttctcttcctgtccacaaaatgagttctaattacaaaaagaaccattgttttgctgttgaaccataatttgaggtgcaaacataccatttttttccaagaagggtcagtgcacagcggttgatgctctgagaatgctttagggaaagcatatgcaatgacattctgcaacaggctgggcagccacaaagaagccaccttgtttccacttcatctaaaagatgacacagcacctcttcttaagaaagctttcctgaggtgcagtagaggccttctgacccagtagaaataagcccagtagaaataagtttggtaggtttggaaattcaacatgcccaagcaccagctatgtggtgctgggtttcacttctctgagcagcagttcccatatcaccagggtgcataaatgaataaacaccttgtatgggttttgtgcactttaaatataatatagtctgcagagcttctggtctgttcttggcacccaggagctgacctgctgtttcctcatagggtgattttgtgtaaattagaaaaaaggatctcttcctttgagtggctaagttggcaactggaacgtgggctgaatcccaccctttatatttcctctctgctgggggatcttgtttgatgcacaaccagtatcggaacacatggaggcactgaaaagttgacatttattaactgaccattattacaatgttgctgcagatcacctatatccaagttcatttccttcagcaaaacagcaaggatacgtatatgaaacttgtaacaagtattattttccactgtacagattgtttcataaaaaagaaacagtaaggttgaaagcaaaagtgtcatcaagtttttcagttggaggtaaaaatcaatgcaatttgcagtattttcaatatcaccaattacatcttattggtcataattgaaagtagtttgcacttacctattatacattattattttaatctgatgcttagctacttggcatcctaagcactgaaatagaagcagattaaaattactgtaaaatacatccctgtgttcttaaagattggctaccagctagaaagcagttgacctatctataatgcacaggacataattcatattaacattgcaggaaacaaatgactcgcctaatttcatgtacatggagagttaaggtttctgatagatttatgagattcaacatgctgacacttttcattcactgaccttttttttttttttacccacttcctactgaggacaggaagataagttaatcttcaagccctttggataatctttccctgggtctcagctgaccttaaatctatcagagaggaatttgttcaatctgacttgatgccacaaatggtagcagtctgaggccctgggctaaagcagctctaaaagcgatacaaacctcttcaagtggcatttgcagttttgacgacaatgtacattacaaattgaattgaattgaaactcaaacattgtttgagtttcccctgttataggttgacaggcatttgacagacaactctggatcactgaggacattgctcagccacacaatgacctcttctgacatttttcgggggctgggggtgatgggaatgggaacatgaactcagaaccacatgattctctcacctccagaacaaggtgggatagtaattgagtaaaagaagccctcaagtaaatgctgagaatttagaaatattcttcggaagaaaaggcagggaccacatatttgtgcacagagttggctactaccagctctgtgtgttgacacatgctagagaggagaggttgaggaaggcttcaatccaacacctgtccttgaataataaagaccataagaaagccaagaatggcaacgcttctgcaaactgagttctctagggtttgtttccatctgtctgcctcatagagcagtgtgtcagtactcaactctgaacaagaaaaagagtgaagaattttccatgtggtaagtctaaaagtgctcagtacacagataatcaaaaaagaggtcttccctccttcttcacaaaggacaccctgatcctctcctactagcattgaagaaggaaagagttaactatgctgaaagagaagctgcaactgcagattccctgagtctgtgacagaaacctgcaccctcagcagcagctagtgttcaggaatcccctgcaccctctgtcaactccagaagccagatcaatacccgtatccattggatggaaatgtcatcttggcaatgagagggatcccagccaattctctatcagggccaccttcacctataggcaggatgagtgttcccttggactgaccatcacatgtgctctccaaccaggtagatttcagtactaagtggagtatgtagtataaaaaggcaaagagaccagagtttgaggtattttgggaagagcttagtatcatgtctgaaacctagtaaccctacttaaagaagaagacattgcttttacttaaaactctaccaacagagaagcatttctttaagttaaacacccccactcctgcccactgcacctccatgcacagtcattgatgccaatttccctgatagatgtactcattaagttaccagcatcaagtataaatctgtatcaccgatgaccttcctagggagcttttctagggaagctacaacagccagacataagaaggcagagaaaggagcaaacaaataagttccagtgtcccaaatctcagtgaaatttgtattatttagagaaaaacaggcatccacttggtagataccacttaaccatcacaaacatgttattaaacaacaatactttaaagaccacttaaggctgggtgcggtggctcatgcctgtaatggcagcactttggggggccgaggctggtggatcatgaggtcaggagactgagaccatactgctaacacagtgaaaccccttctctactaaaaatacaaaaaattagctgggtgtggtggcgggcaactgtagtcccagctactcgggaggctaaggcaggagagtggcgttaacctgggaggcggagcttacagtgagtctagatggcaccactgcactccagcctgggcgacagagtgagactccgtctaaaaacaaaagaaaacaaaacaaaaaacaaaacagaccacttaaatcctgttagggtagggagtagaaagtcttaaattataaaatgaagaaaactaagacttctatactgaacaggaaaaccacaatgctgagaaagtggcaatcatccttacaaaaataaaaatgagatagaaaagtaaatgggaaagcagagaagaatctaatgccagggtaattctttggcttctaactgagcatgagaaaaatctgaggcacaaagcagaccataggtgatactaaactatcactgcctgttttcaaaaagcagcatgaaatttttctactccctgacattgagattcaagtgatttgagtgaaatataaggttcaacactggtttagtttcacttgcctgggtctgagtactagaatgggacttcctagataaggggtcatgggcaagtcacttgaactaagttttagtttcctccactctaaaatggaaattatatgcgtaattaactgaaaaagctttatgagaagtaagcaagatggcatatggagaggacttacaaaagggcttcggaaatatttattattattatacaataatacatgatattttgtgacggttaatactgagtgtcaaattgatttgattgtagaatgccaagtattgatcctgggtgtgtctgtaagggtgttgtcaaaggtgattaacatttgagtcagtgggctgggaaaggcagaccacccttaatctgggtgggcaccatctaatcagctgccagctcagctagaatataacccaggcagaaaaaaaacatgaaaagactagactggcctagcctcccagcctacatctttctccagtgctagatgcttcctgccctcaaacatcagactccaagttcactgactctccttccttctcagcttgcagacagcctgttgtgggaccttgtgatcatgtgagttaatacttaataaactcccctttatacacatacacacacacacacacacacacacacacacatatatatatcctgttagttctgtccctctagataaccctaatacagattttggtaccaggagtggttccagaggaacagaatattaaggatgaatttcttttgttgatctgggggtttttggagttggctgcttaatataattagacccaaaaatgctaaagactttacttctaatagtatggagaacactgatagtccttggcatgaactgtttagagagttatgcaaaataaatgcatttgacattcctgattcactgcttatgagagtcaaagagttgaatgaatctgtatgtaatacctaggactatatgtggagaaccaaggaacacaatgaagttggttggttgctcctaagttcagtggacaaagtgaagaaagaaaatgatgaactcagggattctaactcccggcttcagaagcagatactgagtctcaaatctggtaagattgccctgagcgagcatttttatctccagtagagaaagagccgaaaccatggaaaaacagatgcaagctcttatctttcaagtagctgacctgcaacaaaaggtacatgcacagcctcaccaggtgtctgctgttaaagtgagggcactgattggaaaagaatgggaccctgcaacttggaatggggacatgtgggaaggaccccgatgaagctggagacactgaatttgttaactctgatgaaccttttttgccagaagaaacagcttccccatctccggtactggcaacatccccacctcaatccatgctgtcatcagtgtttccacctttgtctgagagacaaaccctgcacagcctgaggcaatggcgatggccttccctgaggcagttgcagggcaagataatgttgattctcctcaggagccacacccaacacccctgtttaatttaaacctataactagactaaagttgaggcaggcccctagaggtgaggttgagagtgtgacccatgaggaggtgtgctacacttgaaaagaactgcttgagttttctaatgtatagtaacagaaatctggcctgggaattttgagttttctaatttatattaacagaactggcatgggaatggacattaaggttatgggataactgtggaaggaacatagagttggatcaggctgaatttattgatttgggctcactcagtatgactgactctgcatttagtgttgcagctcagggagttaaaaaggattctaatagtttatttgcttggttagctgaaatatggattaaaagacggcccactgtgaggaagctggaaatgcctgatctccccgggtttaatgtagagaaagggatccaaaggcttagggagattgagatggtggagtggattagtcacttcagacttactcaccccagctgggagggtccagaagacataactttgatcaatatcttgtgaaatagatttgtgaaggcatcatctgcatctttgaagaggcctgtaattgcttttctctgtatgccaggtctaacagtgggaacctcagtcactcaactacaaaatttaaatacaatggaaataattgaatcctgaggtggcaggggccaagtgggggcactcaaccatcaaaggaaaagggggtgtagctactgtaatggacaacagtggcaaagaagcaatcagaacagtctgatttgtgcagagctctggcattggctaatcacggtgttcctagaagtgaaattgataggaagccttctgcattcctacttaatttatataggcagaaaacttttgggtcgaatgaacaaaagactaatttgaattataaaaacagagaatcacagcccctcaatcaatttccagactcgagccagtttacagacccagaaccccttgaatgaaggggatgctgggtccccttgaggaagaactccactacattaccaaaaatttatgctgttaatctttcttacatttttccccaaggatacctccagctttttaccagggtaactgtgcactggggaaagggaaatgatcagacatttcggggagtagtggacactggctctgagctgacactgattccagggaactcaaaacatcattgtggttccccagttaaaataggggcttgtggaggtcaggtaattaatgcagttttaacttaagtctgacttacaatgggtccagtgggtccccatactcatcctgtggtcatttccccagtgcaagaatgcataattggcatagacatacttagcagctgacaaaacccccacattggttccctgactggtagggtgagggctattatggtgggaaaggccaaatggaagccattagagctgtctctacctagaaaaattgtaaatcaaaagcaatatcgcacctctggagggattgcggagattagtgtcaccatgaaggacttgaaagatgcacgggaggtgattcccactacatccctgttcaactctcccatatgacctactggggtgcttactgaagactaagggaatacagaatgggtagtagaagaaggtagtcatcgataccagctatgaccacgtgaccagctgtagaaataaggactgtaattgtcatgagtgtttcctccttcttttgttaaaaacatgtttgtgcctgtatacacttgtactaagaaaatatcttcatttcctttttcctttatcatgtgacctaagatttatcaaattcatattagcatttaagtattgttaactttatgtaatagtgtttgggctgggtattggtgtgtttctggttgtaggaaagatagctgtattatgttaggcataattatgacctcattattgtctttatttgaagattatatataatctcaggagatgtgtatgggttcaagttgacaaggggtggacttgtgatggttaatactgagtgtcaacttgattgaaggatgcaaagtattgaccctggttgtgtttgtgagggcattgccaaaggatattaacatttgagtcagtgggttgggaaaggcagactcactcttaaaccgggtggacaccatctgtgttagtctgttttcatgctgctgataaagacatatccatgactgggcaatttacaaagaaagaggtataactggacttacagtcccacctggctggcgaggcctcacaatcatggtggaaggcagggagaagcaagttacattttatgtggatgatggcaggcaaagagagagagcttcccattttagggaatctcccattttgaagaccatcagatctcatgagactcattcactaccatgagaaaagcacaggaaagacccatcccccctaattcaatcacctcccaccgagttcctcccatggcatgtgggaattgtaggagttacaattcaagatgagattttggtggggatatagccaaaccatatctctatctaatcagctgacaatgtggctagaatataatgcaagcagaaaaaaatgtgaaaagactagactggcctagcctcccagcctacatctttctcctgcactgggtgcttcctgcctctgaatattgggctccaagttcttcaggtttgggacttagaccagctccccttcctcctcagcttgcagatggcctactgtgggacctagtgaccatgtaagttaatacttaataaactcccctttatacatatacgtatctatcctattagttctgttcctctagagaaccctgaataatacaatattatataatataatcatatacaatcatcacatataatatatcatggtaatatatcatcatcatcaccactatcaccgcttaacatacagaaactatgagaggcatagatggcctcacaatataaaggtgtgaaaaagcaccacatgctaccctgcatttccctaaatcaccataagctgagagttggtcaagtggaacatgaggacctcaagaaaagtctaaccctatttaaaggcattgaaaggctatgaaattttgccgtcagaaacagagaactctcaattgagaagctgccccaaatagagaccccttaataaatcaaataacacaagggcatcactcaaatctctatcaacaaaagatgaatgatctagggtccctgatcccaagtggcctacccctggctttgtggtcagggagacttgggtttagaatgctcagcacaggaggcaaaggctctgtgaataaatgaggtcccaaatcgcatagggcaggcagctgcaggctttcatgagcattaattttgcttaatattacaaattttaaatgctacaaatacaagcatgacaaatagaaatgcacaaagtgatcattaggatcttaatgtgtgtgcgaatttgcagtcagaataggcacactgcaaacaaagcactatataaatgctaaatacttcaccatttgctactacaataatgtgtcatatggctgaagtttttaagtactttatgttctctgctggtatgaagtcattaatcccatttatacaattaataaggaaaccatggatccaaattagggatcagagaaaaaaaactggaattaaagacaaatgatgggtcatttttctctaaagctgtaatgatgctttgctaaataacacattttcccctgaaccctattttaaacactgcacaatccaccatgaaaaaaaaaacctaattactatcactacatcaatgattttgagttggacaaccacatatttctacgacccgacccagaatgaacttgggtcctttaaaagcctccactaacgcattcatgtttccatcagccccaacaggctgagtcagcttttctccaagtgcagatgaaataggttaaaaagttagagcgtccactttgcagggttgcctattttaaaattccaaccctctttcaccagggaaaatagtatatcctaattcatgatttaatgagtgagctctggagtcacacagacctggtttgaacacaagctctgttgcaggttgaacaaccctcttgcaggttacttggtatctttgagtctagtgtctttatctttaaaatgggtgtaatgtatgacctgcttttagggttagtatcacaaatacttattttttagtaataaatgagcaaagtcagaatgagaagaaaagaaaaaaatgaaaagaaagaaaagtcaagctacatcttttcagtgaaagatttgaaatagaacagatggaagaattctttccatagtcagagtctgagttctccttcttgaagttaaaccaaattccttaatcaagaaaaaaatgtaaaattgaaagagtcggaagcttcatcctaggagcctgagtcccagaggacatcagagcaacaatttgtatgatgttggtattttgatgttgctggtggtagtgtttctccctcctcctctttctcctcctcctcgttgtttttctttctcttcttcctttctctctctctctctctcgccccctctctcattctctgcttataaaacacgaatttccctagagaaagaaatggagaattgaaaccttggctttacactccggctgaaaaaagtcttaaactggaagtatgttagagaaaacctttggcctttctgtgcaattaaaagccttaattagaggaggaagttacagtaaaggagtataatgcaacctaagttacttttattaaccactgtggccacacgtatcctcagacccattagggaaagtcctcagttcactccaatttggttctactgggatcacttctcacctagacagtagaaacctagagaaagagattagatagatggatggataggtagatagacagataaatatggagatggaaattatctatctatctatcagataaaaataaactaaaatgaaattaaagaaaattttgaacttcaggtaaatgcttctttaccacgggaggatgagttcctgttctcaaactctccagggccctacgtcccctgatacgcatgctgacataaccccagttcatgattggtggtatcactggattgaagaaattggcctttagctaaaggaaggcaaggtagccttggtgctgatatggaaaggacacaaaagatgctttcctgcctcaagtattccctctataatactcctggtgaggtttctaatttccacttttggtcaccagctgtggaaagacttctccaagtgaatggagcacttggctccaaatcaggagactcgttccttgtccttgtccaggcctgcaacaattggaatgcttcttactcttctgctttctctcggagggttgatgtgaacatcaaaagaaagactaaatggaagaagctttgtagcgagtgaagtctgatattagtgcagggtacagttgaaataggtttatctaagtataatgacaacatgccttgcttttcctgagacaatcccagtttattccttctgccccagcataattagtaatacccatttaactttcagagaaaatacattgtggtaagtctaccattaagtcactacttgtatttaggacttttgcccaaattagacagcaggaaaaaagagcaaaaggatagatagaattgtatgtgccctgtctccgtgacattggccaaattatttgtattccagaaacctcagtttatatattttttaaatgaggatacttgtagaaactatctcataatacatataatattataaatttaaattaaattcataaatattaattgcaactccctaaaaaatgtagcaaagagtctgacatatcataaaactcaatgtatattagcttacaaaataaaattacaaaacaagatggtaggttttcataattagagaatgtaatggaaaatactggatggggtacttcctgggatggataggccagaatgggtaggataggccagaattgcaggatgggatgatgccagtcttggagagaaacgaaagtctggtcctcacacctattactctccagtggggcccgtggggttagtgattttgtagcagtttgttgttcaaagtgcccttccacttcccaggctttgtactgccccagatctaaaaggtctaactgtaagatttatacagcagaaatagccatttctcaaaaaaggcaaaaaagcttggtttctccagatgttcactgtttgacatccttcttcagacaaatataatccaaggaatttgcagaaaacttgcagccctggaatttggtttgcctcagcgaatattcagtaaactcttcctagggcagaaaatctgctgtgtgatatggtattgttgtatattttgccgtgcgtcgtgccttcttctgttgagttctcagcttgaatgattcagacctcagggctaaagaggagataaaaaatttgcctccaccaccatctattttttttctatatatttctgtcctactggcttctcccatcctacagataggaggaaagatgatctgtttcccagccatgatcatcaaaagacggtgaggaaactatttaaattgtagttaagggtttttaataataagactcacactcagacatgaaagacaactaacattgtcatatatgcttttcttaaaagtacaaatttaaaactggatgtagaattgcaaaggtacttacatctggcaggaggttttgcatagacccagctgccagagtatgagtctaatgagacagaacaccatgcaacccatcaggtaaagcaaatttattactcaaatacagaatgcagggataaacagaagcctaggactcattttgagccagtccttgaaggctgaggaaagcctcacaggtcaattagagtcttgtctccatgtgcccctttttacacagaatcctagggaccttaaaagcattctgctttaggttttataccctgagtggaaattggatcactgagtaaacatgatgtagaacaacttgttctagaaggaaggagatcataccctgtattgttctggaaatttcctccatatctcaggatgttgcgttcttggtagaatctgcccaaagattgcaagcaaggggggaataaatgcattggccaagaccatctggggacttttcttcctgcaaaaatgattagaatggacttcatactaaggtatatgattacagtctgaagaagatatgagtaagatttagaaaaaggactagatgattaaatgcattttttcttgtaatttatgcatgttcacattgatattttctctctttccttctctctgtctctgtccctgtccctctctctttctcactctctctaaacacacatacacacacccagaaagaacagaatttgcattctttggcctctttatctccatttgccagtgttttttatatgtggctctggaacgctggagtaaaaatcatttgggatgttcatttgcaataacaaaaaaattctgagactgcaacacagatcaatcttgggtaggagaagaaaagtgggaattgatacttaaaataatacttcaagtgattcttatgcagatggtccacagatcaaactttgaaaaataatgtgaaacactactattcttcttgtgtcatctttaggaagcagcaagattaaaagttgtctaggaaggatggtttaacatgtatagatcatgtgttgctgatgtttctggtgtgttggctttagaaaactttagtacatttcttagtgcattgacttttaaaaattggcaattgaaaacactttctctgatcttttgagatgtaaatcttctcccagacatttgtcagttttacaacccaggaatatctttctcaaagacaggagagccaacttttgatatttagtcatcaggaaagacagcacccctacctcccagtctctgtggtagggtaagaacctaacttccatatgttccaattagcaaatccccatatgacctcacttttacaaatctccccactaatatcctccactacttttccacaattcacccccgtgcattgtggaaaagtactgcctcttgcttcagtgaaccaagttcaatctttctctcttattgcaatagtctctctccttattgccataaagtcttgaataaagccttccttacctgtttaactctgtctggtaccatttttctttgtcatctaactttaaaatgattaagatataagcctatgtttcttttcatgtaaacataagatgtaaagtgtcaagaatctcaaaccattagtcaaagttccaggttccagctgtaacatttgcctaataatttcctggaaagtttttttattttttcaccatctgaaaaataaaaataaagcctgatttgacaaggatccgatcagactccacttttcccaacacgatttaaccttataaatacttgctaaatatctggcttccattacattgttagctcaatgagggcaaagataatgtctaccttattcattcctgagtccccagtgcccagtatagaacttggcatttaaaacgtgctcatataagtccgttatctcactgctagaaagaaaaacctgagactaggtaatttataaagaaaagaggtttaattggctcatggatcggcaagctatacaagaagcataatgctcgcatttgctcagcttctagggaggcctcaggaaacttacaatcacggaggaaggcaaagagggagttggcactccacatggctggaggaggaggatgagagacagagacagaggaggtatcacacacttttaaacaaccagacctagtgagaactcactatcacaataacagtaccggggatgatgctaaaccattcctgagaaacaaccccatgatccactcacctcccaccaggccctgcctttaacactggggattacaattcaacttcagatttaggtgggaacacagatctaaatcatatcagttctcaacaggtatttgaaagaaatgaataaagttaaataacatataatataaacaacatgggaagaaatgcaagaaaaaacactaaaattttattgaccttcactctgggctcaaattaatggaaagttcaaatagtcaatgaagataacatcagaaaacctggtttttaattctggctttggcattgactggagttattgtaacactctgttttcacactgctgataaagacatactggagactgggaagaaaaaggggtttactaggacttacagttccacatagctgggaaggcctcagaatcatggcagaaggtaaaaggtgcttcttatatggtggcagcaagagagaatgagaaagaagcaaaagtggaaacccctgataaacctatcagttcttgtgagacttattcactatcatgagaataacacaggaagaccagctctcatgatggaattaccttcccctgcgtccctcccacaacacgtgggaattctggaagacacagttcaagttgagatttttggtggggacacagctaaaccgtatcagttatcattttaattattaaatttccttgattctcaagttcatcactataaataccagagacagagtaaatgattactgaaattccttgctgaattaacctcatagactccaggatgatcactgatcctccttccagctataaccatttcatagatcaaaacctgacacacaatgattgctccagagttgcagaacatgtttgtaaatcctgatacttaagaccattattcccctcctctcctttcctatttttcctttcatcctttcatgtattcatatagttattaaatgcttgccctaaagaaaatcaaaaatattttatatatgtatctcgaattaggcaaccacatcttggctgatttctctatctctgataagattcaaattctagtcatgcacttgtttcattaagtggttaaaaatatcttttttgaccttgatgcattatgtaaatggctaatttgccttgaagcatagtctcctgggaatagaactttgatctccatgaggtagccaaatacacattagggaagaacttgcctcatacccattccaccctgaatcttttgactttcaagaagggttaatgtgcttgtgtttacttgctgacagatttccttgctttcacctataaatctatagcatctatatcagattgacttccataatgtagaagagcaaaactgatattcctctgtccacatattcattgtctctctttttctctttctcattattttagatctgtaggtatcatagtttattcagtggttcacagtcattagcacaacaatgatcaaatagaaagaccccaggcatcaacctgacaagagcaagaaaacagatgactcttggaactcatttgtaatacaatagtattccagcaagctctaaatttttgaccttaagcaagagaaagctgatgactttaatagagttttctttataaacctttttctttcagcttcaaaactgctgacttttttaagccctgcttttcttatgattgctttcaaaagcatatttctgttttaaagctagagttcacttcaataatgcttggttaattgtacgggcattcacacttggtggcaagccagaggccttccttgacaagataaaatagagagagccctaggatacttgctccctttctacccacagaacacacacatcctaaatatgagaaagtattcctttggttctaattgtctaaaaagttacctaatattaacaatatttagttacacagcccaagatttaaggcatttacgatatgggggtgggggtggaaaagtgctggatagagaagggcagggttcctggccagggctccactcttgggcctgggcctatggatttaagtgagaacaggcactcctgttttcacacccaaatgttgcattttccaagatcgtactggcttgccatgccccccgatcctgtgcccatattaacccaagacctgagtgggcacacacacaagtggctgaacgttcagaccagcagacaagcaatggcagaacaatgtagcagaaaaagggagaagagaagcctgcatgtgatctgattctttcaggacactgggcaagagctcgggatacaaaaggctgtcacactggccttctgcccttgtgataaagcagagggtccattgagctgattaacacataagccatctgcagatggcaaatctgaaagaactttgtaacacacacccacttgggcttcagaagtcacagacacccactcctagacactgccgtggagctggagaccaaaagtgctcaccctaatctctgctcctgcctgtctaaatgctcctcctaggggcaaccaagcaggtgatccacactcacgtcgcaccatcctgtaagggtaatcagggaactctcccatttcatttccgttaagatggatctggattgaagcaccaccagtaatagacagtagtagtgaagttttaggcaaattacttactttctctaagcctcagtttctctgtatctcagcattatttataagagttcccatgtcataggattgtggtgggaattaaatacggtgcttgtaaagaaatttagagatcctggtacgtgacatgtacttagtaagtgatggtggtgaaaatgcgtgctcttgttttgcagctaaatctcattgctgagtaaacaagatgtctttagttggctgaagaaattaacctgaccaatggcataggaaatcctgcagtttgagccatggtaagtgcttctcactatcttatgcattctttctccttttttgttagactaacgtaaaaccaggctttctatatccctggtatctctatatcccagccagggagtaccgcatttgctttctaacaccctgtcttccataactatcacacagtggtcttctctcacttctttcttccaggctcatgattcattcaaaaacagcctttttctagcagcttcccatattttccagagttgttgacaatgaaactaaggagaaaacttaaaaaaaaactttaaacatggtctcatacaaataaattactggaattgcaaacttagaagtatcaagctgtcacgtaatgaagagaagcctgatactctttgtcccaagatatttttctagaaatgtcatttatgtcattctcagcaatcaaagctggcatcaagatccagagtaggagaatgggtcaaagatagagagctagaacttatttgacagcattgagagctcaattaatatggacccctctcttcacttgtggcagtaccaaaagtaactcaataatactgctccccccttatggacatatcccaggtggatagggtgagtaattatagcactgtaaagcttttctagagaaaactttctctggacttcaatcacttacatctccagcttcaacaatgaatgatttttctgcttctgtgacttgattctgaccctaataccttctttattcctaaatcttttgttgttgttgttgtggtggtggtggtttttgagacggagtctcgctctgccacccaggctggagtgcagtggcgcgatctcggctcaatgcaagctccgccttccgggttcacgtcattctcctgcctcagcctcccaagtagctgggactacaggcgccggctaccatgcccggctaattttttgtatttttagtagagacggggtttcaccgtgttagccaggatggtctcgatctcctgacctcgtgatccgcccgcctcggcctcccaaagtgctgggattacaggcgtgagccaccgcgcccggcccctaaatcttttttatttcaatatagaaatcaccattccacacagaaatttacactcttgtgtatagagatgtacttagcttgattgttgttaggttactttcttgtttaaattgtctttattatggtaaaacagatgtagaatttacactcaactgtttttaagtttacagttcagtgatattaaatacatttgtattgttggacaatgatcaccaccatctatcaccaaaacacttcagcttgcaaaactgaaaccctatacccattaaacaataaatcccctttcctccttcccctagtttctgacaaccacaattctattttctgaagtttgtgttacatttagaagactgcattcaatttcaacataataataatgtttgaatatcaaaagctaccattaacaaagtaaaaatatgagtagcaaaatggaaataaaattaaaactcatattacaagcaaagggctactttctctagtatggaaagaacccctataagcccataagaaaaataaacaacaaagatccagtgaaaagggattaacattattattaaatttatcagaaacagaattaaaatggcattaaactgaaaaaatgcttactgtcacagaaaacaaaatacattcaaaataaaattatactaagacgattttctatttataaggttatcaagtttaaaaaattatgctacatgtcaaggctctggagaaagaggcaattaattacattggtggtagaagtgtgtattcatactatttttattaagcacaatatggcaaccatattaaaattaaatgcacacaactttttaggaagtaaatttgattctgtgaatttaaactaacaatattttccagtaggtgtgaaatgatataaatgtaagggtatttattgcattgccacttgtaaaaacaaaactttgggccaagcgcggtggctcacctgtaatcccagcactttgggaggccgaggcaggtggatcacgaggtcaagagatccagaccatcctggccagcatggtgaaaccccatctctactaaaaatacaaaaattagctgggcgtggcggtgcgcacctgtagtcccagctactcgggaggctgaggcaggagaatcacttgaacccaggatgcagaggttgcagtgagccaagatggtgccactgcactccagcctggtgacagagagatactctgtctcaaagaaaaaaaaaaaaaaaaaaaccttgacaaaaaacaaatgtcgatgatttgtagactgattcatcagctcatgttacattcaacaagagcagacgtataaaaaagaatgaggaatctcttcatgaactgattgaaataatctccaaaatttatttttaaatgaaaaaatcaaggtacaaatcaatgtctatttgggaaaaaagaaagaaaataacaagactctaatttggtttatttataaaatatataaaaaaatacaatagaaagtgataactttgtctctaggaagaaaagtgactgccggagtttcaagagagagaaaaataattttcacaaacaaataaatgagaaaggatgttgtattcttatagtagaatgacaactaagtatttaataatgatggagttagaaaattatcaatggatgcaaacactaatgaaacagctttactgggaaaataatgtttatattgtcttaaatacatcctcacaaatcatttatcagttaccaagataaaaaacatagtaactctagaaagaaaaaccttggcagagaccaatttcaagaaatgatcaaattaatcatcattaatattggcacaaatcaacaacatgtctcctgatgatccactgagaagaatacaagaacacttctggcaaacaatgcatgactttgacttaagcatgataaacatcagacaaactcaaattgagggatattctataaagcatctggtccatgtgtatttcaaaaatatcaaggtcaagaaagctgcagattatagatgaataaatagacataacaattaaatgtgatctttgataatgaattagattctggattgggaataaaaagagacataaagacattattgaggcagctcatgtacactttttttttgggttggtattctttattattgttgagttgtatgaattatcttttttttgcatagaactcttttgggataaatatattttcaaatagtttcttctagtcggtgctttttcatacatgatcttaacagttcctcttgaagagaataatttgttaactttaatgatgtttaatttatttctagattgattacacactaacataaaattagaatgaatacatgaaattgttatttatttttgaaaatcgtctcaaactataattggaataacattgaaccaaaagaactatttgagaaagtaaacatcttatcactatttaagcccaatccatgacattttatatttttaaaaatttttagtttttttgtgcgtttttaggttttgtttttatattttttgggttagtggtcttacacattctacttagtttattcctaaatatcttatgtttttgatactatcttaatttttaaaattaacatcccattttgctgctgaaactatatttcatttttgtagactgaacttgtatgtttgatcccttaatacattaaactactctagtagcttcttgtagactttttacatagactataatgcaatatttagctagacacaattatacttacctcttcaataattatgccttttatttatttattcttattttattgcattgagtgggacctctagtaaaatgtagaatagattggtgagataagacattctttattcttctccatttaagtgaaaaacattcagtctttctccattaaattttttagttgatattaattgcaaatttttttgttgtttatttgtatattactttgctagtttgaagaaattcccttaaattcttagcttgttgagagttttgttgaatcacacatagatgttgaattttgacaagtgctttttctgcattcattgcgatgatcaaatgtttcttcattattgcctattgatatacaaaattaagttgtttggttttcgaatgttgaatcaatgttttattctttagtaaataagtattattttctatttggctggatttgaattgctgatattttaaggattttgcatttatgttcatgattaacatatacctattttttaattcatatgcactctatctggttttgttttaaaaaagtaatgctggcctcacaaaatcagctagaaaatctttccttttctatgttctgaaacagtttgtgcagattggtgttatttgtttatacattgattgacagcattctcaaataaacccatctttgtccagagttttcttgtgggtatgtatttaactatgaaaccattttatttaaaagatatgggaatagtaaaatattctctttatatttcttccagttatggtaagttttgttttcaagtaacttacctatttcatataagttgtaaacattttggcaaaaaattgtcaatcatattttatttttatttcaataataaattatctatcatttataccaatacctactctgtcactcctgatattggaactagaattttttctctctatgtccacctcccacttccaatttacttcacatatgtttagttttatagttgctttttgagagcgggaaaagtccagtactgctaattctgttatggtcaaaagtagaacatataataatttcttaataaaaaataaaccttcattgtatttcagtgaaaatgttattcaaaaatcacatcaaaggaaaatgattttgtaagtgggcctgtaaggatacttgtgtgacagtcaatatgcagggcaaattctgttggggatatttctagtaaggccaggaaagtgagaaaagatgtctaattcatatcagggaattccttcttacaacagaaagatatcagaatgtaactcaccaggaatttccatcaaggggaaacatacgtgacatttgatctgataaccagtttctttccattgtcacttttgcctcatttctaaaacatcagggtaacatttatttatcaggggatttgacgctttgtgggatgagttgatatattaaatgatttgtgaaatttaagatctcaaactactatgatagttgaaaagttgtgtagaaacctttcttggtaattggcttggtgtcttccaatggctcttccaaggaataaatcttctcacagctcacctttctctctgggcagcttataccctttgagagactagattctgattatgtctgtggatttctgtggcatgatatgagaaaatctaacaagaaagacattgtgcataaaagaaatcagcaaataagtctgagaagggaaataaagaaaccaacaaaaagcctgcataaaacgtcagaactaaacacctcccaactgctgcttgtaggaggggtagtggtacatttctaatataaaatagctagtctaatggcagttttgaaacaaagcagaaattgtccataaaaaagaagacacaaattactatgattagatatgcaagagggatcatcactattgatcctatgtacattaaaaggataataataaagcattgtgagtaattctgtgcccacaaatttaataatggatgaaatagaccaatttattgaaaaacaaaaaataacaaaattcacaaaaggaagagtaggtaatctaaataggcttaaaactattaaatacatttaatcaataattaataatcttccattaaagaaagcaccaggcccagatgctttccctagctaattctaaaaaatatttaggtacaaattaaaccatgtttctacaatcgcttctagaaaattaaagagaaaacacttcctaatttatcttagtattaccagtattaccagtattaccctgatgccaaaaataaagacattacaagaaataaaaactacatccaatatctcttgtagacatagatgcaaaaatctcaacaaattgttatcaaatgccatccaataatgtataaaagtatttatacaccacaatcaagtgtgatttactccagatgtgcaagtctggttcaacattaaaaaaaaaaaaataatggccgggcatgatggctcacacctgtaatcccagcactttgggaggctgaggctggtggatcatgaggtcaggagattgagaccatcctggttaacacggtgaaaccccgtctatactaaaaatacaaaaaattagccaggtatggtggcatgtgcctgtagtcccaggtactcgtgtggctgaggcaggagaatcgcttgaacgcgggaggcagaggttgcagtgagctgagatcaggccattgcactccagcctggccatcagagcgagacttcatcacacacacaaaaaattaatccatcaaatcaacattgtaaaaaagaaagaatatgataatagcacttgatatagaaaaatcatttgaaaaagcccagtactcattcaagatgagggggaaaaaaaacctctaagaactctaagcaaactaggaatagtagggaattttctcacctcaataaagaacatctgtaacaacctacagctaatatcatactttattgtgagaaaccgaatgttttcactttaagttggagacaaggtaaagatgtcctctcttaccactcctgctgaagatcgtactgaaaatcctagctaatgcagtgagtaaagaaaattagaatcaagacacagagaattacaggaagtcctgtaattacatcagaattacaggacacagttcctgtaattaatttaaaaaatatggcagggccacaagataaaaagttaacataaaaagttgattgctttcctttataagagcaacaaacgattagaacttgaaatataaaacacaatataatttacattaacataaaaagtgaatccttaggaataaatctaacaaaatttataagatcactataaatggatgtggaaaatgacgaagctctggtgaaagaaaccaaagacacactaaataaatggagaaatatttcatgttcatggattgcaagactcaatattgttaagatgtcagttacttccaactggatctattaaaccaatacaattccactcaaaatcccaaccgtctaattttgtagatgtctataaactcatactaaaatttattggaaaaggaaaaatataaaccaaacaaagccagaacagccaacacaatattaaagaagaagaacaaagttagacaatggatattatccaactttaaggctaacctaaaccaaagtgatcaagacactgtgttattagtaaaagaacagacacttggatgaacgtaacagaagtgagggcccggaagtagaccacacacatctgtcagtggtagatgcccttttccaacagatagaaaatgattgggggagactaaatcaagatggccaactgagtctctgtattcctctcattcatggaattacagaaagttagaaaatcataggaaaaagggaaatacaataaaaacaataactaccatcagcacacaggacattaaggcaattctgttttgatatacatctacatggtgaaataattaccaatgtatcaaaacgtcacattgtacaccctaaatatatacatttttatctgccaacaatacctcaataaaacgggagaaaagaaggaattgaggcaattctgaaagataaacagcagaaaaaatttaggtgtatagaaaaacaactagagaaattatgcagactactactcagaaaacgattaagaaacaaaacaaatgatcaaaccaaaaaaacactaggagctaccaagtcatgaggaaactatgaattctgaagacagaagtaccaaattcaataaacaaaaagataagtgtttaaagaaacatacttgatagaataaattgaaatggaatagagaataaaaatataatactctcacaacaaattgaaagtcagtcattgtgtatgataagataccttagaatttacatttcttattgtcataaataatacataaggtcattacacacacacacacacacacacacacacacacaatgacagaaaaacacatgcaatgccaatggaagagtgatagctattcaaaacacgtgtgaaaaattctgctcggatattaaagtgtgatggttagttgcagaagagccaaagtagagagaaaatatgattactacatgaattgcagcgctctcaagatacaaaattaaacaatggttagaagatacagaagcaatgtacccacaaaaaataaaaataagaaaaaagagaggcagaagtatttttttccccccaagatgagtcttgctctctctgtcacccaggctggagtgcaatggcatgatctcggctcactgcaacctccagctcctgggttcaagtgattctcctgcctcagcctcccgagaagctgggattacaggcatgtgccaccatgccccgctgatttttgtctttttgtagagacgaggttttaccatgttggccaggctggtcttgaactcctgacctcatgtgatctgaaagcagttatcttaagcaaagctgagagaaaattttccactgggtttttaaaagatgatatgctcatcattccttcaattaatgtaagatttttacttatttatttttattttagattcagggggtgcatgtgcttgttagttacctgggtatattgtatactagtggggaccgggcttctagggtacccattacccaaatagtgaacactgttacaaatttactaacacagaggtttgttgtcatgttcctcagtagcagacattataatcattttttaaaggaatttacattttttctttagttttcagatagactcatgagttttaatttcaaaggttgatcagagagagatcccagatatttttaccataataaatggtaaaaatgttgataaagaagaatttcataggtaagcagaaggaaattccttgttacctggagttcagtgagaaactcaagagacaaccaaatgtttcatttttatcaaacaggattattattttatcatcagcagcagtagaaagatctacaaaagagttatagctatgattgaagaatattcactactatgaagttaagtttggtaacaaaatataacccctacttattgtatgtattttgaaatacatgagcacacatttgactactgaattcagcataattgtatttatgatatgacaatgatgtgtaattacatttctctcaaagtcctattacaagatagaggaactttatttaattgtattatgtgttccttctgtattatatttctagcaaatcaggatttgataaattatttagtatgagctggcaaaccagtcctgcaacccctgcacataaagtaattctgattccaataaaagtatttttgacaaatggcttatgcttacatgatttatcaacctaatgtggaatggacccacagcagcggaatagtcggcctcttttgcacctgcttctgtctttgcgtgccaacaggagaaaggcagaaaacataacttatattgaagaagtggttagaaaaatatgatgtttgtgctaggttgacagcatacggatcaaacaacagaaaataaagaaaaagcaataaagacatacaaagtatacttttatcttcagtcatggaaattatttgtgtctgctgaagaaagagaaaagcaccattagagttcactgagcatattaaactataaaccacaaggtgacttctcctatcataaacttagttccaaggggttgcagtcagcttagatttagaggccacaaagttacttctgtgggttaatcagatcctaggagtggtttggttgaaaatgatatagctgcaaagtgtatggagatattttcatgaacaccactgaaagtgaagattcaagggtaatcaaattgaaagcatttatatgatttgaaatccttcatcagctgagagttcactacagtacatgaaattatgtgattgattaaaagcacctactaaaaactaaacttcattgacatgtattatgacacaatttaactgtccagctcaggaagttacataaaagggtctgtggctgggcgtagtggctcagtcccgtaatcccagcactttgggaggccgaggtggatggatcgcctgaggttgggagtttgagaccagaccgaccaacatggtgaaaccccgtctctactaaaaatacaaaacattagcagggtgtgttggccagtgcctgcaatcccagctactcaggaagcttgacgcaggagaatcgcttgaacccaggaggcagaggttgcagtgagccgagattgtgccattgcactccagctagaaggatgggcctgcatcgagcacacatcttgcccctccattaagatatgtgcccttctgaagcttcaaagaatgagctaaagagtatgtccaaaacatcagaaaaggcagaattgaatattcttcatcattttggaggataaggaaatagaaacacaccaggttttgaatgaaaagccaaggaagtccatgcacaagaaagaggcacaaactagaattgaacagatccttactaaaaacatcaacctgactctggctcagctcaatcccatacccctcaaccatatagaatcccggaaaacaaaatatataaaatacaaaactcactagtaagattttagaaaacatgacaaacaaggtaggattaatgaattcgagaagtcaataaaaaaatgtaatggaagcacagaaggaaaatgaaagattaaaacaagacacaacggtataagagacatgcagaatatgtgaataaagaagataaattaccatgcattttacagaccttgaaaatatccggtcttacgttaaaaagttttacgaaaaataatttacaaaaacatgaaattatcaattttaaaaaaattgtcaaaactgatacaagaagaaacaggaaaagtgaactcacatatgaaaaataaatttatcaattagaaagagatcttcctcacacagacaattatagctccagatgaatacattaataaactctttcaaacatttaaggaactattaatacaattttacactcatttttcagagaatggaaaaagataaacaaatgttcccaacttgtttgtaataacagaattgtatctgtgtaaaaacttgacaaaattcataacatgataaatcaaacccagtaacatataaaaagaataatgcattaagaccaagcagttttttttttttttggagacacagtctctctctgtcacccaggctggagtgcagtggcatgatcttgattcactgcaacctccacctcccaggttcaagcgattctcctgcctcagcattccgagtagctgggattacagttactggccatcacccccagctaatttttgtattttttttatttttagtagaaatggggttttgctatgttggccaggctggtcttgaccttttggcctcaagtaatctgcccgccttggcctcccaaagtgctgggattacaggctggagccacctagcatggccagaccaagtagattttgtaacaagatttaaaaatcatcagatataatgcaccgcattaatagaataaagatacatgctgattatgctaaatatagagagaacatttaatgaaaatttaacacatacacgtgtaaatctctaggaaaaaaatagaagaaactttataattcttaaaaaatatggtatgtacaaaaagcctagagcaaacatactcagtggtgaagtattgacattttccaacctgagctcaggaaccaattaagggtggtttcaatctttacttcaacattgtactggaggcatagctactacagtagggcaaagaaaaaacaaaatttacaaagattagaaaggaagtaagcattcagaggaagtaaaactcattatttataggaggcatgttttcttacatagaaaacattccctgccacctcataactctcctcacctcaaaatctaaaatgtctaagagacttatcatggtctctggataaaagatttgtattgaaaagtcaactgcattcttagaatgttagcaataaataataagagcatattatttccaatagcacagataaccaaaattatagcaataaaatggaatactatagttatgtaataaaaaagtaaactactgctacatccaataaaaagaatgaatcttacagatgtaattttgaacaaaagaaatgggaagcaaaaaaaaagcttactacagtatgattccatttgcttggaattgaaaaacaaattaatctgtgctaatagagatcaggatggtggttactttgtcggagtcacttgggaggctggtaatgatctatttgttcatctaggtggtgactatatactaccttacaaatgtataaaactgcattactgaacacttaacatttttacctttcagtgtatatgtattactttgctagggctgccatagcaaaatactacagactgggtagcttaaataatataaatttattttttccacagttctggagctaggtgtccaagatcattgtgttgacaggtttggttttccctgaggcctcccgccctggcttgcagatggctgacttcttgttacttcctcatttggtcttttctgtgcgcaggcacatgcctgtgtccaaatttcctctttcttatacacacagcagtcatattgggttaggaaccacccgaacagcctcatttcatttgaattacctttctaaatagggagaaagataattataaagccccaaatacagtcacattctaagatacagggaattagcacttcattatataaattttgacaggccacaattcagcccatactagcatgtaatttataaattaacaagtaggaaaaatacatacattaaagtaaaactaaaaggacaggtaagaaaataaagtcaaaagtaaagactgaattggagcagcatgaaagttatgtggaaaaccaagagtttgtgataccagagtatctaagagaaaaatgtttttaaaaagaagacgtgttcaaatgtttcaagtgctcttcctagatcaattaacatgaggactcagaaatgtaaattggctttaaaaaaagaaggccattattgactttagtgagagctgttttactggagtggaaaggataaagccttatgagggtgggttgagtagagaatgggaggtaaaaaacagagtaagagtgaaaatgcttcctttgagaggttgccctgtaaatataaattaaatggaagtagctggacggaaatacgggcttgaagaagtggttatggtttgtttttgctttggtttctttgtttttaaaactggaaaagacttctgcatgcttgatcattaatgaaatatgtagaacagtaaggcagaagttgaagatatggatcggagagcagataatcaagagatggctctaataaaaaaatactacagaagataacaaatgttggtgaggatgcagagaaattggaacccttctatactgttttcagaaatgcaaaatggcgcagtcattgtggaaaacagtatggagggtcttcaaaaacagaactaccatatgatccagcaattagacttccaaggaaaaaattgaggagcagattaactacatattttgccttcatttaccctgctggtaatgaggtgaatctggatttgtgttcatctggttctaaagaatattatctttttttacttttagcacataaaacaaactattaacattctaagtccaataattttcatgttaaaatatagttaatatttataacaaagtatatgtaatatcaagaaataatttgattgtaaagtcaaatgagaattttcaggatccaaaattgaccacgtaacgtgaccacaactacatctagcataatgccagatactcaataaatgtatgctaaataacctgtgtttaaaaaatagaaaaaaaaaaacaaaataaaatgtaacagaatggtttaacatggttaatctaagtgtaatttttttctccctttctttcctctaccccaattatttaaatgaataaccgtgtcgggtgtttaagaaaatttttaaaaagtgaaataaaccatgaacacagttcttctctgaaaatattctactccttccttctacttaattcagggaactttctgctccacaactcctgaccacactgtatgtggtaactgtctacaaattgcccctgaggactacaccctgacagtttacttagtcaccagctacagaggtctgaaagccaactttttgagcagacatgggagtaatttcataaatatacccaggagcactaccttacatgaaaggatgcaatgatgagagaatatatacaggcctgaatcacatggggaaaagccacagaacttagttattttatttattatattatatttattatattgacagctttggaagtgtgtgggctagttcttgtaggcaggtttctcaaccttcctgaataatctgtatttatatggagaactaggtgaaaattatgtgaagctagcagcaattgaagtcatctttcttgaataataaagttcatagaccaggaaaaggaaggagggaggagagaagaagataggtttcaaagcttttctaattatgaagaaaatttgatttgtatttcatatataaaaatggtccttgttatttctagaaccaatctgctatcctttgaattaacaaaagatatgtaacaaagagtatccaaattggaaagcaggaagtcgaattgtctttgcagatgacataattttatgtattaaaaaccctaaaagagtcaccaaaacattttagaactgataaacaaatttaacagtgttgcaggatacaaaatcaacatataaaaatcagtagagtttctgtgcaccaactactctctagtgtaaaaacaatcaagaaagcaatcccatttataatagctacaaaaaataatttttttggaataaatttgacaaagaaagtgaaatacctccacaaggaaaaatgtaaaacactgatgaaaagaaattgaagaggatatgaaaaaatggaaagacttcccacatttatggaatggaagaattaatattgtgaaaatgaccatgccaacagaaatgatttgtagaatcaatgcagtccctgtcaaaataccaatgacagtcttcctcccagaaatagaaaaaaaaatcctaaaattgattggaattacaaaagaccctgaataaccaaagcaatcctgagcaaaaataacaaagctggaggcatcacactaagtcacttcaaagtattttataaaactatagtaaccaaaacagcatggtactagcataaaaacaggcacatagacaggcagaacagaacagagaatccaggaataaatccacatatttatagccaatttatttatgacaaagattccaagaacattggggaagaaacagtcactttaataaatggtgctgagagaatggaacatccatatacagaggactaaaacatgatttatttttaaaggtttaatgtaattctcgaccctctccttctgcctccccttccataaatacccacttttccctgtgacacaatctaccatggggctttcaacagcatttttaaaatacttttttaactctttaagttgattttttactaatgcttgttccactgattttatatgaagtagtggcaaacaccaaaatttatattactgaagtcttgtagtttcaaagaatgactgctgcatatcatttgtctgcaggaaagaggaacctaatagagtttctaatgttgagaatcctttctaaatcgggttagctcaagaatgtggtcagtcaccaatcatcatagcgggtgttgcaactttgccttttcagaaacttctagctgccttcttgtgcctctctcccactctcctggagttctcccagaacaatatgctgagaacattgataagggtaagtcactattagtggaactgtcaacctgaattgtcttcttgcaggacaacttggctgtagctttcaaagttaaaactgaaaaggctttttaatccagcattctgaatatggtacttattctacagaagcactttcattttcttggggtggggtggaagcaagataatatatgtgcttggacattcattgcataattataattgtaaaataaagtaatgaaatgaatttccatataagaagacaagtacaataaatttgataccttcataaaatgaaatattctatagccatgtaaaaagacaattttataaatctccctgtggtagttttaagtgaaaaattcagctgtaaaacaatgtgactaaagaagaaagagagatataaacacacatacatatacacatacacagatacataaatctgttgttatatatattatatataattactagatgttattattaaatgcactgaatacctttggaaattaaatagacattagtcattgctttcaaagagaataactggtttatctgggatcaaaagagggaggaagggaagcacactattcactgtattcacttttatattgttgaattttgatcaatgtgtattacctatttaataattagtaaacaaaataatattaagaaaaagtataaattattaagagatgatcttaatacagcatcatcattccaaaggaactttcataaagctgaggattgcacagatctgcatattacgcctatcatgtagtcacaggtgattcaaggtgcatataaggttgggtaaattgtttagcgctcttccaaacagggatcattttattgacctatacacgtcagcattaataccttatttggttgcactatacacacgtttgcatagatgcaactgcacataaatattgcatatgtatgaatacataatggcatatttatgtcaatagaaataataccacataagctatctcgaatgtcaaacattcatgattaggctttttatacacatgtgataaaaagaataatcatatcactgaaagagtcaaaagaaagataaattagatactatgactgacttaatcaccaccattcattttatatgttatttcaggacatagtaataagggcatatattatacaaattgttttttttacttggctttcttgattatgcattctttaccccatccagcccaaattcttcctgataaatttagattactcctgtgtgattcctttttgttttgagatatgctttggtgattcccagtaggcataatttttatccttttccatccattttctattttcctgtctaaacaaattgtatgcatcagtaaaatacactaaacttcacatgttgttttgaaaacaaaaagggaatataagtttagaatagatgcatatttctgttgagtagactcttttattatcataaaatgttttccttacctctggaaatatttctaaccataaatatctcccttttcaatggtggtagggcaacactggctttcttcttggttagtatttgcttggcgcatttttaatctttacattccttttatctttgtgttttctgtgtccttatatttaatggtgtttctttctttttttgagacagagttttgctctgttgcccaggctagagtgcagtggcacaatctcggctcactgcaagctccgcctcccgggttcaagccattctcctgactcagcctcccgagtagctggggctacaggtgccgccaccacgcccgctaatttttttgtgtttttagtagagacggggtttcactgtgttagccagggtggtcaatggtgtttcttataatcatgggttagctagtttagtttcttctttttataatccagcctatcaattcttattttagagagaggatttagtctattttaattacattacaaatatacttttacttaaatctaacatcttatcctttgttctatatatgttcatatgtattattttttcatagtcttgccttcttttgaaataattacagattttataaatcatccatttgccctctaatagtttgcatgttatttatttctttagttcagttttatttattcctttttattagaatatataacaaattagtattttatcacctccacaccaaagattttgcaacccttacctacaatgtatattaaaaccccaaaaccattattgctattattttaaacaatgtctatttatttatatctggttatttacctcataatttttaaatatatgcttgcctcatcttttaccaggggttatattccttctgactaaatgacttctttttgtgtttcttttaatgtgagttactctgatacaaggtacatcatagccagaagcaaagtcttgttcatttttcattcactttgagttcaatacatttttatctggtatggctcttcctccaactgagaggaaggattgggagataagaaagaactgcttacagcagagcaatgaaagtagatctgcaaatagcaaattatatttaaagttggaataggtactcagtagagacacatttacatttgaggaagtataagtagtatagtataagtatagtatacttataagtattatttgaggaagtataagtagaaggcaagagtaataatgaaaggtgacagaggaccatgagtattgattctggtatgttcagatctgggtccaaagtacaagttatctacttataatctttgtgacattaacgggaagacaaaacttgtttaagtttctgttgtcagtcccaaaacaagaaaaaatgatgttttatattatgagatggttatgggaattcgataataatatatttatcacttaatagtgatgcctgctatgtaattgaagctttataaatcatagcaatcattaaaaaatcaagaaatatttaatggacatagcattgtggttgatgctaaaacataattagattttcattggaaagagatcagaagaaatctggctgttgaagagccagcaagaataatgacttgggttatgaaagagaccaccatgttcagggcagagaaaacagctgacactgctgaatctctagccctgactctggaggatggtcccttggagcttcattatggagaatttgcatgttatggagaggtggtaatacatgaggcagaaaacctgcagaggactgtgtgctaaggtggttaagcatcattgtagatccttgagcaggagtgtacccttgaccatgtcttaccgagtgagttctacgtgtctgggagaatgttttctctaaaaagatggagtagtccaatcttctagttctctggtcctctgcccataactcacctcccactgcattgccagtcaccttagttgactgaatagcatggacatttccacagagaataaaatgttttgtttattttcccttagaagatttttagaccattttatttcccagtttttcttccacaacaccttttctcactgcatagaacttgggtagaaacagacattctgtctttcctgcctccattcctcctggcctcttttttgttttttttttttgttttttgttttagttttttgatacagagtctcactctgtcacctaggctggagtgaggtggtattatcttggctcactgcaacctccactccctgggttcaattgattctcctgtctcagcctcctgagtagttaggactacaggcccatgccacgatgcccagctaatttttgttttttttttagtagagacaaggtttcaccatattggtcaggctggtcttgaactcctcacctcaagtgatccacccgcctcggcctcccaaagtgctgggattacaggcgtgagccactgggccaggtttcctcctggcctcttaaagaacagaggcttctgccttgtttgtgcatgatatgtaaaaactctgccacagttggtattagaaaaacaacttcacaaatcaaagattcatggagaaaattatggttttggttttgccaacccagtagtgagtaccttccataaaatgaccatttactacccatggtgatgagccaagctttatggaatcagaacatgacaatccaaacacttggttttggatgtggagtgggattaaagccctgattactgcatttaatctttataatttctctgctccttcagcctccaagaatctacggaatcctgacacgcttagttcaggtactctcgggcacaggttctaagagtgatttcaggtagattagagttggttaactgattctaaggcattcaatttctcttccgtttcaatgagtttactccttgccatggggtcagtgattggaaggaaccaccaatttcttctagatctaattcaagttgatttgctaatattcagtaaatacattgaaaaaagtaataggaagtgacttcaggaagcaatgctctcattgtccatggggtagaggacagcagatgtgggtaatactgctttttggggagcatttaggaagaccctttctgagacttgctgcagttttcagagtactgtgagcaggatggtgaatgctctgaaaactactgaaagaagaataattggaggaagaggcctcttcagggagaaaggaagactgttttgccaaatgacaagagacccattaccaagtatagacaaaggagtgtgagcaggaacaagctagcttattcaatgttgctgaaagccaaaaggcaaaaagtatagattgatggatgtggtcagtgaagagacaaccagaatcaaccagaaatggaaaagggatgtagggaatcccctgagagaattcagccaggctacatggctattcatttatgatggcttaactgatgttgctacatgtaattagaccaaatcaccttggtgatcctttccaacactaaagcactgtttttaaaccaaaatatactttggcacatgacaatttcttttctgtcatacccaagacttctcctcttctgttcctttcattttcttaaaaaaattataaaacctttttggcaccaactgggattcctcaaccccactgtggttttttttttcaaagtatattcaagttccctacagaaagaataacccaataacccaattagattatgaaaaatacacaatttatgcacgtaattccccactgtcagcatactcaaacaagttccctggggatgaggcccaggaatatgcattataagaagttccctctgaggattcttatcaccacctaaatttgacaattaccatcccagtatctttctctcaagcattttctgtacttgtgattttttacagaaggtcagtcgtgtctaattctttcctcttagaatgggaaattaagattcagagaaataaagtcctggtctccgagtatatctggttggttttagttgcctcccattcttgcgccaaacgggcatctctgttcacatgcagggtgcaaaggatgctgagtcccatgttgtctcatggtgagatcctaaaactagaatataaaaactttcattgccttctttccctgagagagatcataaagctgctactgccaagaataaggaagctcagtaggactgatatcggttagggcagtgcctctcaatcttggctgcacataggtatcagtgaaactttaaaaacaaatacctaagttgggtcctattgcaagataattaaatcaaaatctgtaggattgaggccatattatttcctttctaaaaagatcccattcaagcatcacagctcttgtgctcccatagcacttagtacagaatgttatttttgtacttatcacatatttttgtaatcacttatgtatttatatctatctccacctaacttccctgtgagtgagacagtgtcatcactgtagatagtaggcagccaggacatatgaatatttaaaaataaatgaaatagtatagcagatccttgaaattacacatgctctagaataatctgtggtttggctgcttctcatcaaagtttactttgtgcctcctgggaggaaatttctgaagttgctttgcaagcctctttctttatttgtgaagctaaagaattgctctagcatattttaattacaactaagaagtgttcttttgatcaaacattaataacatttctaagtcataaacaaactaagatttatcacttgtcctaaggttgacactgccattattctcaattactcctgagcccgcacacattattcactaagtgtccccggaggagggaaacaaggagagagttctgctgtaagaaggaataaaattcttcctggagttacatttttgtatattcaaaacatctccttgggattttttttttttatatctacagcattccccagacaagataatagcatgttctggtgaaaagtccacccgaaaggagattgtgttagggagccagcacacacttgaaattgcaaaacaaaagttagttgatccatattgtggctctgctccttatttacagagagaagaggggagtgggaacaagaattgggatctttcttcaccaggataccagttggctttgcctactggacagggaggaagttagcagtcagccctcctggaaataccaccccaggaatagtggaagtggtggcactgtttcctataattttagagcttgctaatactatcattctcctaagaagtaataacttggatgcttattttgaataattgcaatattgtcagttcctatttattaaacaacttatatataccagatacttttctaagtactttagcacattggctcatataatcctcatactattcttgcgaggtaactgttattatctcagttttacaggtgaagaaactggcacttagggaagttaaggttgtgagttttttatggatttgcctacaagtgtttaacacatgcaactttgcctgtaaaataaagtaatataattaatttgcttggacatatggtggaaagtaccaggaatatataagataggaatattgtcagtggataaaacaggttctacaatgaccaacaggtgaggactgacctgtgagacaagccacagatactaaaactgatatctggtgagccagaaaatgtcagatctcccctctactcacccaattaggtaagcattttgatattcaaccattggctccatggtatctagtggagactggaccaatcagagaagcatcccagggcctcacaaagattataatgaaattctgctgagtgttgttcaagtgaaagagagatttctcctctgtgggggagagtgtctatcagataactagacagggaatgttcagccccacaaggcccttatactcaacacagagaaggaagttattctgtcatttccactgttgagggccagacatgtgttccctctcatgatcggggaggaagcacaacttagctatctagggtatgacaatctcttggcagttgcattgggagggaagtgggtgtatctgaagcccaggtagagtgcctgatctgagggaagaaccttaactcactgaatgacccatagaataggacattaattaatgttgcaaaaaagagaattttaccaatagttattgtaaagccactgggctgcttttcaagacattgtctctttattttgtccacttatttcctacctttagaactttaaaaaaaatctcttctgtcttccctctaaaatctttctaatgggcagttattttttcttttatttttctttactttctttcccctaatctttcctttccttctttctttcctccttccttccttattttcttccctccctttcttctttttttcttttttctttctttccttccttctttttcttcctcctccccccttccctcccctccccttcccttccttcttgctttcttttgtttctcactcttcctccctcttatcctttcttcccttctcctctccttttcttctccctcctccatttcctcctcccttcctcttttaatgttaccatgtgtattaatctgataggactgtcataaaaaaataccaaagactgagtaaacaacaaaaatgtatttttccagagttttgaaagctaaaagccaaagatcaaagacattgttaagtccaatttctcatgagatctctctctttgacttggagatactcacttttcactgtgcctcagatggctctttgtatgtgagttccctagggtttctccctttttcttataggtacatcaatcccatcagtgtcccacacttatgaccctcatttaatcttaagtatctctttaaaggtcttatcttctaaaccagtcatattaggggttatggcttcaactatgaattttgagggcacataatttagttcatagcacaatgtttgaattttcaattttggggcttgtgtattttcatcctgtagtttgaacagtttcaagtattatatacatacaagtagccacatatacagtctaagttgagtatctgcccttagtttaatttcccattcattttttttcttaaggaaaaagacacaatccagaaagtaacttgaggcaccaacaagttaaagcaccaataatttttagtatgaaaatgaaaaactggtaagaactgctctgttctacaagattaagtggaagggggctgaaaggagtacaaaccaaaaagatgggaatatgctggagtaggggcaggcacaggatgcaggctgctaaagcagacagtcctgagcctgaatcctaggtctaccagttgccagttttttggccaagggcaagtgaatgttcagtcttaatttcctcatttgcaaatcagtcacaccaatctgctttgaggagacactgcaaagacacaaaaacacaggtaacatacatgtgtgcatgtacacacatgctaaaatgtctgacggggagtaaaatctcaaaataaaaatccacagaccacaattttagaaaatattaaagttcatgtagattccaatgtcttacagacaatcttgacaccaggcccgcaggcaatatgtgtgcaagcccaaagcttcagaggaaacatcagactttcacattcaacataaaataaaattttccgtgcagacctaggcacttgctctacatcttatcaggggcccactagagtaagggagcttggatgaatggccctttgcttacacaaaactgaacgctccttatgagcaagaatcctgtctgtttagtggattattgtatgcctggaacctaacacagtgcctgaacatagatgctggtgcgtatttattaataactggatgaaggcatattatactcacaaagtactttactgagttttgcagatggacacataagaagctgtaaaataagactacggcaaaggcctttctccatcctaaaactgaaatgattcttagaggttgttcaaagttgctctagaatttacttccctaacaaaatataacccaaaggcttgcaataaaaaatgacccaggactccagacaaaagatgttaaaactttgtcctttcacatcccatgataaatgtagcagcaaagatgcttcttaaaataatcttaaaagccctacagtagagttgaagaaaaaattaggttagaaaataatttttgatggatgagagccaccaattttccagcaatcagaaacaaggtgcagaatttgttccataatatctgccattaaactatttcagcctaatattcttaacagaagacacgtgtcaggcataagaaacgatttaataccaccaagacattgacctcggcaacgattcttacatgtaatatagaagaacagattacagtttggagggatggttgcctggagcctaagagaagtaaatttctgcagctgaaaattgcatgtagctctcccagggggacaaatctatttctaattgcaacttttaacatgatttacatgacctaaaacacacttgtaagagccagccatcattttcatgcctttgattttaggtaattacttttagagctgaaagattttcactgtctttcatattacttttggccataaacaataacgtttgattttcagcttcctctcttcttaagagaaaagaaaaggaggaatgttttcccaaaaccaactttcacagggaaaataattaccccaagctaattagaagaggggattgttaattaatgcagtctgggctgtgggtgaggtgggaggatggggttatatctaatgcagttgtgaagtcagagtcacttaaatccactagttctatccaaaatgattccccaggagtggataggtgctgtccctcagaccactgctacagatgcctgtctggtcaccttgctttcaatcatgttcactaaatccatcctctacacaacagactgtgatcttttaaatgaaatctcagtaacttcccctgacatttagaacaaaattgaaatttcatctcatgttctacatgctccgcacaatacagctaggactcctttggccaggaaaacttaagaaactttcaaggcagagggtgtcagctttggatctatgtctatggccataattcaacaggtttgaccaggacacatgactagcaggattcccagcagcaactcttctgacaacttctctttctgcccgtttttcactctgactctgtatctagaatatctagtattataagtctctgataaactttatttgcattttctttctagttggaattgcccaaaggccttgcaccaggagcaaatactttgctcctaaagcagacattcagatctggaaaatctgaaagaggtataatttttattcttgttgtttttatcattaactttgccctgtattaacatattataaattattttacagttttactggtatgctagagattgcataatgattccaatgaatataagttaatactttattgacttccagacaattcaaaatgtgtcaaacactttaacactatttctcttctgactttagtattactattgttacatactttaattttgtagatattttaaagctcacaacatattcttttttgtggttactgtcaatatttatttagattcatttatataactttcatctaactgtactttccttcatgcacattccatctttctcctaggctcttttttattctgctgaaagaatacttatctggtgattttttgatgttgtcatcactgtttttgctgtttggtttgattttagcttacatatgctgctaataaaatttctctgagtttgactaaaaatatttttggctttttaaaggaatatatattttttcttttgcattttttcagatagacaatttaagattagtattcatatctctttcactaattaaagacatcattcacctgcttcctctcttctgcagctctcattgtggctcatttgaaggtaatacagattttctatgtctatttgtaaagttttctttcttttggactttaatcatggtgatcttttggggattttttgagcatttttcctacttcaatgtattattattggatatgagccttaatgacttatgtctatttggggaaaatttactaccactatctcttctcccttccctctcccctcacctctctggatttcaattccatgcaaactagaactttacaataaatcccatatgtgctttatgctcctgttttgcagttttataattttctcatgatgtgcatctacctgtgtgttttatgcttagtctgtcttccaggtcactagaaggaagtgtgctttcagcttttctagcttccagatcaccaggtctctcttggtctgtgtctaatctgttagcatatctatttactgattttgattttgataattttgtttcatttctatttctattttattttacttgtagtttttgctgtcagctgaaatttacaatactatttataatttcataaacacattaaagttggttttctttttaaaacatcataagtctaattagcctattgttggagtctctgttgatctgcctcttttatctgtcacttttttccctcatacttttcttcgtactttgtgctctcatatgggtttcttactggttgttttatctgttaatatccagacattaagggtgaaaacctatagagataatacaaggcatttactataaccatctccctccatagagaatttacttatgttttttaaaaagtagttatgctcgcagaactataaattccaggtcattttaatctctactagggattgagatgatttaaaggtggactttattttatttaaggacttgtctatttcctctgctcctttctccatggatgtatcattattgcagtcacaaccaaaagctgaggtatttatcagggcttttccttttggtatcaaatcatccctacaaaagcatcaaaagttttattcagcttctcagccactgacttaggaactggaatgtagcagtttcaaatccatgacatcatggcattttctcatcctgtagatctcaaccacataactcctcacttagcaggtccttcaatacattccaatgttttctctctttctctttcatctatttataattttcttcaaattatttagtaattataagagagcatattagtcacaagcaaagaattaaaccattgttagaaaagaatattttgttactaattttattaaatatagtcatatgcctattttactactgtatttcccagcttactgaaagctgtgtgttttgactaatgaaatgtaaatagaagatatttgtataatttacagaaaagctttttccaagagttgagtcagtacattttgtcctacttttttatgctgtctagaacatgggcatgattcccttcattttaaaaatcatcttgaatcctgaggcacatttgaaatgcaagatatgtgaggtgaatggcagaaaagaaaaataccagaagactgaatttccaataaatgtgagtctgtgctactggcacttaacttccatcttcttaaggctaatgatatttccatactttgttataagcagctgagtaacacttatacctgaatacaatttcataaaactattcatactgaacttaatatgttattcttattctgggataaacaaatttttttttttttttttttttttttttttttttacatcagcaaagcaaccgaatttcaatttacaatagtggaactcaggacatattttttccaccaaaacatccaaccaagtatgagtgagtggcctggccttaacacattgtttgtttgtaagtatgcttatgcaaacaggttgtttattattatattttatctagcatattacttgctattttctgttattatttttccactacccttgtctttggtatcttctcttcatcttttttctgtcatattatgtttgcttagggttctataagtattcctgctactaatgatatgagttgtatgacagctaacagctcacgttatttacagtctttgctttttagaataaaacaggaaaccatcaagtgcagtgatttactcagctgcaggatacaaggcactccagtcctattaaggaagaataactgttatgattatttaatgagctacacaatgcctgttattagctatttattgatgtatgaatacttgggatctactgcttctagtgccagtgagaacaactcatttttcaatcaaacctaattgacaatgctagtatattgagaaaaatgtaatgcttctcattagatttattggatggcaccattcttgccaaatctcatattgacatgtaatctaaattaatgtcaaggtgatagatttgtagttgtaagatcaagccttacctctaatgttctaatctacaggaacaacaatttgaaggaaagtcgatatgttgataatataatatagagtaagtacaatatatataaattgatatatatagtaatttgtgtgtgtgtgtgtgtgtgtgtgtgtgtgtgtgtgtatatgaattatactttggaggaatcagaaacctgaagagtgttgcttcttgggagtctgtctcttgtggtcttggagtagaaaccagatacaagctagaaaaagtctaacttctctaaatgcctgcatgtagtctttactgcaggattatcaaatgagtaaattaaaaatggaacaaggtgttagagatgagtgtctaagccatccatgcatgataactaagatttaaatgacacatttatcagtaaacataatccttcaactcataatatccttaattttgaatttagtgagaattatattctatattgataggtaaataccactgaggaaaactcaagagtagtcacattctggcatcatcaccaaaggtactgggatcttcatccctctgctagatatgggttacaaatactcagtcttccaaaaaaagattcactgagaagatctgtactacttttgggggaaacaccacagatattaatatggcttgcagatgctattttccttgagccttgtttattgcatgttttgggctgttttcgttgttgctgttgttgtttttgctcgttgtttttaatattattgctcttttttgatgcctactgtgcattaaaataaattatttaacctatttttggcttaattttctctctgtaaaatacaagatgataatagtatcaatttcatagggttatgaaagttcaataagcgaaagcgtgtcatttagttaaaacagagcctgaaagagagaaagtaaaatacgagagtgaatgatcactgtcattatcattatcattctgattatagccataatcatctccagcagcactatttatcatttatctatctatttatctattatatattaaatctctgttaaactctacatatttgttcatcctcctcagtgatactcagccttgagtatagttgaattacagcagtggagaacttgttgcctcagcaaagcagtcctgacatgtgtctttctgactaggcagcaaaggcttattctgtttgcatgtattgagtgaatgaaagtaactgctactctgttcacacatgtttggactatgaaatggtcatgagctaaaggaagccatatatgctaaaaaatatatacgtgttaaaagaaaacctgtagacaaaataaatgtaacagggttcacttgagcattgaaaggttcatgaatcgggcaacactcaaaaccagaaaaggttcagagagctccactttagcagcttgagcagcaggcttttatagactgaatgcagaatcaaagtatgaacatcacttgattgactaaagtgagacatttgctttatttgtgtatggtccagtggaaagcctctagtaatataactaatagctgtttgtgaatggctgaagctcagtttaattcatttgttcattttttcaaaatcaatgcattataaggaatgcctttaagttaaatatcagtttatttgtgtaagaactgtgggtacagaaacaaccccaggctaatggttttctacttattttgttttaaccaaaggtagagataaaaaaagaggggaaaagagagagagcgagcttgagagaggccagctgtggcaaccccctaactggtttctctttttccttgaaaaatatttattctaatcctgaacttatcctgccatttctcctcatccattgctcaatgtctccattagcctaattcttcagtcatctactttaatgcaaagaagataataaatacaatagggttacctgaccactacaatagcccctatatttatttataggcttctcttcagtcccacctacttaagctaatagtcaaatcttttttcttgaaaccacaaaggtaccttatttagccaccatgtttttactctgcataagtgaagacaaatcacatgcacagtctgcatctcatatatatatatacacacatgtattttaagacagagtctcactctgttgcccaggctggagtgcagtggtgtgaccgcggctcactgcaacctccacctcctgggttcaaacgattctcctgcctcagcctcccgaatagctggcattacgggcacgtgccaccacacctggctaatatttttttttgtatttttagtagagacgggggtttcaccatgtcagtcaggcttgtctcgaactcctgacctcgtgatctgactgcctcggcctccaaagtgctgagattacaggtgtgagccaccgcaccaggcctgcatctcatatttttatcaccagaaccctaaactcaattcagatgccttcagctggacacatcatttgcccacttgaggcaatatagattttgatttaagaaaaatacagaagcctaaagatgtaattgtctgaagagtagaagactctacctacccatttgaaccttagagaaaacatgtttcagattaagcatgaaacagtccatgtaaatgattttgactcatagagcaatccattcatctccataagcatttaatttaagatgtaattttaacatagattagaaatttatatttaaagatgcttcttggagacaccccagttggatttgaattgggttttacatgacatgtcatttaaatttctctgcttatttaacttccaacacttggcagatgcattcccaggaagcattacaccttctccaaatgcctcagcccttggaagagagaaagcactagaattttaagccaagcttgggcacccacacaagacaacatggcatccaacctgaaaatgtgtcagaaggagtgaaagaataatgtatcttaatgtatcagaataccacatattcaacaaaatataggtcactggtggttgcatgcacagggcagggtggatatcaatcatttactaattaatgttcagttctgcctcatcccttacaaaatggactacggagaccaagagagctccatgactcagaatataataatttagccttttgttccttcactggctaatagaaaagatgaaaaggtaaaaaatctaggtaagatgtgtggactttggtgtgctcctgtttagaagcctgtgtgcagagcacaaaactgcagtgccaggtatctacacaacatctcgtgactcgagagataaatcaatgttatgtaaacgactattatgtccactacactgtgcttaggactttgaatttattcaagtctctatttttgaatggtatatagtctaggtaaggaggcaagactaaattgtgcaaaaacaaccaggattcagagtacaatgcaacaggttgaaactgtcagaaaacgttgccaacaacaccattctaaacaagattagtcagccatcttatgtggatgtaggagtttgaagaaggactgaattcaagtataaagaacctgtttatctgataacccggtgcactggagtaaatcccagtctccaaccagcaatagtcttatttacatgtcaaagttttctagaaagaaggatgcatgcattcatttctacattcttttaatgacctgtgtttgttgctggtgttatatgtgctgagtctgagttttttcatagtgctcagctgtctaacaggagttgttcctgtagagtcttctctccacacctttagctgtgctagtcttctcacctggagtgctttctcctttcattccaccaatcctactttttcttagtctgcaacctgcaaggccacttttaattgtttcttcagtggagctttccaatgatagcagtctttagttttcatttgttttggattttaatcttaactaccctcactaggtctttaaaattcactttttaccgggtgacttaatttcactcatgatcacaaaggaagcattttcttttctttttattttgcacaatcttgtgtcaagttttggccaatagaacaggtgtggaaggaagagacatatttctagccctgtttctaattaaacaataaagcaccttcattttatggttctttcctctgttcttttccaggtaacttcagaaggccttataaagaatgtgcagtaggaagaagaaaatctggaaccctgagtgagtacttttggaagttctacccaggagatctctgaaactagcaacatccaagttaaattttgtcccaatgagtaataaactcttcttttttaaaccattgaaattcttcagtattttaaataataatagcaagtattaattatcctcagtgatagactattttctcaacttactcattatataagttaatgtatgaaaagcacttagaaccatgcttagcacatcctaggtgcttaataatgccaggtgttattataattattactattattactagtgcaacacagtcaactaatatttagtgagtgctcactgcgtactaagcatgctctgggtattgaagaaaaaatagtaaataatcactacatttgtttttgagttcacagtctagtaaaaataacaatagcaataaaatatctaaccttgcctaatgactgtcactgttctacttttttctgtttattaactcttctattttttaagataacttaataattttatccccattttgcagttggggaatctgaggaaaaaagagattatacataatgtccaacgttacaaagctggtaattggcaggccaggatttaaacctagtgattctaatttccgtgtttatggttttatattttatgccatgctgcccatgagaattaagtgaattaatggagctgtgtgcagaatgggatgaagacacttcattaagcagtgacactggaacaaagtttgacagatgattagatgtttaccagttgcactataatgttaaggacatgaaaaataaattctttccaattgatgcaccaattgattaactgattaacggtgttaattttataaagcattgggctgggtagtctaaaaggtctaaattagtgatgactcttggttttaaaatggagaaattcaactcaaacagtacttaagaaaaggagaaaaacttttatgaggtcatatgtgagtctccatccagatacctgcctgaaataattggtaaaatgcctctgtctgatttaattctaataaagttctttttaaaatattgagtgtaaaagaaatggacaccaattactcaaggctcatagtttatgggactattaacgtctatagaaagaagactaacgcagagacattttcgccatcctattcttcctcctggacaaacaggaagactcgtttatttagccttattttcacattgttgaagtcaaatgattgacctctagtcaatgagtggtaggaagaaatggtctaagtcacaaatagtcctggctcttaaaaatatttatttctaagtcttccaattctttcactctcaggtgcagtgactttagaagccatatattttatgtgaccaacttataagcaggagtgtgacccaacccaaactggacttcccttgacctataaatatgtttatatgttttaaggtagtaaaatgccagtgtttacttctggctgcagtgtatcctatctatcctagttaattcaaccatctgagtaataaggtctcagagacaactctcaatggactgactcatctacgccaaactctgaatgaaatactatagccaagaatttggaataatctcattgaagaggcccagcttggaactgaataaaaataagccagatagaatattggaggattcagaatgtgaaggagcaaagataattaaaaaaatatgtccactatatatcatagcctttatttgtcttgcagtaggtaacacatactaaacgtatctgactttcctagaccattgttaatgtacatctgcattctaccaataactggaaagacaatctttccgataataaacctgtggtctattttcataacatagatccattcatcattttagctcaataagcaaatattttcttttgcctgaaatatttcttatcacccacatcatatttaatgtctaggagttaatgctgcccaattcaggcatttaattcaaatatagaagggctttacatacatttcttattttttgctaacactgtcattggactttgtttttattattaatacatttgactcaagaaaaattaaatttccttctttgaaaatcccatgacagtagaaagttaaattgaagggattatgatttgtattgtatttgaggaaatcttatctgccttaatcctaatgtgggtccagtttttattacagaaaattctttgcatttaggaagtaggcagttaatgttagaattaatatgcacagagaaatccagttcttctttgtacttgggttgtatagtacaattgaagaaatcttcaaaggcatgtgatttttcttactttaagtttcagacttctgggaaaactcaactttcagaattaggcaccatctgaaagattagctccagccataatatagaatattcttcttttcttaagctgttattttctttattctccaaaactgtatttggcctcatactagaaatggacactgtaggctgtcaagcattttagagtaagaggcaaagaaaacaagagttgcacatctacatctgaattcccagagcagtaatagaagcaataagtcaatttgtaggaattcaggaaaaaaaatctcaattgggatcaagatgctctaaagaacttcattaaataaaggggacttaaaatggcatgaaacatgtgttcgtccaaaggggacgaaaataaaaggtagtaagttactcttgtttgaagcattgaagcatatgctgggacaccagatgtcaggactgcttgagaaaacacaggaatataggaaaagcacaactaatatatttggagtaataaaagaaggaatgcaaatacctcaataattgcacatttattattattattattatttttaatactggaaaatgtattctcaatattctcatcccaagattctctgtgactattacttaacatgcattaaatagtaataatttatcatagtagtagtcagctctttacatgaaacagcacatttagtactcataataagtctatgaagtaggaactattacctgtatgtatgtatgtatgtatgtatgtatgtatgtatgtatgcatttaatgtattcagaaacttttcaaattaatggaaacaaaaaatggctaaaataaacactcatattcactaactgctctttctttccttacacatatgtaaacacgcataccctacatacacacacacacacacacacacaatccatttaccaaaccatttgaaggtagagtgcatccatagtaacactcccaaatgtgcttcttaattctaagaacactggagaatccatttcccaatatcaaggatatttgcctaataaaccacaccaccactgatatacatgaaaacataagcattcattcaactaatttttaaaatagcatatccatttttcatctccaattatctgaaaaagcgttctcattgtttctttttaaatgcaggcttcactaaaaattcataaaattactttggctgttacgtctcattcatcttcccacccagtgcagactagaccatatttctcatgatattgaatcttttgatgactctgggtcagtcatcctactaaatagcccatgttcttcatttgatgacaatttcataatgatgatatttaggttgcatatcgtgcatttttgggaaatacagtaagcattctacgaaagaagctcaaagctcaaaaggcatcttttgatgcctaaaggagtgtttattttaattatttcttttgtttctagtggtttgaaaacaaattttctatgattccctcactactgttgcctttttctttccttcccttgtctctgacaccccataacatgcttactttatttatcctgtactgtagaagtatgcatagtaactaataggagttctctgtttaagagctggaaatgagtgcccagaagttccaataactgggtttaacatagcccaactcatacaactagtatttttggagtaataaaagaaggaatgcaagctacactgaccaacttcattaccttctgcaaggttggcttctttagaagagggagcagagatgaaaaggtgaatcacttcatagcagggcttaagatagtaaaatcggccaggcgtggtggctcacgcctgtaaccccagcactttgggaggccaagacgggcggatcatgaggtcaggagatcgagaccatcctggctaacacagtgaaaccctgtctctactaaaaacacaaaaaattagccaggcgtggtggcgggtgcctgtagtcccagctacacgggaggctgaggcaggagaatggcttgaacccaggaggcagagcttgcagtgagcccagatcgcaccactgcactccagcctaggatgacagagtgagactctgtctcaaaaaaaaaaaaaaaaaaaaaaaagatagttaaaatcaattccagctgatttaaattttattcactaaactacaaaacattcacagacatgtaaatgaatatttttgtaaatactaacagggatttctaaaattacatgcaattaaataagccagaagaaaattttaaaaaatttaactgcataaaacagtaaaaatctcatccatttcaaaatacataaactaaattaaaaggctactaaagctaaggagaatctttgccaaaatattacagacaaaatttaatattattctgtacaggacttatatttcatcaagatttatactaaaaccctgataggtaagtaggaataaagaataatgagatttacagaaaaaagtatatgtgaccgaaaaatatatgtcaaaatgttaagttttgtgttaaagacattaaaatgaataaatgaaatattttatctagcaaatactcaaggattaaaaaaattgcttgcaactgtgcaacagaattggcattttcatatactcatgatgggaatttaaatgttcttactgctctctaaaaataaattaaaaatattttgtcaataggcttaacaaaatctatatcatttaacttattatttccatttattggaatatgttcaaagactcaaaaaatctaccacagaatcataaacaaatattttgtgtaactcaaaatcaaagcaagtaatggctgaacaaattctagtgtagctccaagatggcatcaaattgcactatttagatatttaaaagaaagtatttattgaattttaaaagttcataacttattaaatataaataaatatacgatataaatatagtgtaatagtaattataaattatgtacattattttattaagtaaatattctaggtttaactctaaaagtacgcttttgaagtttcattttgttttttctttgttgtatcttccaaattattgctaataatcgtgtctgcattacatgtgaaatttgtttttcaaggataaataaacatagaaaaataattaggggctgctgtcaaatgatgttagcagttggagagtgacttcttgccaaaagaggtgttgacaaacacaagtaaggtgacatcatttggtcaagcactttggttactgaaagaggatcatgtgcattagacctctcttttcacttctctgctctttaactgtctgttatttgactgggtctcaaccatatgcatgtgctcacttgcaggttagcctggtgggaaagtcagcctcagctgaagcctcaacaggcagcttggatgcttcttgacatctacattaaggtgagttcaaagtgggcagcccatcagtgattatctgtaatacctctggggagtttcacatttcactctgtattcgcttctcgctggctgtcataataaagtctttccaaataaacaccttttttttttttttttttttttttgagatggagtcttgctctatcgcccaggctggagtgcagtggcataatgtcggctcactgcaacctccgcctcccaggttcaagtgattctcctgcctcagcctcctgagtagcttggattacaggtgcatgccaccacgcctggctaatttttgtatttttagtagagacagggtttcaccatattggccaggctggtctcgaactcctgatcttgtgatctgccctcctcggcctcccaaagtgctgggattacaggtatgagccactatgccctgtcaacacatcttaatattatcttcatttgcaaaatgcccaatttttgctcatcttaaaatttcattgtgttttgtcagctgcaacgatttgggaaactcggatatactctctaactcttaatttcaaaattgatacagaaaatatgcaatctaaatagtgtgatacttattaaagaaaatgagtttgtattcaaaaagcttcccacagttacatttccgggcacaggtagcttcaccagaattttgtagtaaacatttgaagaagaaataatgtcaatactgtttcccaaccagaaaatagaataaaagggagaatttcttacacattttataaggacagaataattgaataattctaataccaaaactagacaagatcacaagaaaataaaaatacaaattaatattcatcatgaatacacatgcagaattcttaccaaaatagtaacaaatcaaaagaaacatatacaaatgaaaaagaaatcacaagcaaagtttatcccaagaatgcaagattgtgtttacatttataattaaataagcataattcacattaataaaatataagctacataaaaatataatcaataatgtagaaaaggcatttcacaatgtcaatacatttataataaagaatctctgcaaactagaaattaaaaaatttcctcaaacttataaggcaggaatataaaagttcttagaggtaataaatatttaatggtaaaatacggaatttttatatgattggagatgaagcaaggatgtctacttttatcatatcttgttaacattatgtgaaaggtttatctttagcaagacaaaaagtatacaggtaggaataaaacaagtaaaaatatatttttctgatacaattacataattgaaaaacattatattacaacttaagtaaattcagtaaagtcacagaaaacaaagtcaccaatcgatataaatttatctctgtagactagtatttagaattggaatagtaaattgaaatgtatgttgtcacttagaaaacatgaatatttaggaataattgtaatagaagatatgcaggagctatacactggagaaaaaacattgctgaaaaaacaaagtagatagaaataagttgagagataattcatgtaaatgcaatgaaggagtctatatttttaagatgtcgggcttttttcctcatttcaaaattcaactcaatctcattcaaaatcctaccaggtttttcattcggaaaaaattgacaagtttcctctaaaatctgtatggagatgtaaaggacctagaactaccaaattaaacctgaaaaagactcacaaatttggaggcttcaaactatctgatttcaagattcctgtaatgtgacagcaatcaaaataggttttggtagtaatgtaagaataaaaacagatcaatggaacaccatagggagttcaggtataaaactatgcatgtactgtggtttgatctacaaagatgccaaatgatttaaaaaggatagtatcttttaacatatggtactggaataactgaatatccatacagataaaaataaatctcaacctctacttcaaattaactacaaaattaatatgtgatggatcatagacataactattaacattttcaacttccagaagataatatataaaactaactttacaacaatgaaataggaaaatatttatttaacaggacactaaaaggactatcagaaatttaaataaaaatgataaatgggatttcctcaaaattaaaacttcatcttttcaaaagacactattaaaagtgaataggcaaagctctagatagaaagatacacatcggtcaaaagcggccattcagaatgtagtgtactcaaacgtatcaacaaagaaaaacaactcagtaagacaagaaggaaatacttgaatagacatttcaaagaagaatatttacatattcctctataaaactggtaaataagtgcatgaaaatatactcagcatcattagtcatcagtgaaatggaaatcaaaaccaccatgtatttttactgcacctccactagattggctaaagttaaatgtctaacattaaatattcaaaaagacatagagcatccaaaaatcttagctaaattaccataaaagggggtcaacagaagcattttgggacgtacttatggagttaggatttgaaaagaagctgcagaatgagacacagaagcagtgaggaagtaggaaggtggtaaaatgttcacatagggcaagtctgaagagagccaggttcacagagttcaatcaacattcccgctgataaaagtttccagagtttgtctttaggcacacagtgtgaccctcaagaaataaattaacacagaagactggggataaaagctagcatcaaaataactgagaaatcaatgtcaaaggaagaaagaggggaatatagtttagaaaactcttttaaaaagtatacattgcaggaaaatcaggaaagctgaaagaatcatttaaggatatatccaactggaaaaaaatctctactaggagaacaaagtcaagtttgttcacaggtgtgtggaaatagctaataaaaatgggcttatgaagatataagagaaaatgttgacaaatgtgggagccaggctttagggaagtctgaagtaaacaagatgacgagcacacataaaaaagtttagcaggtggataaagacacagaagaagcagtttgagacaccaaacatgaagaatcatattgtttgaattcagttccagaaaagaaggaatcaaggttattttgtgagaatgaaagactccaaagtggaactgatgactgcagaagagtggaggatatttgtaacatccattataataaaagaaagaaataaaaggatggctggacagcattgagagaccaaagtaaaattatatgaactcataagtagatatcaaataatgaaaaataattttatagcttcatgtagcaatgtagcagcttagtcatgtttgaaattatttgccccttggaaaaaaatttaaaaactcatatatatatacttattctgcatatatttatggatattttatattcatatgtacacatgtatgtgtttcctagttctgttcagtaacatatatttattaatctatctatattgaattagtaaatttatcatgtatttataagaaacatgagtaaggagaaacgaaaaggacatacaggcatcaaggagtttaggagacatggaagaaaagtaaattgaccatcagaatattatgtataaagttacggaagagagatacattctgttatatgggaaagtaatacttaagcttagaaacttaatggatgagtgaagtttaaccagcttggtaagaaaaatggggaaaaaatttacagtggttgtgaaatgtgcccaggctgagatgactcaggagaatttcatatagtatgtctatacatggtgtgggtggcatggctagatgtgagatcatgaggaacagtaaacgcagaaaatttcaaattttctaatgaaagtgaagaattattttaagcaagtgaaaaaaaattgtcccattagtttttttagaaagaatagagtgaaaaaaagtggaggacagagggggtatgattattagcacaaagtcctgattaaaagatattacactaggaaaagtgagaaataatgagtgaagctaaagcattcactgcagggattaaggaggatggaatgttgtaagcatgagggttaattaagaggcagaataaacaaaatgatatttgactgggaaggggcaggacgagacaggaggaaattaggatgacatactagatagagagtagttttgtgaatacgtatttcgatgtgttacgtgaatattcgtgtcccctcagaatccttatgttacaattgtaacccccaatgtgataatattagggggtgatgactttgggagtcaattaggttatgaggacagagcccttgtaaatagggttagtacccttataaagagagacatgtgagcttgtgtctgctctctccattctctatattgtgagcaacacccatctgcaaaaaggccatcttcaaaccagaaccacatcttcaggcaccttgatcgtggacttctcaacctgcagaactgtgaggaataaatgttgtttaagccacttagtctgtgataatttttatagcagccttggatgaccaaaatggaaaaaacaggagtaggtattagagtgggacagaaatattggtaggttcagaatggaagaatgtgagatggtatgagattttaaaacgaaaaaaataaaatagaaacatattgaccctaggatccagtttgaggtttgaaattgaccctggcatccagtttgaggtcggtaaactcaaacgattctaggtgaactaatgaggctgaagatgagaagcacatgcagtggaaattggaaagtgaggaaggtcaatgtccataaggcagtaatctatactttttgaagcagacaatctacaaaaatgattccaaccacatttgttgaaaaatttcgactaagatttttacctcattcccaaactctagatcaaatattttcaaatataatcaaaatatatttgcctcgatgttcaatagaaatctccaacttaatgagcaatccaaatttggcctattaaccaagatggtattcaaaacatggacaacttacataaaacagttactaacataataaaatacatgcccaatttctcaactgaatacacattaataaacaattgctccaacagaattgctacttactggtttaattttagttctgtttcactaccaagtctcttttcaattccttgtgtgatttgtctcatttagtggtacattcacccattttccccagatagaggtataaggaaccattatctatatgttttatagcctctcacagtattgaataccaattcctgttgattctgtcttgaaaaggtctctttaattttacctttcttttctactctcttcatcatgtcttatgttgactattgtgttagtctactataaggtctcaacttcattcctttgcattgctgttctgtgcctgaaatgctttatttccccttatctgcctggcagataaccactcataattcaagaaagaaatcagatgtcaactccaatgtgacagcttcttctaacacccatgaaagattaatcgcttatagccggtactgagtcggaggtgactcataccagctcattagagcaaatgtgcatatctcttttaggtacataattctacatgatttaggtaccttgaaatcctctaggtcaggataattcacaacttggaaattggcaaacactacatataagttgctccccacccccaagatctggtttactaagattccattgtttctagaccttctgagctcctattacaggatttcgtttctgcattacaacaacggatttccttgtcagtctttctatattagattgtcaggtgcaaggaatatcacttgctatttatcaaaaccttagtttctatcaccatgcctaacacatactttccgtttaggaggaaggaagtaagaaaagtaaggaagcatggaagaatggaaatagagagggagtgagacagagggaaggatgctgcatatgggtgattctgagtttcagattgtgatgaaaaaacctaattaaattgttcctggggtagaattgtgagttcaattcatcaagtcaacatggctgctaggttcttaaaaacaatgatagctaagaatgggagggttggtggagaaggtgatggctattgaagaacatagatcatccttcaattggtgaatagaaacaaaggtgggaaagattaagaaacagaatactgatattcaacccaaggatgaaaggactcaatactctccctcaaataacaggcaacttagtttttcagttagactgagacagatgtttgatcattttgcaaatggagacaaacatttcggctgactactatttttctcagttaagttcactccataaacagcttggttacaaagctctttgggaggcaagcaagattccttatctagacaacatagagcaagaaggatgaattccatctttcctctcaggcagagataaagggcacctgactttaaataaccaggagcagttggggggcagagtaaagccctcacggataaggcagtgctctgttcagaccacctgagtacaagtcgtagctctgccacttatctctgtgaatttgaacctattacttatttctagtcttctcattagaagaagtgagaaatgggattaaaactacttgattcactgggctgtttaaagagaattaaataaatctataagtagataatttagcatagtgcctggcatatactaatcacttagtgaaatgttcatgacgccgacgatggtgaaaatgttaatacaaatatgattggctaaaaaggacccagacctctagcgcttttgatctatagttcaagtcacatgtacttctggaaagacaaattgcccttgagaaggcagggaggaccatgcaggattcctgaaggcatcagtgagaactacaattctaccatgttcgatgaatgcccaaaattaattctagaattttgtttcttttaaaatcttaagagttcaatctctgggtttatggcgaaatttctaataaacttctgtccttgatataaaacttcacacttaagaaacaagagaattttccatggagcaattatatcccttagtttcacatcccttccttgttcagaaggtgtttgttacattaaattttaaaaaaagtctgaaagtgttcatcacacacttcataatgattacctgagtactttcaatgtttaaaatatttgtccaaaggaagaattattatcctctctgaatgatttctggtgtatatagaagaattaactattaatttctacaataagaactttgagtcaacccaattttcactgacttcatactcaaaagtcataaataagtccacctcagagaagagttttgtatcctgaattctgattctttttctatagttggagagatttgcctgaaatattaatactgaaatccaagactatttatcctttaataggtggtgatggttgcaagtcacaatattaataataaagtcactttcactgactctgacttccagtcctctagaaagtcattttcctgtcctagccaaacaaatctgggatcctcagagaggtgaatagcatgtgctcacaacaagccagtttcctgctggatccgctgttactgctcagtggaattcctaagtacatagagacccctgatgggtaatcacatgccccccaggtgctgctgtttcccccaggaacagtcctgtcctctgtatctgcctcaactgtagattgtatcacaatgaaaagggaaagatctctctccttttcggtcacagtgagtggggcactcaagaaatgctgtttaagtcccaaagcatttcacagatttcagtacaatcattccttttggttttttgttttgttttgttttgtttttcatttgaaaagctctattccatattgatttggttttgctctgtgtccccactcaaatctcttctcgaattgtaatccccacatgtcaagggagggacctggtgggatgtgactggatcatggaggcagtttctgccacgctgttctcataatagggccggagttctcatgagagccaatggttttaaaaatgccagttttccctgctctctctctctctcctgccattttgtaaagaatgtgcttgcttctccttcaccttctaccatgattataggtttcctgaagcttccccagctatgcggaactgtgaatcaattaaacctctttccgttataaattacccagtctcaggtagcatctttacagcagtgtgaaaattgactaatacgaatataaaatttaaggatggcttgcacaggggatataccaggaacatagccaaggacagattccatgctgtgcatagaattatctcttatctgccacagaacgtgttctctctcttgggaacctcatagaagtggacattaacagtccctgacacaggttgggagacatgtgtgattctcactcagattgtagctattggtctctcttctcactgctttctaggctccccaacttccaccacaagtactcttacgttacctcatcacccagttctgttttccttactgttgcttcattctgtagaccttaactttgctaatttaaacataagcatagttcacttggttactgtgaagggcaccaatgaagcaaacatcttgaggtcagttatcagtatttcagccaaatataaccatggcctatagattagatcagatcctttatttagatacaattttatagaaaagagagtgctcttcagacagtcccaaggatgtctggtgtttacttgaagactattttgattgtcatgtgacatcactgtctctagtattgagcagttttcaattcagttgggaggacaaatggttaatcatgatatcccgagcaagaactacaagtagcacaaaatcaaggtctcaggttataataatagagtctaccactaactaaagtcactgacagtgagaataactatgaaaacaattagaaggtaaccattagagctgagtcttaaaatatgaacagaaattagttacagggaaaggtggtcaaagtaagaacatgatactttcatattataaatcattttcattggatcagattctactgatcagttctcatcaccagtgatgactttcatataattcaatataatataatatacataacatgacataatatcatatatatagcagcttataatgggaatccaaaggaagttaagaaattaatggttcaccaggtaaataatcctgaaaatgcttgacatttaaaaaccagggctataaataaggaacccacctctactcatgccattttggcaccaacagatgatttccccactgatatggttggctttgtgtccccatccaaatctcatcttgtagctcccataattcccatgtgttgtgggagggacccggtgggagatggttgaattctgggggtgggtctttcctatgctgttctcatgatagtgaataagtctcatgagatctgataattttaaaaacgggaatttccctgcacaagctctctctttctctttgcttgctgccatcaacgtaagatgtgacttgttcctccttgccttctgccatgattgtgaggcctccaccagccatgtggatctgtaagtccaataaacctctttcttttgtacattgcccagtcttgggtatgtctttatgagaaacatgaaaatggatgaaaacacccacatttctcaccctttcacctcaattcaagacaatttaaaaaaaaataaatttggacttttccacataagatgtattattttacggaatctaagggtaaagctaaaactttgctcattttaaatcaaattagctttgcttcgataagaactgaagcttataatgttttatccaatgtttcataaccttaagtactctcttctgtaacctgatgctttggcaaaagttgggaaaaattgagtttgttttaggaaattcttgatttagcagtccactaaactcaccaacaagttgcaataatatctgttctggactaaaaccaagaacataattagcctggtgtacccctagcttctttatcatggagcagtgatttcataaatcataaaagaatgtaaaacttcaacaacgagaaaatattttctgttgaggaacagatttttaaattttatttgttttgtaaacaatatgaaaaggtttcatatgaatacttaattgtaccatcatatgcttagtacaattgtagaacaattttccctctctttttactcatttcattatatattctcactcactgtttcatcacataaagatgacaaagcatgggggaatgaatatatatatatataaaatatatctgtctacttatttacataactagttttcagtaattttcacttcatttattttaagatggtgctttacataacagaaacagttaaaaattattgaaaagcaaactatccttatttttggaatttggttccaataagaataaaaatgggagagaaagaaagaaaacaattttggggtatcaacgcctggtgaccttaaacagagatggaaactgtaaaatagaaagacatctggacacttaatcaaaatcagcctacaagtacctgaaaattatgctgtaagccattttaacctctctttcatagagggaaagaacacacttacaagcccccaatctattcaccttggattgttctaattggcgccatttgttgagagccaattatacatgacaaactgtgctgataccagatatggtacatcaccttgcaataaccgtaagtggaggtgttgtgattaactccgttgcactgatgaagaagctgaagttaagggtcattaaattacttacttcaaacagggtattactagcagagcaaggagctaaggaatcaagagaattgaaaaaccccaccccttaatactaatgcacaatcgagtcaaaaggaggctgaatgattgcaaacttcgcagtattcctcatctagctttttcttctttctgtggtttcttgtgttattgtaatttaaatgtctatgtacctcattttaagtgtccaaaaattagatgccacatcttattggaggaaaggaaggagtcctttggagggaaggaaggagtcacagtaaatgtagacgtctcctcatagtctggtcaatagaactgctgagtaaatggcagcatcctttattcacttaatagataaggttatccctgagcacagacacactgaaggcttctaggtagccaggagagtctctcaggtcaagacactcagtaatgacctcactaatgagaccctttagacttagaggctcatcaccagagaaaagacttacaggtgcaaccagcagcaaaacaggaggaaatttattctacagagaagcatttttgaccctggtttctatcccaggtaagcagggaggccaggatacacgcatttgtaaaatccagcacttagtatagtgcctgacgtagtgtgtgagcactcactgaaacaataatattaacaacattcgccaatatgtaaacattaatcacactttactaagtgatgtatgtgaattatttaacactctccaaattttaaaataggttctattcttgcacacatttttaggtaaaaatgaggtatggaaaaggtatttgttcacattcacaacagtagtcggtaactgaggtgttttaagaggtttgcctgactccagagctcttaaacacaaaatggaattgttttctcctataatcctaaaatctagaataaacccaggtgcacaattaggatggaataatgttttcatgcgtattggccacataagcacagagcagccatcaaagagagcaactgtggccaggcacgtggccaccagaaactagctgctactctcatggggaattttggttcaatgttcgtggaagctttaaaggagatgattgcagagatggaaacatattctcctcctgcttcatacttacaacagtctttgtcctcttacctcccatcccccttttccctagctgcttatgaggattgaaacgcggatgatgagtcttggtgcccctcagcaataaagccctgcaatgatgtgctcaggaggggaggcaagctcttgcaagaggtgctccacccacactgtgtgtcctagaaccagacctatatattttattagtaattaatggggcatttcatgttctccaatttctttgtactaattgcctgccacagggttaacacagacaattagaaggaaatacaaaggcaacagaacactcttttgtctcatcagcttttgcattatctgggaaatttaattccatcattaggaagacactacagatgatactacagtcttggagaatctgaaagtctacatcatattttccttaattttatccttatcttactgtctgacagacatatgcattcccaggtcaccattttcaggaggttcaagcaggatgcttaatgctcattgccatgaatttcaggtgtcataaaatatttatgaaataaaaaatgacaaagaatcaaattgttaggacatcacttccattcatcatgttcagtagccttggttccaaaagaactctgattttaatattgttacaataattgtatatcatctaatgtgatatacggtttcctctgttttttttttttaaagaaaaagcaacataacttatagatgcaatgaatagtcttccctttttgctacaaacaaacatctgacaatttaaccagtaaacatcatttattatgcttaccaacacttctgtagattttggtacctctggcaaccagtaaacctaagcgaggttaaaaaaaaaatgtatgcgtacttaactttgaaatgcattatttactcagggctacaaagtacatgactgcatatacatcctcttatgcttatccagatgcccacaacaatgtttaagagtagtgctccagagaatccttaagtttaatttctgcctaaccttttaaacagtcctgagcattaacatgtcttgctgcatttctttttatcaccctacctgttctaactcattttattttccaatttccctaaactgtatcttaggaatgagctggtttttaaactcttcctagaagcttccttcaagaatattaccatctgggccaggcacggtggctcacacatgtaattccagcactttgggaggccaaggcaggatcatcaccagaggtcaggagttcgagaccatcctggccaacatggcgaaaccccgtctctaccagaaatagaaaaattagctggtcctggtggcaggcacctgtaatcccagctacttgggaggctgaggctagagaatcacttgaacccaggagtcggaggttgcggtgagcagaaatggcaccattgtactccagcctgggtgacaagagtgaaattctgtctcaaaaacgaacaaaaaaacaaacaaaaagaatattactatctggttatagaactaggcacatgaacattaaattacagaagggccatcctaaaaccactgtaaacaatttaaaacaagacagtgcaatttaaatgtatcagtgtgcagttaataacttctccaggtaatatttgtagttatgttctatcccatcctagctatctcattcaaaatttgcagaaaacttcaaggagagtagccaaaaataacttgtatcaaagacacatgtgacttttatcagtaatgagagcttcattgcttctcttattttatttgtgcagcaagtaattattaaaattaaggcctgatgaaaggaaacaggataattcattttgggctgcaactcatgtgcaggggaagtgattcatgaatagttataggcctcaagctttcgggaaaacaattgcagtgttactagaaagatcatcataattaagtaaaagccaacccttagctatcaatagacactcagagattcacaggcataggtaatgcagaaattataactatcatgaatattacatattaggctttaattatcggggcaggagcctgggccctgatgattttttaatgaaaggtggaataacttcctaatttagcagttttcatttaaaaactcattagcaacaatattcaataatgcaataagattttccagatgggaaaaaaaaggagcagaggtaaagatatttcagcaacattttcaagggtagaccttgacaaggtttacttacattttttgttacccaataaataattctttaccaatttgcccagccttcattgtgctatgaaatatttaccctatattccctgccaaagaaagagtactctgtgttacttggtactggggtattttggatactgtaaaatctggaaaaccatgttacagtgattaaaaaaaaaagaggtaggtctattgacttggagagcttagatactccattacttagtttaacgtatcactagcccaatgttttttaaaaaagtgactcacagaatcaaagagcaaaaactggcttcaaaattgagttttggaaacctgccaatggtctcatctggttgataactaacacatgcattgaaaacaaacaagcctttattggctttatagtaagaatttctattgaatttatgagaggagaaaaagcataggttacttgcaagagaagtaaatgtttaacaagtgctaacgatatattcagtactttcaggaaaagcacaaccatagtctctgttatatggctttgttctttttaatccttactctgaaatttaaaggcagcattatttttaaattacattattgtagacttttattcttcatggggaatatattaaaggtagctactactggagtttaaaaatacatatatagaaaatgaaataaattgtcagcctattacagctgacttaatgttggttaagcatatcatttgggcatttgactgtaagccatcaataatttctgaattgactttttttattacaagtaagaggagtaggggtgtgtttttaattatagtgacatgcctcctttttcttgaacactcagagaagcatgatttcataatttcatgtgaaaaaaggaatttgagaatttgggaataactactcttttcttattaataatttatatttccatatgggagatagaaaatcttatctcatgttatacttttaaatagtcagattaaaagcagttatgaaatagctttttaagtctggatgcaattggaactcattcgtgacacatttccatcataataggatctaagaagtgagtgcaagagaaaaaaaggctgattcagcctttgacacaatgtggaattgttctctactgtaatatctgtaaggttttatccagataggtaagacacccagatttcatggcttcgttatttttaacatgcaaagctgtttccgaatagaagtaatgactgttcaaccaaaccgtttctctcctgttaataagtaaaaagaaagcagtattttggggaactaggcatgaaagaaaattggcacatatttccgagctatagcagagctgtacctgaggttgcacaaatgttttggttatctcaactcagtgcttcctgctgggatgggcattacttaatagtagagttgagacaacaaaacaaaacttgagaaacttgaagagtgacttttatggtctgtgtgaatagtcctaaaaatacattggaattacaaggatctatacatgttgatgagcgttacttgtgggaaaatacttctttatgaagagaaaatggaattgaatgtatcacattctttttttttatgccaaaacttttttttcttttttttaactttctttttaggttcaagggtgcatgtgcaggtttactagatagataaattgcacgtcacaggcgtttggtgtacagattattttatcactcaggtaataaacacagtaactgataggtaatttttttatcttcaccctcctctactctcaagtaggccagagattattgtatattgtatctttgttcttaatactgtcaaagaaagttttgatttctatcttaatttcattcagtagcagactgtttaattcccatgtaattatatgattttgagctaaattttagcatcgatttttatttttattgtgttttggcccaagagtacggtttgtatgatttttgtggggtttttccgtttgttttttggatttctggaggactgtttcacggatgaaagcgtggtcacttttagattctgtgtcatgtgcatatgagaagaatgcatattctgttgtttctgggcgaagagttctgttgacatctgttaggtccaattggtcaagtgttcagatcaggtcctgaatatctttgttagttttatgcactgatgatctgtctaatactgtcagtgggctgttgaagtcccccattattattttgtggttatctaaatttcttcctaggtctaaaagaacttgatttgtgaatctgggtgctcctgttttgggtggatatgtatgtagagtagttagactttcttgttgaattgaaccttttactattatgtattgctcctatcttttttgattttttctttgtttaaaggctgttttgtctgaaattagactagcaatccccacttttttctgttttccatttgcttagtagattttcctccatccctttatttgagcctatgggtgtcactgcatgtgagatgggtctcttgaagactgcctatcattgggtcttgcttctttatccaatttgccactctgtgccttttaactgtgggacttatctcatttacattcatagttaatattgagatgtgtgaatttgatcctgtcatagtgtttttcgctggttattacgcagacttgattgtgtagttgctttataatttcaatggtctatgtacttaagtattttgtgtgtgtgtggctgctggtaatggtctttcctttacatacttggcactcccttcaggacctcttgtaaagcaggtggtaacaaatttccttagcatttgtttgtctgaagaggatcttatttctccttcacttaggaagtttagtgtggctggatatgaaatttttggttgaaatttattttctttaagaatgttgaaatgtcttctggcttttctttaagaatgctgaaatgtcctctggctttaccttaagaatgctgagatgtcttctggccaaaatgtcttctggatcgtatagtttctgctgaaagtttcaccagtagcctggtggggttccttttgtaggtgccctgactgttctctctagatgcctttaacattttttccttcatttctaccttggagaatcagatggctatatgtcttggggatgaatatcttgcatagtatcttggaggggttttctggatttcttgaatatgaatgttggtctctctagtgaggttggggaaattttcatgaacaatattctgaaatatgttttccaagttgcttgctttctctccctgtctttcagggataccaatgtgatgtagatttgatcagtttacataatctcatatttttaggttttatttatttttcatcttttttctttaattttgtctaagtaattatggagaatcagtctttgatatctgagcttcttgcctcagcttggcaaattctgctattaatacttgtgactatattctgaaattattgaagtgagtttttcatctgtatcagatcagtttgattctttttcaaaatggcaatttttgtctttcagcttccatatcatcttattggattccttagaatccttggattgagttttgactttcttttgaatcttgataatctgtgtttctatccatattctgaattttatgtctgtcatttcagccatttcagcctggttaagaaccattgctggaaaactaatgctatcatattgaggtaagaagaaactggctttttgagttcgtgtttttgttctttctcatctgcgtgggctgatactccttcaacctttgaagttgctattatttggatgagttctttgattttatcttctttgatgcccttgggggttttgttgtggtataaggtaagttcagtctactggcttcatttctgaatatttttgggggtcagtgctcagctcagcactcctaggctatgtgtgttaactctggagggctagtattggtcccctagcttttttctctggcccatcgaggttagaaacatgctgctctggaggggttgagttgttccctgattgctgggcaaagcactatgatcggtggggccagccaaagcactttgtcagggtggtaacagtaggatctgtgcctgtttgcatatgtcagcagcagcagcagcggcggcaccatgacagcagcatcattggctggggtggggtgccactggaagtgaagctgcagtgttcctgaatgtgctcatactggcagcagtaacagcaacaggggtgggggactggtgggtgcagagaagccagcctccatgggtgcatttcagtggcaactgtagcagcattgcagggggtagggttgtgcatgccttcacagtggtggcagtggcagcacagtgggggatggggttgtcatgttcatgtgtgtgtttatgctggcaatggctgtgcagctaaggtgggcgtgatgtgaactcacaccagctatagttgtgtggcaggatatgcacacatgtgtgccaatggggcagaggagatgaggtccatccacgggcatgtgccagcaaagcagtggggggtggtggccatgggtacgtgcatgctggcgaggtagcgtgagggaggttgtggtgggaggaaggtgcgggtgggctggtgcacgttggcagggaccactctactggtgctctccaatggccaggcatggtctgtcagtgaagaatctatgatgaggacccacaggaagtacctcagctgggcattgaatgcttcactacaagcaggcacagccaggctgggtgccccagggaggtcagaggatggagtgtgctcacataggattggccctatcttacaggcaagaccaccctgctctgtccagttctgacagttaccataaggctaaaatctcctagaggagcatggtgagccttgggggattggttttcctggacatgttccactgcatatgttcccatatcaaaccctgtgggctctgcacaggctggagtcctgccccctaccacctctctaaacaactctccctgccagatcaagtgactgtgagggtcatggggtctcctgctgccaagttaccacaggtccttggtgagagtgggtcactcctcacctgtttaactcatcccttcccccaggagtcactgggggctaggaatgagtccctgtgcatagcagccccatgcagatttcctagcttcctcctccttcagctcagcatctctgtcatctggccatccattccaatactttccctttgacgatctttgcagagtgcaccagtcttccagatgatgtattctctcagtgacagatgttccttttggctgcatctagttgaccatcttgaatcttgtctcatactctttaccatgatttctgcatatcatgacagaattttgatttattgctataaattaggtcataattgttttggatcagatattaaatcattggacaaataaaaccccaccaagtgataggggaaaatattaaaactcgatgcaacgtcttcctaaaaaaaccgcttaaatgccaggaatgctcaatgtaacttctgtaaatattttcttatcttatttagtactggttaatgctacttccagaaaataataacttaatttaattgcttcagtaaatcgcagctgatcttaagctttcttatagctctggggaacagcacagtatcagctgagaaactctggcttctatagtgctatagaggacataggaggaaggaggaaaaaaagtgggatgagagagaatagggcagaggcctcaggaatgaccgactctctattacaaacattttagatgacatccaccatgggtaacaatcaccctttgtaataattgcatttaaaaagtttgagtttaaaatagtttaaatacatagtcaagcccttgagtcatgtaatgattcagtggagagtgtattttacaaatacagaaatgtgggtggcatatgtgataaactcctatgaagacttctaaaatgaacaaaggagagagtgatttcagcaacatggcagaataggaggtccaagcccttgccccctcacacaaagaatgattaaacaaatattaattgtcaaaaatagctctgggagagctctggagtgcaattaagaagttaatgcaacccagtggaatataaaaactgatggtgaccacagagaaaagtgtagaaagcatttttcctgtattatctcatcttgcattctggcacaggaaagcaccaagaagaatctacttgactgtgacttccctctacatgggaaaagtaaaacacgggaaattcagtagcccttgtcacagagcacaccagcaccacagatgcaattcattatagaggacttgaacagtctttttaaataaagacctcagctgatatagcctcctagagcccacaccaatacatctcaatccacacccagagcttgagtcactgctaacactgccttcccagagctgtggccactgtcccttcttagctcacgcactatttgtattcaaagcagccttagactcagggctaccatgtaccccttggatccataaaaagtacccaaccataccccatccagtcagcaactcatgcccagctgcaggtaaaagtcctttcagaccaaagccagtctgtaaagtcttggacggtaattcactgctttaataatgcaaatgccaatgcaattctacaaagaacaaaaaagtcaggaaaacatgacatcaacaatataaaacatacatttccaataataaaacacatagaaatggaaacataaatattgcctaagaagaattcaagtaattttttgtatgtatggtttaaaagtggctcatccagatacgagtaaacacacataggcaattcaataaaatcagaaaataatatatgaacaaaaacagaaattaagccaaaagatagaagttataagaaagaaccaaataaattctggagctgaagaacacaatgaataaaagaaaaagtgcaaaagagagcttcaactacagaatgatcaagcagaagaaagtatcagcaaattcaaagacagggcatttaatgttacctagccagagcagaaaaacagtaaaactaataaaaactaatgaagaaagtttacaggcctaacggaacaccatcaaggtacctactgacacactgaggaagtttcagaataaaaagagaaagggagcaggtcagaaaaattatttaaaggaataatgacagaaaattactcaaatctgaggaaataaacagatattcatattaagaagcccagtggaaacaaacaggttgaacaaaaaaaaggtccacactaaaatgcattatcattatcattaagttttaaaaattgaaagacaaagagaattttgaaagcccaagagaaaattacatgtcacctataatatccataaaactggaattctatgaaagcatgaatctcactggtaaagataactatataagcaaatacacaataatgtaacactaatggtggtgcataaattacttttataatgctactataaaagttgaaagataagtttgttactggtaacacaatataaaaagaagtcaactctgactacaagaacatacaatttacatgtggaaggatggaagagagtaaaagtgtaaagttttttcctgtgattgaaactgagttattatcaacctacaatagagagtcataactacaagatattttatgcaagcctagaggtaactacaaagaaaaaaaaactgaacacaaagacacaaaatgaagggaaaagaaccaaagcaaatcagtacaaacattagcaagtaaaaaaagaaggcaagtgaatagaggaacaaaacaactgtgaaacaaacaaaaacaataaaccaaatgtcaataataatttctcatcatcaataattattttaactataaaaagattaaatgtttcaatcaaaaaccatagagtttctgaatggtttaaaaacataaaataaaagacctagttatatgctgtccagaagacactcattttagacttaaagacctacatagggtaagagtaaagggctagaaaaagatatttcatgtaaatggtaaccaatagaaagcagagtggctatccttataccagaaaaaaaatagatgttaactcaaaaattgtttctagagcaaaaagtcattatataaggacaaaagggtcaattcacaggaaggtgtaacaattataaatgtatatgcactccacattaaagcacctagacatgtgaagtaaatattgacagattggatgagagaaattgacaagaatacaataatactaggagacttctatatcctgctttcaataatgaatagaatatacggatagaaattaataaacagctgacttagcctctagattgaatggacttagcacacatatacggaactttccagccatctacagaagaatacacattcttctcaagtgcatatggaacattactcagaatagatcatatgttagtttacaatacaagccttaacaaacttcagatcagaatgattccaagcatttatcctaatcacaatgaaatgaaactagaaatctataacagaaaaaaaacgataaattcacaatacattgaaattaagccatatatatatatatatatatatatgtatatattttacgatggagtctcactttgccacccaggctggtgtgcagtggcaccatcttggctcactgtaacctctgcctcctgggttccagcaattatcctgcctcagcctcccaggtagctgggactataggcgtgtgccaccatgcccggctacttttttgtatttttagtagagatgggatttcactatgttggccaggctggtctcaaactcctgacttcatgatccacccatttcagcctcccaaagtgctgtgattacaggcatgagccaccgctcctggccagcaatacgttcttaagcaatcattgggtcaaagagaaaatccaaaggaaattaaaaaatagctccagccaaatgaaaatgaaaatgtatcctattaaatttatgagatgcagcaacagatatattaaaaagtttatagctaaaatttattacaataaaaaagaaaaatcttaaataaaaatccaaatttgtatctgaaagaaaaagagtaagaaaaaaataacactaagtaccaagttagcagaagaaaggaaataattaaggaagaaataagtcaaaagtagatttaaaaataatataaaagaatcaattgcttttagagttggttcttggaaaatttttttaaaaatataaatgcttagctagaccacctaagaaaaaagagagaagacaaataaaaatagatatgaaagaggagatattacaatggatgcctcagaaatgaaaagaatcacaagagattactatgaacaattatataaaaacaaactggatattttgaacgaaatggataaatgcctatggacataaaacctgattaaaatgaatcaagaagaaatatagcctgttcagataacaaggaaatttagtaggtaattaaaaacctccccaaaaagaaaaatttaggtcctgatggcttcacaagtgaattctaccaaaaatccacataaaagttaataccagtcctcttcaacttttccagaaagtagaagaaagaacacttctgaactcattttatggggccggtattacccagttaccaaagtcagacaaagacagcacaaacaaacaaactgtcaaaactatagaccaatgtttttggtgaacatagattcaaaatattcaataaaatgcagcaaactgaattcaacagcacattaaaaggttgttacaccatgaccatgtaggattgattgctgggatgcaatgatgtttcaacatttgcaaatcaatcaatgtgatataccacattaagaaaactaaaaataaaaaccacataataatttcagtaggtgtaggaaaagcatttggcaaaattaatttattcatgattaaacctctgaaaacaatagatagacaaggtacttacctccacacaacataggttacttatgaagagcctacaactctcattctaggtataaaatgaaagcatttactctaagtttctgcacaaggtaagtctgcctgctcttaccactttctagtcaacgtagtatggaatttgtagctaaagcaattagatggaaaaaaaagaattaaaagtcatccaaatctaagaggaagaagtaaaatattctccttacgcagattgtataatcatatatgtagaaaaatctaaagggtcaacaacgaaaacaaaacaacaacaaaatcctgttagagtacattcaacctgttagaaacacattcagtaaacttgcaaggtacaaaattacatggaaacgtcaatgatgtttctttacaaaaacatcacacaatccaacaagcaaattaaaacaaaaacaatttcatttacaatagcaacaaaatgaatgaaatacttaggaataaactgaaccaaagtggtaaaagatatgtacactgcaaattatagaacattgttgatgaaaattaaagaagtcacagataaacggaaggacaacttgtgttcatagatttaaagagttgataatataaaatgtccacattacccaaagtcatctgcagattcaatacagtctctatcatattaccaatagctatctttacagaaaaatgtcttaaaattcatgtggaagtacagaacacctcaaatatccaacgcaatcctgagcacgaagagtaaagctggaagcatcacagttacagatttcaaaagatattgtaaggctatggtaatcacaactgtattgtactgacataaaaacagacacataaactaatggaacagaaaacggagcccagaaataaatctatgcatctacagtcaattgatctttgcaaaagtatcatatcgaaacatgcaatgaaaaaaggatagtctcttaagtgatgctaggaaatctagatatccacatgtagaagaataagatgaaacatttatcacacaccatatagaaaaattaactcaaattgaataaaagacaaacataagacagaagaacagggaagaacatcttaacaatggtctagatagtaattttggggatgtgacttcaaaaccacagggaacaaaagcaaaattagacaagtggtatggcactaaactgcacagcagctgctcaacaaaggaaacaattagaggaaaaagacaatctacagaaagagagaaaatatttgtaaatcatatatccagtaagagattaatatccttatatattaaaatatgtaaagaattcaataacaacaagaaaaaataaaataatattattttaaaatgggcctaggtcttgaatatatatttatcaaaacaagtcatagaaatggccaacaggtgtatataaacgtgctcaatatccttatcaacatgaagtaaaaattaaaagcacaatgtgatattaccccatacctgttagaatgaaaattatcaaaagacaaaagataacaagtattaccaagacatgaagaaaacatgtgctgttttggtgaatttacattgttattgctattatggaaaacagtacagaattttcttcaaaaattaaaattttctttaaaaattaaaagtaaaactcccatatgatctagcaatctaactgtatatatttaaaggaaataaaatatctcaagaaaatgcctgcaattctgtgttcattaccatattattcacaacacccaaagtacaataacaacctagatcttaatagatgaaaaaacttgataaagaaaatgtggtgtatatacatacatacaatggaatattattcagccttaaaaaaggagatcatggcatttgtgacaacttggatgaacctgaatgatattatgctaaatgaaatatctcatgcacaagaagataagttatgtatgatctcactcgtatgtggaatttaaactagttaaattcatagaaacagagtagaatagtggttgttaacaactttggggaggaggaaggaagatatttgtcaaaacgtataaaatttcaggtatgcagtaggaagttcttgagagctcaggtacagtaacgtcacagtaattaacaatattcactgtatgtgtttgaaatttgctaggagtgtagatgctaaatgggagggtagattttaaatgttccatcaaaaaaaacaaaaagaaaaaagaaaatggtaactatatgaaatgatgggtatgttaaatagcctgattgtggtgattattttacaatatacacacttaccaaaacaacaagttgtacatcttaaatatatacattgttatgtgttaattatatctcaataaaccttaaataattcatcaaaacatggaagaaaattttaagaccaaaatagatatgtcatgtttattgattgaagaactctatattgttaagatatagagtttcaaaaaatatattgactcagcataattctagtcgaattctagcaggttttattgtaaaattgatgagtttattgcagcactcgtataaaaatgtcaaggacttggagaagggaaacgaaagaaaaacttagaatgaattacacacttagatttcaatactagctctaaagtctcacttagtagattgatacaacaatagacaaatagattaatggaatacaacgaagaccagactttgacattcatgtaaagggtcacttattttataacagtaatgcaattcaatgggaatgagcttttcaataaatgtatcagtttatataaaaatagacataaatcttgagttttatcaataacttgagttggatattagatgtaagcattaaatataaaacctaaaggcttgtaggagaaaattaataataatatcttcacgatcttgggataaccatgaacacaaaagaccaaacctaaaggaaaagtaatttggaaactagaaatgatttataggaaacactttggcttggcatgattgctcatgcctgtaatcccagcattttgggaggccaaagagggtggatctcctggattcaagagttcaagaccagcctgggcaacatggcaaaaccccatctctacaaaaatacaaaaattagccgggcatggtggtgcacatctgtagtcccagctatgtggagggctactgtgaggtgattgcttgagatcagaaggttgaggctacagtgagccgagattgcaccactgcactccagcctgagtgatagagcaagaccctgtctcaagaaaaaaatagaaaaagaaacttctattaattaagaaacacttttaaaataatgaaaagaccaatcgccaactaggagtaaattgatggccagtattcacaaattttaagagacttatggctgcaagaaaataatcaaggaagacttgtgctacatgtttccaatttgaagaaagtgaaagtgaagccacctctgcccaactgaagcctattttattgtctctatcttccctcttcaacagaaattcctaagctgacgtaaatactgatattctctgcctttgtttccaagacaaccagaagaagaataatgataaatacataaacacatcaattagaaaagttttgttgctatatttatagagggaaagagggaatctgcatagagacagaattataaaagctgttgcttcttaaccaagagtgacagatgagagttttcagcaaagacatttgtgtgttttggagttgggggaaggtggtggtaggtataactggaaatagctgttagaaattcaaagtttgcagatatttcacctagtgacgaaggttttcagttatatttaaagcaaggccaagggaaatgaatcattctgacaatgacgtaacagcagcatcttttaaaaataggagtcaataagagctaagaaaatataccaaatggtaattggtattcatttgtttttggaatattgaaatcattattcttccctttacaaagaaggaaatcagaagtaaaagtctaaatatttaacagcaaaagggtttgggcatcagccacctagaaatgatgccagatcacagtactttagtgggatcatgaggaatctttagttaattagctgacagtgctgttcccccaaaacagtaagcagcttcatcaaaaacaaatatttataatgtgactccaatgtgctagcaacttttctagtagaggaagaaaaaaatgctgccctcatagagctgaaattgtggtaggagaaaaagacaaacaaaagaagaaaaataaatatattgaatagtgatgcaatcagacacaataaacttccatttaaagagatatcagaataagtgaaccttgaacttgcctttataataaataactagaaaacaggacaaaatatattaaataattatttcaaacatcacagaacggagaccgtgttctctgagagtagaatcggaaatgagttgattcctgcaattattctgaccaggagtcacttttcagactgcataaagaatgatctctggagtaaaaacaatgacaggggaattgtaagcctaaaaatacctaacatggatctgtgataaactacaggtcacacctagcaggaaacaacccataaaacatctgcaattttcaaaagaggctctagaatgatcaaatcttgttagtatggatacattaatcttacagtaaaggctattctagactttcattaacaagtttttaaaagaatcgagctggttagaatgtaatttaactgccagccaaaataacgtctaacactatcggaagaaaaacaataaaatatatttaaaaacagtattaacattattcagcatcaaataaaagaaacacgagacatgcaaagaagtaggaaaatgtcctaccactagtaaaaagaaaacaaaacccaaagcttcaaaaatcagaaatagtagtgttaccaaataagaactataaggaggtataattatgtgtaataaattaaaggaaaacatgaatagtataaaggaagacatgaaggatatgtaaatgaaacttctagggctgtaaagtgcaagcatactcaggatgaactttaaagtagattcagcaatatcaaagtaaaagtcagtaaccttgaagacatagaaagagaaaatacataaactaaatcactgatagaataaaatgctaaatgatgaacaaattctcaatactatgagaaaatttcaagtaatctaacataggtctaatttaattcccctcaaaaaagaatgggtttaaagtatttatacaaaaattagttcttctcatgtctgggaagttcaaaaaatctacccaaagctatgaccaaatcactgatagaaagctataaattggccggggacagtgactcacgcctgtaattccagcactttgggaggcctagtcaggcatatcacttgaggtcagcagttcgagaccagcctggccaatatggtgtaaccctatctctactaaaaatacaaaattagctgggtgtggtggagcgtgcctgtattcccagctatttgggaagctgaggcagaggaatcacttgaatttggaagcagaggttgcagtgagccaagatctcacattgcactccagcctgggcattgcagcaagactccatctcaaaaacaaacaaacaaacaaacaaacaaacatcaaaagaaaattgtaaaataaaattttaaaaacaactaaaagaaaaaaatgaggacaatccatatacaggtgtaaaaatagaaatagccattgatttagcaagaaaaacaatgcatgccagaataaaaatgtagcaacatttgtaggagctgaaaataaaaccaaatgtcaacctgttattctatgtccagtgaagatattctttaaaaatgaatacaaaatgaaaacatttttaggtaaacaaatgctaaaataggatccatttccagactagcattacaagaagttgcaaagacagttctacaggttacagtaaagtgatcccagatggaaactcttatttacagaaaggaataaatagcattaaaatatttaatatgtatgtacatataaaagagtttatttcattttttccaaaaacttatttaatagaaaacaatttaaactataataacaatgttgcagattaatatgaaatgtagaaataaaatatatgaaaggttctctgtaaattatgtatatatattactgtgcatatatattatatatttgatatgaaatatttgtgtaatgcaatgaaatttattgaattgtcttggcaattttacaaaaatcaacagacctcttacatttgtggaaaaatggagtagacatttttttcctatttctcctgctatacacaatgaaaagcttggacattttacatataacaatcattgaaggacactaaaaggtagataaaataagtcatgacctaaggacctcacaatctgtgcaatggtgtggtcagtttcctgggttttctttttatgttatgtattccagtaataaaactgttgaaggtggtagcttaaaagcatcagcaggcatagaaaagaaaacatctacaaagccttttctctagccataggaccaggaaagcagcattctattaagaggaaggcggaacactttcatatagtaatagctactattcctaaacactagcaaaaaaatgaaaaattaaaaaaaagaaatttctgccctactttcaccaatcccagcaaagactgagtggagagcctggacttccaacacgtgtccagctgtaaggacactcatcagttctcctcaaagtaaagctgtggcaccaaagatggctgaatagagggtggagacttttatctccactggttggtaacgaagtatctctccctcagcctgcttctcttttcatcctcccattgtcaccttccatcccctgccctgcagtgtcagtggaaatcatgtgaggtgcctggacttattcattcattcaacgataatgaggcatgcctttctctccttactggagtcatgttaaaggaagacagctaagacagaaaattgaaggaagagtcaagatctcataacataatactcaagttgtccgggtttcagtaggaagtccctcatgttactaagaactcaaaaatctgaacttgatttttaaaaaatcaatacttaaaactgagatggcagaaattattctctgacagagattttaaagcagtcatcataaaattgcttcacccagaagttacaaacatacaggaaatatttttttaactcagcaataaaatagaaagtcttagcaaagaaataggaggtatagagtggaatcaaataaaaattttagaacataaaactacaataatgaaaattaaattgcaaaaggtggttctaatagaagaacagaagggatagaatgaataatttttgaatcttaagagagaacaataaaaattacacaatcgacaaaacagagaaaatacattttaaaaaataaacagtgcctgaggaaactttagactatatctcaaaagagctaacatttgtgtctcttgagttccaggagacaagaaaaaggataagattgaaaaattactctaagagataatggctaaaatcttcccaaatttgggaaacggtgtaagctaacagatccaagaaactactttgcttcttggattagtttgtatcacaaacagaataaactacaaactgtacacaccaagacacattatagtcaagcttctgaaaactcaggatgaagaaaataacttggaagcagcaagaaattcgacactgtacatgaaggtaaaaacaaattgaataacagcgggtttatcatgagaaaccaggtcagcgaggagaagaggcctgatattttttaagagctgaaaaaaggttctgtcaaccccgaattctatgtctactaaaaatatatttcaagactgaaggacaaatcaagatattttggaataaagaaagactaagaggacttgtcaccggcagatctgtcctaaggatatggctaaaggaagttttctaattgttataaaatattggcaaagacaatacatttttcttctcttcttaaattttctaaattatgtttgatgctagaagctaaaattataataccttctgatgtgattctaagtttatgtggaaaaatatttaagacaattatattgtaaatgggtggtggtggaggagcataaattgtgctacagattctacattttactttaactggcaaaataatgacaccaattgactatgataagttatgtacataaaatgttatatatatataataaccagtaagaaaggtttacatcacatacactcaatgacactatggacaaattaaaatgaaattctgaaaaagggcaagtaacccatagaaaggtagagaaaagcaaacagtaaaatcactggggaaggaaaaacacaaaacaaaagtaaaatatctgacatattggtaactatattaaacagaaattatcttttaaaattacctatatgctgtttttaagaaactcagataaactataaaaatatagatgtagtaaatgtaaaaaaagaaaaaaattatattacgcaaagtttcagaaatgaaaaatatctggtaaataagactccagatctatatctcagtcaataactagagacagagagggacattgtataattataaaatggtcattccaacaaaacatattaatcttcaatatccatgcaccatgcaaaatatttgaagtaagactagtataagtgaaaggagaaataggcaaatacacaatttaagctaaagactgtatcagtccgttttcacactgctgataaagacatacctgagactgggtaatttataaaggaaaagaggtttaatggacccacagttccatgtggctagggaggcctcacaatcatggcagaaggtaaaagacatgtcttacatggcggcagacaagagagaatgaatgaatcaagtgaaaggggaaaatctttataaaataatcagatatcgtgagacttattcacttccacaagaacagtatgggggaaactgtccccatgattcaattatgttccaccgggtgcctcccacaacacgtgggaattatgggaactacaattcaaggtgagatttgggtggggacacagccaaaccatatcaaagatttttacaccctacctcagtaatagataaaattataacatagaaaatcagcagacaacttacccaagatgctaccattgggtaaaggatctcttttactcagtgggacctgtctgtattatttcttacaactgcatatgaatttaatatcacaaaatgaagagttaaaataataatggtagaataaatcatttgaccatgatatggagccatttctgaaccattgccaaactatcatcattattatagctttatattgattcttaaagttgacatagtgtgccattctaattttttattcaaaacatttgcattggttattaaaggttgtttgtattactgtataaatattaccatatccttgtcaaattctacaaaacacgtgttagaattatgatagaaattttagtgaatctgtaagttatttcagtgagaattacaattttaacgtaagtgactcttttaacactcttatacaatgcatctgtccacttacttaagttatctttaatttttctccacggtgttttctgctttttcctcttgaggtcttggagttctagctgctaaggctgcttttctccattactgaggaaagcctttgtgatgaagccaaaagtgttgaaaagtaatgaaccccatttagcaagatttccacattttgatttccctctaacaatctgccaataggcaggtttttcatttgcgccactgttttcagatagttgctttttcttttgaattttgtgtagttatgcttgtcattagctggaggattggtctctaaggtgtttgcaatgcaatagtagaactggaatgatatgagtatattttgataataaagctaaaagggttattttacatatcgatattgattgttaaagaagaagattcaagaatgagttcataggttttggttgacaactggactaaggctattgttgttagcaaaaaagtgaaataattcagaaacaatagttttggggtgggagatattaagaagttcagtttgaaaaagtcaagattgagatacctattagatagtcaattaggaattttaagttggaaatttattaaagaagtctttatttcagtggagatatcaaagttggagataattttatgaatcataagcatataggtaatatataaagtcaaaaaaactggatgaggtcactaaagggagtgtgtgtggacaggaagggaagagatcaaaagagactcaaaggctgagttctgagtcacataaaaagcaatataataaaatgtgaaaatgtgcttacagcaatatgtaaaatgaaaatatgagaaggaataaataatccagcctggaatgtcaaggaatttccttacacttacctctaaaaatgaatctgtatgtatgaacaaaagttatccaagcaaatgaaaggataaagaacattctgggatgataggcttcaatgagcaaggcacagagcttatggagagcatgactgtttaatcatgctacgggaagactagggcaagaaatggtaaatgcagtgttgaagaagaccagatagaacaaccgttgcacttttttgccacgttaagaagacgtttttatcaggagagtttggggttttaaaactgtttctgaaagtagaacttattgtatgtaagtaatctgaggtggaatttaaatttataaaacaaataaaagaagaatttccttgttgaaattagtgcattcaggggaggaggaaggtacaatttgctttatgttcactccgggtggcagcccctgacacaccttcagaaaatctcaagaattcatgcttcagaattcagtgaaacagtcaggtgctttcaatgatattcatcaagttttcattttaaatctactacttatgtgggatgaatttgaatgaaatattattggcaaattcactgaaaagaagaggagatcggttaatagtgcaggcaagaagtgacaaaggcgaagaaaatgcagtgtcttatagaaaattacttggaatattcttgagggtagtgagagccagaatcctctaagatgagatgatatttcttctttcatctaaactagatcttgtacataatgatataaactgtaccactcaaatagtttttttaaaaaacccttaattcataaaacaggtgcaagagtgtcacagtatcctcacacagtggtagcccccatgttaccttcagggactctgtagaatctaacataacatttatctgtaaagtttactgatagatagtgtacagttttatgagtttaaaaatcagtaattaatgcactcaccatcacagcaacaatataagacaatcctattattgcccaaatggtctccttggcactttgtggttaacctttcgcccagtcctagccttttgcaaccattaatataacattaatccttcaaatgttgtcttttccagaatgttatataaatggaatcatacaatatatagcatttttaaactgaatctttttgttttagtatagctcatttgtgattcatctatgtagttgcacccaaaaatagtctcttcctttttgattgattgacagcattccattgtgtagatataccagcttgtttaccttctccctcgctgtgagatatttggattgtcgtcagattttggcgattacaaatgaaactactataaacattcaggtaccaggttttgtgtgtacctaagtttttatttcacatgagtaaatacctagggcagagtgagattattgagtagaatgttatctattcaatttggccagaaaaaaaaaataccaaactgtttctctattctcaagggttttcacacgacaacagatgagttgtggtgagaggctgtgtagatcaaaaaccccctaagatatttattattttaccttttatacagaagtttgccaatctctggcccaaaatatggtccatcatggtgaattttttatgtgcagtggaaaaaaatgagtattttgctgttatttgatggagtgttctgtaaatgtgaaataattcacattccttgtgatattcagtctcctacattcttaccaattttctgtttctttgtttgttctattgattactgaatatgtagtgctgaagagtgttgatgtttccagctataattgtgaatctgcctcttcttcctttcagttttatctacttttgctttgtgcatttttaagttctattgctaggtacatacccctttggagttgtcatgtcatcttgctgaattaaacattttattgctacacaatggccttctttaatttctgataatatattttgttttcacttcaacttttctgttattaagagtcacaccagctttctgttgattagtgtttacatttgttttaatcttatccgtgccatcacattcaatctaagtttcttgtaactagcaaatagataaatattaccttttaaaattaatagactatttttagagaagtttaagatttaaagaaaaaataagcagaaatttttactgaaatggattcattttaggtcctgttgctcacagcaagaaaagtcaattactgaaacaatgagtattaccaggaaagaaggctttattcctgggtgctgtagccgaggagaacaggagatcagtctcaaatctgtttccctgaccgactaaaattggggatttatattgcagagaagggatgtagctacatgcagtaaaacaggtattagcgaggagtacagaaccatcaaggcaagcaagggatctggcatcccaccattgtccagatgcagtgatcttataagtttcagctccttgataatgtctgggatgctgactgattgtcagttccctgaaagaaactcagataagacaaatgtaagtttctctagttttaagactgaaagaatcaacttctatgtttatccaaaaaaaaaaaaaaaaaactgtctatgggacaattgggtcggtttcaaaatgacagagtacccatattatccctctctcccctcttcttccccacaatcccctttattattaacattttttcattaatgtgacacatttgttgcaattgacagaatattattaattaaagttcatagtttacattgggatttagtctttctgttatacaatttctgggtttttacaaaggtataattgcatgtagctatcattgcagcatcaaatagaacaatttctctgccttaaaaaattccttgagttccacctgtttcatcctcttttttactgaaccattggcaacgaatgacctatttactgtctctataatttggccttttctagaatgtcatgtagttggaattatgtagtatgcaatcttttcatactggcttattttactcagtaacatgcatgtaagcttcctctatgtcttcttgtgacttggtagctcatttccttttattgctgaataatttttcggtgtatggatgtgctacagtttgtttatacatttatcttttgaagggtatcttgttttcttgaagttttataatggtatcttgtttgttcttactttttaaatgttttgtcaatcatgaataaagctgctctaaatatttgtgtgcaaggtttttttgttgtttgtttgtctttggttgtgggttttttttgtgtgtttgtgtgagctaaccaaggaatatgatcactggatcatgtggtaaaagtatatatagctttctaagaaactgccaaactgtcttctacagtggctgtactactttgcatccccatcagtgatgaatgaatatattggttgctccacactcttgctagcatttgttattttcagtgttttgggttttagccattcttaaaggtatgtagtggtatctggttattggtccttaatttttaatccagtatgacaacctctgtcttgaaacaataatttaaacaagtgataatgtaagtattgttagtgtttgatataaatctattatttcactggctgtttgcaagatagtctatctgttcttcgtttattttttccacttttggtgcttttaaaaaaattaaatggcatttgcaaactacctatctgagaagaattaataacctgagtatataaagacctcaaataactctataggaaaaaaatctaataatctgattaaaaatcagcatagatatttctcaaaagaagacatacaaatggcaaacaggcatatgaaaggtgctgaacatcactgatcatcagagaaatgcaaatagaaactacaatgagctatcacctgaccccagctaaaaaggcttaatgcaaataaaaactacaatgagctatcatctgaccccagttaatatggcttttatgcaaaaaacaggcgataataaatgctgatgaggatgtagagaaaagggaaggcttgtacactgttggtgggaatgtaaactagtgcaaccactatggaaaacagtttggagattcctcgaaaaactaaaaacagagctaccatatgatccagcaatcctactggtaagtaaacatacaaaagaaattaaatcagtacaagggagagttatctgctatctcatgtttgttgcagcactgttcacaataaccaaaatttggaagcaacctacatgcccatcaacagaggaatggataaagaaaatatggtacatatacacaatggagtactattcagccataaaaagactgagattctgtcctttgcaacaagatgaatggaactgaagataattatttaaagtgaaataagccaagcacataaagacaaacatcacatgttctcacttatttgtgggatctaaacatctaaacaattgaactcatggacatagtgagtagaaggatggttaccagaggctgggaagggtagtgccaggctaggggagaggtggagatgataaatgggtacaaaacaaaatagttataaagaataagatacactatttgatcatacaacaaggtaactatagccaatagtaacttgtatttgttttgttttgttttttttgagacagagtctcgctctgtcgcccaggctggagtgcagtggcgcgatctcggctcactgcaagctccacctgccaggttcactccattctcctgcctcagcctcccgagtagctgggactacaggcgcccaccaccacgcccagccaacgttttgtatttttggtagagacggggtttcaccgtgttagccaggatggtctcgatttcctggcctcatgatccgcctgcctcagcctcccaaagaattgtgtgttttaaaataactattaagaatgtaactggattgtttgtaacacaaaggataaatgcttgagcggatggataccccattttccctgatgtcattatttcatattacatgcctgtatcaaaaaatctcatgtaccccacaaatacatacacctactatgtgtccacaaaaaattgtaaaataaatagataaaaattttaaaatgaattgcctatattttacaatttcttattaattctactattggcttatatttatatccttttagtttttcagcattttccctagactaagcctctaccaaccactaaattgtactctgtacatataattttgtcatttcaagaatgttatataaaaattcttgaagtcatatgagtacatattagtacatattaatacatacagtgtactacttaagccatagtacattttagtatgtatactgcactatggcgcgtacactcatgtcatttcagtacaagtttactatatgtattagtatgtatcataaatagtacatagttaattactgaatctaccttcaaatattttagtttttcatgtgtcatatatagatcttaaaatagtataattccaattcctcttcccattctttgttgtatttagtcatatgctttacgcttccatagtctataaacctatatcatcattgctttttgatttaaaaagtcataataattttatatttacaattacgtatgacattttcagctttatttctttctagatttctttttctgtggttcctttaatatctcttgtgtgcagtgctgttggcatagactccttcaaggctttgactgtctgaaaagtctttatttattcctcttttttaaaaagacagtttccctgagcctagaaatctctgtttgtagatattattctattattgtctggctttcagagtttgaaatgaaaaatctgctttcattttttattctacatttcagtatataaaatatgttttttttttctggataccttcaagattttctctttgtctttcatcttcagcaatttcaatacgtctagaatttgtttgttttgttttgtttttaattattctggaattatattagcttcttgaatctgtaatttatggtcttattattttggaaacttctcaggtattatttcttcaaataattcatcttcctcttgctctctttcttcctactgtggaagtccaattattcatacgttagattatttgatattattttatgctttttccattctctcttcctttttaactctttaatcttcttctgtttctatttgtatagagtctattgatctttcttaaattcacacatacactatatatatattgcattttattagaattttatggattacaaatttggctttttagtaacttgtaaattattctatcatattaaaatattgacttttctattttaaaccaaaataattattattggataattttactttacataataattaatgggtgacatattcctgagagttatctatgaattacattttttgtatatgtaagtgtgtatatatatgaaatttcataaacgaagaatattatttcctttcagtaataatctcttctattaatactgttcataaattactttcttaacatattagttaaaaaaattaatcccaccatgtgacattttgttgaggggacaattactcttgtgccatagtctcattttcagtggttaaaggattgtatttagggttcacttaaaatgccttaatagaaagtcacctctaatcatatttcagcaacagtctctttactgcaacttattactatattttatgttctagtaactgcagagttaaatgatttatgaatatgaagtaagaattccactctaacctacaatcattggaacacatcttgagtgacatgctgtgttctctcagttgaaagccatcgacagtttaaatgtaatgcaatccagaatctgtatgcagggtgacaggaggctggaggccatcccctcccaaggaataattaatagagcagaaagtgtcaaagtcaagattcagcgtagatggggtagcactttctaaatatctgcaatatattttctgaggagaaaggagtagatactgtaatgtttaagagaactgaactagtatcgtagatatgaattccaaaagtactatttatctctattaaaaatactttttaaaaagattagagctgctcaaacattgaagagcctgccttcttaaagtagtgaatttccagtcactagtagagtaaaaatagagtctggataactacctaaccagaatttcagctcctatataatttctaagcttcctaactacctcctacctctaagaatcttggtagagaaagaatgctaaataataattgaatataaaacaatttaactaataagtccaagaaactatgttactatttagcagaatccagaggatgtgggcatttcttaaatgaagtatgagttaaattggaccttgaatatttggcaacatttgaatagggtaacaaggaatggcagaacagggtattttgtgtacagaatgtctcagttagggctgtttgttgcacgaagcagaaagaaactctggataacataagcaaaaggagaactgattggatgaatatggagtaatttagtaaatcaagtgagaaaaggtcagagataaggcagctgtgaagacattggtggcaaactcaaaggcgatctctttgggccattacatttaatgtgatcatttttgccattatttccctgtggtacccatcttgaaatttaaattccccccaaaattaagaaattaagaaacatgtttccaaataatgcatgggtcaaagaggatatcacaatgaaaatcagaaaatattctgaggaaaataaaaattaaaaatatgacatcaaaatccactagatacagctaataatgtgtctaaagggccatatttagaactatacaaagttgaacgttaattatctaacattttatctcatacagctattaaaagaacatcaaattaaactcaaggaaataaagggtttgaaaataaacaacacatattattgaaaagaaggcaaatataaaataaatttaattacaaagccaaaatttgttcttcaaaattagtattacattttaacaagaatgatcagaaaaaagaggcaaaaaacacaaattatcaatataatattagtaatagaaaagagaatatacctcaaatatgtaaacatcaaaatatacaatggagatattattaacaattttattctgataattttgaaagttgaggtaaagtacataaaataatttaaaataatctaataagagtaaaggagaaaaaatatgtaaccacttgtatagttgcagaaaaaacattgattaaaaattaatactcttcatgatgaaaattctcagtaaattagagattaaaaagagcttttcactttcacagtgaggttaaggacaagagaagcatatatactttcatcagttcaacttaccattttcttagatattccagtcaccatgacatgacaaagggaaaaatgacatgaatattgtattttgaaaacactcataaatgtacacatagaaaaattaaaatatatatttggcataagccatcataagataaaaattgagttttatgtaatcacaataaacaaatagaaaattaaacataaataccatttaagatattaccatgtaactattaataaatctagcgaagtatgttcaagacctttccactaaaaactataaaatagtgaaaataataaagatataaatttagaagggttgtgccatgataataatttgtaagactcaatgttaatatatgcagtcctcttaattggccaatagatttttttaaagttccagtcaacatatcagtattttatttttgtgggaattgaggtgctaattctaaattttgtatgaaaatataaaggacctagaatagccaaggtattcataaagaagaaatcaatgctggggaatttaagctattatataatcagataatattataaaattaaaataattaaattattataaacgttggagtaaggatagaaaaatggtccaattgaatataatttttaaaagtacagagatggaaccaatacacaaaatcacttgatttgtgacaaaagtactactataattctttggggaaatatagtcttttaataaatgatgctgagttacacagtacacataaaatttaattttatattgaccacagacataaatgtgaaagatagaacaataaatcttcaagaaccaaacatatagaattattatcttcatgaccttgatgtaggtaaggatttcttatgcagactacaaaatccctaaacataaaatgaggaaaaaagacaaaataaacttcaataaaactgagaacttctgttcaacaaaagacaacattaaaataatgaaaatgcaaccatgatttgggaaaagatagttgcaatgaatggttcagcaattgactcatatctagaacatataaagaattcctataagtcattagaaaatgattgataatgtaataaaaactgaagaaaatacgtgaataggtacatcacaaaagttgatatccaaatggctgaaaaattgtagaaaatttaacaacataagtagtcattagggaaatataaaataaaattccactgacatatcactacattcccactcataaggcaattaaaaagactaatgataccaaatattgatgatgaaatagaacagttttaattctcacttaatggtggtagacatacaatttaacttatgtgaaaaaccatttgacactgtctcttaacatagtattttatacatcatattctatgatccaacaatcacactaatgggaaaatactaatggaaatagttgcatttgctcattcaaagatatataccagcatgttcacagcagttttattcataattagcaaatccaaatgctcatctgcaagagaaaacataaaatgtggtatattcctacaatcagatactgcacagcagagcaaaaagactagtgctatattacatgaatgaacttcagacatattgttgtcaaaaatgatataagtatatatcttatgaacacatttatataaacttcaaaaatatacaaaaatatcctatgataatagaaatcagtatattggttatcttatgggtagtgactggaagagagcataaagcagtttctgtggtatagaaagtcctctttatctttagataggggatagttataggagtttatataggtgtaaaaaattataaatgtggacccaatacttgtgtaccacatgtaaataacacatcattacatgctgttttctgtgctttggaaatgtgtctaatgttactagtctctttataatattttttaaatttgacatacaaaaagctgtataatttaggtatacaacatgatgagtttagtgataaatatacacctgtgaaaccatcaccacaatctatgccacaaacctatgcatcacctccagaagttttctcccattctcttataaatattatttgtgataagaacacgtgacataagatctactcccttagcaaatgtttaagcatgaaatgcagtattgttgactttttttttttttaattacatggagtggagattgattgccctaggaggtttgtctcatggtcactgcttggcttgagcaggacaaatcgtcttgagtaagagtctaagaaaaccacaataaggaaagaaatttctcaaggagacttaaagacaagaaaatagtagggatattacacagacaaaacaatagatggccatcaaatatggtaatggcagatattaacaataactgacatttatatcttaagtaaccattaaaaatattctatctcatttaaaactaaccacaatcctatgagcaagtactatttttttttttcgtattttccatttaaggtcattaaaacacagagagattaagttttgtttaaggctacctagccgcttagaggcagatttgggacttgaatacagatgacttgtttggaggtctacattttgaacctctatgctatgctggatcacaattatacattacatgttcaagagtgttgaagaagacaagacagaaagcagcaaaagaaagcacggctgggggtaaggaacacctggaggcattaaactatttcattgttcctttcattccgcttactgaagggtttccaactctcgattttataagtcagaagcaaatttatgtctgcaaattcactaaatcctgagagattataaacatacacgcacatacattatggcttcatttttagtgatttatcacatataattggaagtttagagcctgtattctttctcaagttgagaatctccttttttaaaattcagaggcttcaatgtttgtgttaccaaaacactaattttgctattcgtgcaaagattagaatttctacatgaaagtggataagatacctgagaaaaaatctcatttcagctccctcatcataatattgaatagggtcacataattgaaaagttatgtaagcatagcaagtgttataaggtgatggcacaatgagataccaaagttatcatcctgcttgcaaatccaggccatttcacagtggaaaagatggcagttttgaaagggacaaagaagaagtcttgtgaaataaataactctgcaatggtaagtataccaatgccctcaggaaactgtatcaacagtcgtagttcaatctaaccaaaacaaatagtatagaacatggaaaggtaatgtcaaataagaggctttatcgaattggctttcgaaacagataaatgtgcagatgcaaagccgatgaaaagaaatgtttgttactactcattgaatggatcaatagcaagctgctaagtccaattttcttatggcaagtcctcactataattcatgacctgtgtttttttttaaaaaaataccatcagaagtctagatttgagtgaagttaagagttatacttacatattattaatacatttgctgctgaacactaactcaaaagaaattgtcattttcctcaaaggctcctaacttttatggcctttcaatattcttacatttgtttcatccggttctacttaacatagtctgactttttaaaagttggctaaaaccatagcagaaacttacgacctttagtaatctttacaacttagataaactttcatgtattcctttgtcgtcaaagagcttctcaaactcatttccatactgatgtcaataatctcattcatacccacccttctcttgggtaacttggagaacaaggtcaataaatatccacataaaaaaatctctcatagggaactacaatgggtgatagaaatgagatgaaaatagaacaaataatcatatgatttaaaaatatatcatttcaatggaatattgaaaaacatatctggtacaataaagaatgggaatttttgcaaaagtaatttgattcattttctattctcagttattattttatcatgtgatgtctttcccagggtaggaagcaataacagaacttactaagggaagagaatcttttatgtataggtaagatattcccctggtgtggaagaagctagaataatcaactgctttgatacattttaaccagctcttctgagattgttttcctttcctaaccttcaaagaaagttcccatgatgttacagacctacccagcagaagccttgggaaggaagacactgcttaaccctcaatcttgggaatcctggagaagaagagaacacacatcctgtaataaaatgaatttgtataaaacagacatcaataaaaaagaaaatgctatggaacaaagaaagcactagagttataaaacaaagtaagctgagcccacataaagaagaaagagcaacatatggagtaaacagacaataaaacgacttcccaaagtttcataaaaactccaagctagttagaagatattaacatgagagaaaaaagaagagtggtccctctttaatatccactatcatatgagtggccttttaggaattaagaaggaaggagacaaagtaagatagaaagaaggagagagggtaggagaaagagaagaaaagagtgggaggtgggggttgggagaaaataatcttgggtattataaaaatgaaagaaaaaccctctttctgggactgcagaaatgttctgacacatatatttagcacacattcagtaaatccataattggaatcttctatatgccagacactggctaaattatgaaatccaaaaataaaatattgctataattggtctcaaaagactatgatccagattctgagtccttgcattagaagaaagaaaaaaggcccagctctagacagatgtagtcttaaaaaaagaacttggcaattgcttgttaatgggtatttgtctaaaagctgaaccagataatcctcaagatatcttctttaagaggaagaaggattgaaagagagttgaacattgaaagttttaccaattgaatcttttagagagtttacaaattctcaatttagtattatacatatggtgtttgaagacggtcatatttaaataattcagtctcaacatctctgccttattcttcctgtttttattcacatttccagcctaaattggtgctttaattcagaagcaggcaaatttgagtaactataatatgatatatttattttaaattgcatgcagaataacatatattggtgtaggagggtaggggataaacacactctagaatgagagagacttaagattttatctaaattctgttcttcactcaatatggagcctttagtaagttgtttaattctgtacatattctgcatattccaattctttatctataatactggaataataaatctatgatgtccacagtaccagatatattaatgcccaaaccgtgttaccctcgtatctgtgaagaatagaccctcagaaatatggttaataaaatcaatatgtcaaagggatacctgctctcccatgtttattgcagcaatatttacaatagccaagatatagaatcaacccaagtgtctaacaacagatgaataaataaagaaaatgtggtgcatatatacaatggaatactattcagtcacataaagaatgaaaccctgccatttgcaacagcatagatgaacttggaggacatcatgtaggtgaaataagccagataccaaacgaaaaataccatataatctcattcatatgtgaattttttttaagagttggtttcatagaagcaatgactataacagtggttatcagagaccggggataggtagtggaaggtaagaagggggagaggttggccaaaatgtacaaagtgacaattaaaaggaataagctccagtattttattgcatagtagggtgacgatggttaatagtaatgtattgtatattacaaagtagatagaagagaggcttttgaatgttctcaccacaaagaaatgagaatgtataatgtatcaataataatacaataataataaattattttaacatcttttgcaaggcacatctattgatgacagagtctcccattttgtctacaaatgtttctcccttacttctaaaagatatattcactttaagaaatcttatagaattctaagtttctaagttgttttaattacctttttattttagtttgttgttgttttaactttcaaaactttaaatatttcactgtactctcttgttgcttgtataagttctgaagagaaggccaatggaatacttatctttgttcctatataaaaaggtggcacctgccatatctcattctgttttctttcaagatttcctcgttataatttttctgcaagttgaatatgatgtacctagggatgtattcattgttatttatcccactttgtgttctatgagcttcctggatctgtggtttgatgtctgtcattgattttagaaaaaattcagttattatttcaacgaattcttctgttccttctttcttcttcttttggaattctcattgcagaaatattacacctgttgtgatttttagagttcttggatattctgttctatctctcttattctcatttgtctttgcatttcagttttcaaagttgctattaccctatctgtaagctcactagttctttcctcagtcaaggtcatgtatagtctattaatgtgtccatcaaaggtgttttcaatgtctggttacaatgctctttaaatctttagaatttccttttgattctttcttagagttcctacctctctgcttatatcaatcatctgttcttatgtttgtctactttattcattagagtccttagcatattaatcatagttattttaaattccctatttatattttccaaatctctgccataatggagcccagttctgatgcttgttttgcctattcaaactatgtttttgatatcttagtatgccatgtgattattggttgaaagctgaacatgacgtactaggttaaaggaactgagataaacaagtcttcaatgtgaggtctttttttatcttttttattttattttaaattaagttctaggatacctatctatacaggatgtgcagttttgttacataggtaaacatgtgccatggtggttttctgcacctatcaacccatcacctattaagcctctcatgcattagctatttctcctaatgctctccctccctataccccacctacaggccccagtgtgtgttgttcctctccctgcatccatgtgttctcattgttcagctctcataagtgaggacatgtagaggtcttatgtttatctggctaagagtttactgtgtttactgttagctatagctataggtttcaaagacaaaatttttctctagtgttcttgtttttgtctcccttggtttttgtttgtttggttggttggttttgttttgtgtttctagtgacttcttaaatactctctgggttgtgcagttctttgagttgtaatcctttcgtataaaagccatactgatacagtggtaagatgtgggaggaagagaagcattgtatagttacatgattatgtctcaatcatttactgaacccttgcctctgggttgtaaccttcacaactgttttgctgttctcttcccactgcccctaccttcaaagtaagacattaagactggtggggactggagttaacgatttccagtcgcccatgtgggaggttggagggagctagagttgggtattttctacatctatgtagaagatcggagaagttcaagttgggcacttcttttcccacaggtcaatgaggctctggtaaaacccgaggtggtcaggctccagggaaatagtttatcttgagggcatgcatgtgttaaggagaacaaaatacactggctatatttcaaaatgattactttttccctcctgctgcctgaaggaggagtcgatttttctctgatgtttactctgacaactgggtgggactcctagaggtaaaattcaggaaagcaccggggccattttaagaccagccacaaatggaatttttaaatttcaagcttgtctatactgagcccccagggtttcatcaattagagctgaatttttctatcccagtactgactccagtggggggtttctggtcctaggcttttgctctagtaagctgtgattctctgtatctgcctgttttttccaattttggaggcagtgttttgtcctgtgacctcaattttctgacagatgtattataagaacagttcttgattttccatttgttcatcttttctgctttttggttgtaaccacaggactgacaacttccaggcttcctacatgccacactggaaaccagaaatctctcttaattttttacaccttccaataatcacaaagtcttctccttcccatttgccttcattttccttttccccaagtgattatttgttcctcagggttaaccatgattgatcattttgatgtatcttcctcttcagagttgcagacactttcctccccagctgctgtaactcatggaaacaagttcctgttctaatgagaggatcatgaccacttccatttttacccaaggtagctgtgtggtcattgcttccttgtcttattagtgcctgaatgttccagatcagatcctgtactggaaagaaatttagaagtccaatgacctggaagggcaacctcatttcccaaataggaaagcagtgcttaatatgttgctgttatttttatccacttcactctttgtagacacatgattttaacctatggttgttaaaagcatagcaggtctttctgggtcatggaaattcacttaaatgtgcaaatgaactttattttatttttgattatcaactctacctatccctcactctatagtataaaggcgagtatcccattaagcttaagagtatatgaaaatgtctgttagtagaagaatttaatcatagtgaacacgaatgaacatattttctgttatgatacagtcatctttattggctaaatctctttctggaatgtattattataccctactttctttggaccatttagaattggcgggggagtgcagagaagtttggtcatgtctaaggtaattgaatgactgtataatttatttccaagcagagagagaaaaaaaacaatcttgatcagtctggatggtggagcaggtggaataagtggggagtattctgggtgaactagggcttttgttgactctatttcttacttcacccccaaggaaatggaactgatttcaaattcttagagctttcttgggcaaggcagaagctcttcctgcctcagctagttacttatttgcaactcaaggagacaattgtttgctaaaaaagagaagtcagtcagatcaatatgagagcaaaattgacactgggaatctgtgtcctatttaaacaggaaaataaatacatccactgcagatgctgcaagtcatggcaaaccttcatagaaaacgaaatatctgtgcaattcccttctattctgaataagttacaagaagagattaacaagatctattacaacacaaagtcagcaatactatctctctcactcccaacatcacctgtggatgggaacattattcagttttctttcccaaccagccatgttaatatacttcaaaatgtgttggttactaaaaaaatgacttaagactatacccttatttttaaatctacacgaggggtccccaacttccgggccacacagtctatggcctgttaggaaccaggccacacagcaggaggtaagtggcaagtgagcatgagtgagtgaagctgagttccacctcctgtcagattcacggtggcatcagattctcataggagcccgaaccctattgtgaaccacgcacgtgagggttctaggttgtgcgcttcttatgagaatctaatgataaatgtaatgcgcttgaatcatccccagacatccccagctcctctcatcccatccatggaaaaattgtcttccatgaaactggtccctggtgccaagaaggttgaggaccgctgatctatatatagtccgaaaaataatagatttttctggcagtctacatatatgtgacaaaaattatgttagatgtgtaacgctaaagtccaataagcccgtatacctaaaaatcatgtttgctttttgagggaaaatagccttcttttaatcatagtctctatattctcagagcccagcaagatgcctggcacagagtaggttaacccatgtatatattattatgggtattgatgaatgaagtgatgacagggaggcattaacaaaattagcatggcttgagctttgtgaactgtatactggcattttttgttttgcaggaatatcacgtaggaaggtatttccattttagtcctaataccacctaaattcttttttaagtgactgaaaaaaattagccacaatatttctacattatatcttagcataaggattcatctatatagacccaccattctgggatccagatgggtgggcaaattcatttcatggtgaccactgaacagctgtcagtaataatttctaatgaccgcatttgattttcctagactgtttcccaactctgtcattttgcgcccatctgtgggaatggcaaagagcccacaagcaaggtggcaggttatcagctgtctggaacaggtagggggagaaggattagttaagcagagatgagagaactctgctgatagcttctaggctgagtcatagcacagtagcagtttggccgctttgcaaccctctcagtagcatttgtggttattaagaatcagggactaaaacaaaaatgcaaaagaaaaaccaaaaacaaaccaacttattaagaatagcataggccatgtgcagtggctcaggctggtaatcctaacactttggaaggctaaggcaggaggatggcttgagcccaggggtttgagattagcctgagcaacaaagtgagaccctggttctacaaaaaaaatttttttttaaatcatccaggcatagtgatgcacaccagtagttccagctgtgtgggaggctgaggcaggaggtttgcttgagcctgggagggaaggttgtagcgaggtatgagtgtgtcattatactgcagcctgggaaacagactgataccgtttctcaaaacaaaaactaaaacaaaagaaaacaatcaaaaaaaaaacaacgacaacaacaacaacaacaaaaacaaagtagcataatgtggtttgagttgagggcagaaactaagaatccttggcaaataacttctgattttatggataaagaaactgagacctagtgagaggaaagaatttttccatttctttcacaatattataaatctaactgatcaaggcacatgaaatacgtatctttttttagaaaacttgctctattaaggcaaggatttttgtcagcttttctcagttagatatttctatatataataaatatttgccaaacataccttaaagatctgtgcaggcttatatagtggttaagaagtcaaattctgagatataaatctgaatagcttacgtgaccttgagcaactgaacctctctaagtctgaaatggaagtccaaatagaatatgcatgcagaatatcttacacatcctggcacacaggaagtactctataaatattctccatgaacaatgggcattattatcatcatatactttctcacagatacagattatgactaaaatgaattttcatttgtctctaacacagactttaatagtgagccaaaaccatatgatggattacagatttcatgtttagaaataaatttgtctagattcacactatttattgaagcagaagagttctttggtaataaataccaatattgtcagagatcttcctcctatgagactttacaatgttaattgctgaagaaggacactgggttccatttaaaaaataaatttcctaatgttattatatagctacctattttagtaacacaaagtgattaaggagtgtacaagacaaatgattcaaattaatcctgagttctgtctagaatatccccatgagccaaaaaaagtaaaatatccaggtatctaactacagaataatggttaatagagattaaattttaaaatacacagacaaaaatagcagatggaaaagaaaatatgatgcttatatactgacaaatacaaaaagcacagaaagttgagggggagcctcttcatccattaaaaacagaaagcatttttctggagaaagaatccattaaaaacagaaagcacttttctggaggccagatttgggaggaaatgcatgggggagatggagagaagaggtataaagtactatagaaagcaaagatctgggacggaaagttacagagaatgatcccaaattgctactgttaacatattcggtatctctgtcttcagtacttggatcactgtgtaatcactaccttaaggcatgggctcagagtccctctgttttccacccaccacataacttggggcttgctacctctaggactagcaaagagcttttgctaggaaaagcttaccaggcaatggttatgtgaataacctgggagtcagatgaacctgagtttgtgtcctgactatcactttctaactatgtgtccttaggtaagctcctcaactcctttcttgtaaatagtaataataataatagtatacctactctcatagaagtattgtaaaagacaactcagggccgggtgtggtggctcacgcctgtaatcccagcactttgggaggacgaggcaggcagatcatgaggtcaggaatttgagaccagcctgaccaacatggtgaaaccacatctctactaaaaatataaaaattagccgggcatggtggtgtgtgcctgtaatcccaactactcaggagtctgaggtaggagaattgcttgaacccaggaggcggaggttgcagtgagtggatatcttgtcattgcactccagcctgggtgacagagtgagactccatctcaaaaaaaaaaaaaaaaaaccgacaactcagacgaggcaagaacaacttgacacagtactggcacatagtaagtgtacacttacttaaatcttgtaattactgaggaaacatccttgatgttagttcaaaagaagatgacatgtataattcaaggatattgtcttccacagcactctgctatttctgccactcttgaacatttagccctaaagggggcaacacagtgtagaaggaatactaacaatatgaccttggcaagtcacttaacttctctaagctgtcctgtcttttttgatttatcttgcctccaaagattgtagtgagatcacaatatgaagatgcagcagaccactataagaccacaattgaaaacctataaagtgatgggtgttataatcagtccaggaatacacattaacaaagtgaacacatgtctgcattccagaaattccatatgtcaaaggcatttacaacgtaatattaatttagaaatgttagcactgggctaggcacagtggagactaataagctcatgacctaaaatgaattactaatactcagcacatggggcaagatgactgactagatgcagccaggaggaacacctgctacctgaggactaggaaatcaggaagactggcctgctctgagcagatcttcagagggaagtcattgacagtggagagagggaagacacagatgctgggctgatgggagaggaagctgggaagcctgaatggggctactgcacaccaggactcattcgtggcccccagtgtttctttgctcccataggatattttgaccccaggggaactgttggacctgaactctgcagggtgatcttgcccatgagactgtgccagtctgatctaagtacccctcagtctgctggcctctcctggggccccagcttggccacggctgcttacagtgcagccctgggagcccagggcaggtatatcctgggagcctcaattatagcttctgtgctacacagagctccagcagagtggccactgcagacatgcaccagtctgcccataccctctccccactgcatcctcccccatgctgctttgcctacacacactttcccatggccaaccccacattgctggcttgtgtgtacatgggcggactttgcctccccttctctgccagcacatgtgttcatatgggccctgctgtgccactgctggcagcataagttcacctgtccttgctccctgcaactaccacaccaccatggctatttgagtgttggcaagcacagagcctgccagctctgcagccaccagcaccctgtacccatgccaacatggccaccagtgcaaaacaagccacagagaataatggacctgttgctgtggccaccagtacccatgtgaatgcacacagaaggtgcacacagtactgtgcccaccagctaaccccatgctaacaccaccacaagtgtgaatgcacaaacatatggtggcaggggcccccacccctcatgccctactgccaccatttctgctgtaaatacccacatgcgggccagtactctggcacccactaacaccccacagcagccaaaaagtgtacagcctgctgcactgtcactgctgctgctgctggaatgtgtgaacaagaatggatcctgctgccactgccctatgaaatgttttggctggcaccacagtgctttggctggcatcacccaatagaatgttgtgaccagtggtctgagagcagtttgctccctccaatgctgcaggttcctggacttgaggagccagagaacaaagccacagcccaataccagtccccctacagttacagcatggagtctggaagtcctgagctgaaacttggcctaataaaatcttccagaaatgaagtcagttgactgaacccacctgatactacaatcaaactcctaagggcatcaaatagagaaaaagacaattaaaaggaaaacatcatccaaaggacagaaacttcaaagactgaaggaacactggccccaaaagatgagaaaggaccagagcaggaactctgacaaacaaaaaagccaaagtgccctctttcttccaaaccactgcgctagttctccagcaagggtttgtaactgggctgagatggctgaaatgacagaaatagaataaaaaatatggatgggaatgaagatcactgaggtttaggagaacactgaaacccaatccaagggagctaagaataacaataaaataatacaggagctgacagacaaaatactcagtatagaaaggagtataatcaacctgatagagctgaaaaacacactacaggaacttcatcatgcaattgcaagtattaacagcagaataaaccaagtggtggaagaaagagtctcagagccagaagattgactttctaaagtaaaacagccagacaagaataaagaaaaaagaatgaataggaacaactaaacctccaagaaatgtgggattatatgaagacaccaaatctatgatgcattgtcgtccctgaaagagatggggagaatggaagcaacttggaaaacatttcagtatatcatctgtgagaacttccacaatctagctagaaagaccaacactcagattaaggaaatgcagaacacccctgcaagatacttcacaagatcacccaaaagacacctaattatcagattctccaaggttaaaatcaaagaaaaagtgttaaaggcagccagagaggaagaacagatccccttcaagggaagcccactagactaacagtgaaactctgagcaaaaaccttacaaaccagaagggattggggacctatatccaatattcttaaagaaaagaaattccaaccaaaatttcttatctggcaaaactgagtatcataagtgaaggacaaataagatccttttcagacaagtaaatgctaagggaattcattaccaccagatctgccttacaagagttcctgaaagaaggaaaatggaaagaaaagaccgttaccagccactatgaaaacagacttaagtacacagaccatgacactataaaacaataacacagtcaggtttgcataataaacagctaacatgatcacagatcaaatccacacatatctatactaacctggaatgtaaatgggctaaatgaccaaattaaaaggcatagagtagcaagctatataaagaagcaagacccaatggtatgttgtcttcaagatacccatctcataagaaatgacatccataggctcaaaataaggggatgaacaaaattctaccaagcaagtaaaaaaacagaaaaaagcaggagttgcagtcttagcttcagacaaaacagactttaaaccgggaaagatcaaaaaagacaaagagtgttacttcatggaaaaagattcaattccacaagaaaatctgtcttaaatacatatgcaaccaacacagtagcacccaggttcataagtcaagttcttagagaccttcaaagagacttagactaccacacaacaatagtgggagactttaacaccccattgacattattagacaggttatcaaggcagaaaattaacaatgatcaggacttgaactcaaaatttggagcaaatggacctaataaacatctgcagaacactcccatcaaaaataacagaaaatgcatccctctcatccacacacggcacgtactctaaaatcaatgacactatcagcaaatgcaaaagaacccaaattataccaactgctctctaaaaccacagtacaacaaaaatagagatgaagactacaaacatttctcaaaccatacaattacatggaaattaaacaagctcgcccataatgacttttgggtaaataatgaaatagaggcaaaaaccaagaaacagtttaaaactaatgagaacaaagatataacatgccagaatctctgggacacagctaaggcagtgttaagaggaaactttatagcactaaatgtccacatcaaaaagttagaaagatctcaagttagcaaataacatcacaataaaaataagtagagaagcaagagaaaagcaacctaaaaccagcagaagacaagaaataaccaaaatcagagtggaactgaaggaaattgagacacaaacaaacactcaaaagatcaacaaatccaagagtttgttttttgaaagaataaatgagatagatatacccctagtagactaataaaaaaaaatagagaagatccaaataaatgcaatcagaaatgacaaaggggattttagtactgaccccagagaaatacaaagaaccagagactactatgaatacctctatgcacacagactggaaaatttagaagaaatggataaattcctggatgtatgcaccctctcaattctgaatcaggaagaaattgaatccctgaacaggccaatgatgggcttcaaaattgaactagtaataaatatcccatcaatcaaaaaaaaaaaagcctgggaccagatggattcacagcaaaattctactaagtgcatgaagaagagctggtaccgtttctactgaaactcttttccaaaaaagaggaggagggaaatcgcatcacctcattctatgaggccagcattgctcttataccaaaacgtggcagaaacacaacaaaaacagaaaatatcaggccaatgttattgatgaacattgatacaaaactcctcagcaaaatagtagcaaaccaaatccagcagcacatcaaaagcctaaactaccataatcaagtaggctttatgactgggatgcaaggatggcttaacatacacaaatcaataaatgtgatttatcaagtaaacagagctaaagacaaaagtccacatgattatttccacagaagcagaaaaggcttttgataaaattcaatatcccttcatggtgaaaattctcaaaaaatgagatattgaaggaacataccaaaaaataataagacccatccatgacaaacctatagccagcatcatactgaatgagcaaaggctagaagcattccccttgaaaaccagcacgagacaaggatgccctctctcaccactcctgttcatcacagtattggaagtcctggccagagcaatcaggcaattgaaagaaataaagggcatccaaataaaaaagggggagtcatattatctctgttttcaggtgacatgatttcatatctagagaactttacagtttcagctcaaaagctccttaagtgataaacagttatagaaaaatttggggatacaaaattaatatataaaaatcagcagcattcctataaaccgacagcagccgagccaatagcaaatcaggaacacgattctattcacaattgccataaaaagaatgaattacctaggaatacagctaaccagggaggtaaaagatctctataaagagaattacaaaacactgctcaaagtaactagaggtgacataaatgaaaaaacaatttatgctcagagaagacaaaataaatattgctaaatggctatacttcccagtgcaatttatagattcaatgctattcctatcaaactacaaataacattcctcacagaacaagtgaaaactattttaaaattcatatggaaccaaatgaggctgagtagcaaaggcaatccaaagcaaaaagatcaaagctagaggcatcacattaccgggcttcaaactatactacgaggctacagtaaccaaaacaacatggtacaaaaacagaaacataggtcaatggcacagaatagagagcaactccgaaatatggctatacacctacaaccatctgatctttgacaaagctgaccaaaataatcaatagagaaaggattccctattcaacaaataacaacggaataactggctaaccgtatgcaaaagattaaaactggaccccttccttaaaccataaacagaaataaactcaagatggattaaagatttgagtgtaaaaccccaaactataaaaaccttggaagttatcctaggcaacagcattctgaacataggaacaggcaaaggttttattacaaaggcactaggagcaattacattaaagcaaaaattgacaaatgggatctaattaaactaaagaccttctgcaaagcaaatgaaactgtcaacagagtaaacatacaacccacagaatgggagaaaatatttgcaaactatgcatctgacaaaggcctaatatccagaatctataaggaactttaacaagttaaaagcaaaaatggaacaatcctattaaaaagtgggcaaaggacatgaacagacacttttcaaaagaagacatacatatggccaacaagtatggcaagaaatgctaaatatcactgatcattaaagaaatacaaatcaaaaccaccagtcagaatggctattattaaaaagtcaaataataacaggtgctggtgaggctctggagaaaagagaacacttatacagtgttggtgggagtataaattagttcaaccattgtggaaagcagtgtagttatttctcaaagtgctaaacacaaaactaccatttgacccaacaattccattactgggtatatacccagagtaatataaatcattctaccataaagacataggcatgcacacggtcactgcagcactgttcacaataaagacatggaatcaacctgaattcccattaatggtaaattggatgaataaaatatggtagatatacaccatgggattctatgaagccataaagaaagagtaaaatcatggcctttgcagaaacatggatagagctggaggccactatccttagcaaactaacacacaaacagtaagccaaatgctgcatgctctcactttaagtgggagctaaatgatgagaacacatgaacacaaacaggggaacaacagatgttggggcctacttgagggtagaggatgggaggagggagagtataaaaaaataactaatggatattaggtttagtacctgggtgacaaaataatctgtacaacaaaagcttgtgacatgagtttgcctacataacaaacctatacatgtactcctgaacctaaaataagatttttttaaaaaaagaaaattactaatactaaaaaactacatgatgaatatcaagaatttggtaagaattctgagtgcataaataaatacatagaaaacctttcaagatgtcccggcccaagctccagccactgcctagctgcaactgcatgacaaactctgagcccactcaacccccagatttgtgagcacagttattgactgttattgttttaagatgttttctgggtagcatgttactaagcaataagtaaatgactcagttacaaagcagtaagagttgtacttgacttaagaaaagttctcaataaatgctctgtattgttaaaaaaaaaaaaagaattctgattgttgaatgagttcagaaggagaaatcttatatacaatcactgaaaacctttataatcttatacaaaccagagaattgacactttaaggggagtcagacctacaggcagaaacttgatccagcttagttctcaaacccatgatcacaattcatagattttattggtagtcaatgtttctggtacaagtgaatcactaatgacatttgttggtttattggttgaaaagtacttgctgtagataaactatccaccaggccatgtgctcttcttcacctcagaaccatgccttagtttatcactagctgcctccttctctttctttatatcctagcttcaatggcagtctttcctcatcactttctctaattaaaccacctattctaatccactcccctcaaaacacatacatgttctattttctctcctaacactgtgatctttcctgttatgttttccttaaaagtgataatttctgaagagcagttaacttggttaaaattccagactctgcctctcctaaaatggtaagtaactgaagttttctctcacttctgtgagcttccagcttttgcttttgtatcagattctctgaaatcttgtggcgtgtacagtttagtggtcaaaaagtttgtgtttttttttttttggaagaatttatatgcacactttagggctcacttcttctatgggtcctttacttctagaagttttcctctaactttctgctatactatgagcctccaaatcatccttggacatcctgtaaaactaattcggctgctttgcatagaaaagtcacttttgaatctgtgcatgctcatgagatagagcttcaaacttgcaaatctgttctttgtagtttgtctttcaaaggttaatttccctccagtttatgcccatttttgcttgttcttcagaaattccacctttttttcttgagatttgtaatggtatctaaaggaagtttagtctctccaaaccatgccaccaatagtggaatccaaatttctatgaaatatctatgtaagaatggagaaaaatttattttcttttctttattttaatgcatctagcaaagtctatgacgtatataagtaatcaatggaggacagaaacaggttccctaaagcctgaagggaaaatgaaaagcaacacatcgggaaagatggagcatggtggggggaatggaggcaggagtttgggcacacacaatagttaaatagctttcattcccaatttttatgaaggccagtcctgaatgtagcactgatccccagtgacctggagaaatcttgatagtcttacactgtatgtctgaagaaacattttctgattaaaacatgtcttagcttgaatcccacactttaagaaaaaaccttctcctttcttagttttaatttgttgtcaatattaatgatttgctgtaggagcccctggaagttttcttaagaggaaatttttatttgtggatagtgataggaaaatgcatttcagttgctacaacagaaaaaaataaaaggatgttagaaaacaacttttccatgaaaagatggaagacaagaacttactttgcagaagtggatcagagtgtttttttgctaattgtcaatggctaaatgtaggtaaatgggcatggattattttatattactggttcagtgtaattcataacaggcatatataatctcttctaaggaatgtctatgttatctagatgattctaattcatctttcattatttgaacccattagataatacatttataatagaagttaacaatttaaactatggagtcagagaggctagggtcaaagtagcaaatatattatactacctactaactgtgtgaccttgaataagttcacacaaccattctctaacttctaacttttgtaaaatttacctgaaagtgtgaataatgttagtatgtatcttaccagataatagaaaacagttattgatacatttgttcaatgaagcttaggttattcttatttgcatttagttatagaatttgggggaaaacagagatgtgaggtaactcatccagtgaacttagattacaacagctgaatttttccctaaagtatggattttgttcaccttgcttttattcaaaattctaaaatgtatatcatctcatattttattttgtaagcagactatcattaaaggtttttcatggacaacattatgtcttttagttgttataattttaaaataatttgaacatttacattattaagccagagaacaccctcagttaagaaaattgaagtgtgtggtttctattctgtgcaatcaacaacacaaaaataaatatgttggaaacacacacacacacacaaaaagaaaattgaagtcagagaaaaatcatgagcaaaagaatgtcaaacacggtatctgacactataactggtgtgctacaacttttgaaaatgtttcataactctgaagtcttaactgtaacacagattaagaaaactccagcatttcactcgtctacacagtaagaaaaacataaaactaatgcacaaagaaaacagtcaaacatttcccctttaaagatatctagatacaacatatggagagaaagaaagtaagtctagctggcgtatttgacaaaactgttgaaacaattaaagaagaaacacaaaattcagatcactaatttatttaaagaactttaattcaaattttaaacattcaatttaaacatcaaatggtataaaataaatttaaagacaaaaataatatattatatataatacttccatacagggctaaacacttttaactccttgaagacactgtcaaacatttctctattcctaaatgtctgaatagaaatacacgttcattttccttaacaaaagaagattgctttacatgattttctgtgactagcttttattttcaagcaaaaatgttttgttgacatgtcttggagtcaatgactagagtttccattatgatttttaatggctagatactactatttattttgtgttctaattgtatcagttaataaccatgtataacaacatacctgaaaactcaacagtttatgacaataataatttattgttgctcatgatggtaattgtaacagtgttttattgagggattgctctcagtcgaagggaagttaaggaagcatgataaagctcgggaagaaagttaacttatgatgtggtattagtttgagacaagcttcagctctaaagcaaaaattgcacccctgcgttggtctcaccttaaggccatattgtacacccttcccatcaatcattggccataacctgactttgggatcttgtttagccaagtgcgattccccaacaaagggtggaggtaaaagctgttggcagccaatattcatggcagcctggtgaagggaatcttggtgagtttccacagtacctattacagtgctatgaaaagactctgccttgtaagtaagggaaactgaagagtcagaaagcaaaggtgtgaatacaagatgagatttttaaaaaagtaccatctatgcaatcaacctatcatgctaatttattaaatggaaatgctgtgattgatctttaataccctcttcagctccaaagtattaaataaacacatggaaacatgccaaagcagtcataagtaaaaaaataaagccagtcataattggcattataatgcatttttgtattttggttaaaaacacattaaaatgtactatattaaccatttttaagactacagttaagtagtactaagtgcatttacattgttgtgaaacatacctccagaaccttttcatttgcaaatctgaaacttcatactctaaacaaaaactcccttttttcttccctcccaagagcctctagtaattaccattctactttgtgtttctatgaatttgactactttagatacctcataaaagtggaattatacagtattttctttcagtgattggctaatttcacttgacacaatgtcctcaaagtttatacttgtttcaacattaatcagaattcctttccattttgaggtatataatattctcttgtatgaatatactatatttggtttatcctttcatctgtggaaggtcatttcagtgacttctacctctggctattccaaataacgcttctataaatatacgtgtgtaactatctgtttgagattctgcttttaattattttagatatagatccagaattgggactgcaggatcatatgaaagttctcttgttaatttttgcggaacctgcataatgttttccatagcaggcccaccattttataatttcaccaacataatacaagggctttatattttccacatttttgccatcctccactggttttctaatttttattttattgtagtgatcctaatgggtgtgagatgatagctcttggtggttttaatgtgcacttctgatagtgatgttgagcatctttcatacacttgtttatcgtatttggaggaatttctactcaagttcctttgctcattttaaacaagtataaactttgaggacattgcatcaaatgaaattagccaatcactaaaagaaaattctttgtaattccacttttatgaggtaactaaagtagttatttgattttctgttgttgaggtaggtgttctttatatacataattattaatccattattagatatgatttgcatatattttctattccatatgttgccttttttactgttaattgtgtcctttgatgcataaaagttatgtttgatgtagtcacgtttatcaatttttgcagttgttgcccgtgcgtgtggagtcttatccaaaacatcatgtccacgttcaatatcataaagagtttcccctacattttcttctaggagttttatagtttaaggtctcatgtttagtttttaaattcattttaggttaatttttgtgtttggtgtaaggtatcttatttttccttacatgtggatagccatttttcccaacactatctgtggaagagactatcctctctatcatttcttgagtttttgtggcacacttattgaaaataatttgaccatatatgcaaggatttagttctgggaactctattcacttcaaggagtttattcatttcttctagattttctcatttgcatgcagttgttcatggtattctctgaggcacttttatatttctgtgggatcagttttaatgtcatttttgtaatttctgattgtacttatttggatcttctcttttttggtagtttaactagcagtctatcactcttatttgttttttcaaaaacaactcttggtttcattgatcttttgtgtgtatttttgcatttcagtttcattaacttcttttctaacattagttttattttttttccttctactagctttgtggttgttgttgttttttccctagcccctttttgtgcaaagttagattgttaatttgagatctttctaacttcttgatgaaagcatttagggctataaaattttctcttaccactgctttggtgtttcccagagattttggtaagttgtgtccctatttttattaattccaagtaacttttttatttcttccttaatttcagtgttcacccaggcattattcagggtctagttgtttaatttccatgtatttgtgtagttttaatagatcttgatattgatttctatttttattacactgtggcctgagagtgtgcttggtgtgatttaaatttctttaaatttattgaggcttgctttatgactggtatgtggtcgatcttacagcatgaagcatgtgcagaaagaatgtctattctgtgtttgttgggtggagtgttctgtagaggtctatgaggtccaattagtcaagtgtctagtttaagttcagagtttctttgttagttttctgccttgatgatctgtccaactctgtcagtggggtgttgattctcctactattattgtggggttctctaagtctttctgtaggctcagaagaaattgtttttttaagtcttggtgcttccatattggttatgtatatatttaggatagttaaggcttcttgttgaattttaatctttattattatgtaatgcccttcattatccttcttaatttttattggtttaaaatttgttttatctgatacaagaatagtgactcctgctcatttttgttttccatttgcatgataaatttttctccactcatttactttaaacctatggatcattacatgcgagatgagtctcttgaagtcaacagatgcttaggtcttgtctttttgtacaggctgccactcttcatcttttaagtggtcatttagcccccttacattccaggttagtattggtatgtataattttgatcatgtcaatgtgttgttagctggttgttatgtatacttcattgtgtagttgctttacagtgtctgtgggctgtgtgcttaagtgtgtttttgtggtaacatatgtggtaacaccattcttttggttcaatctttagtgctcccttaaggacctcttgcaaagctagtctaattccctcagcatttacttgtctgaagaggattttatttcttcttcacttaccaagcttaatttggtgggatataaaattcttggttggaatttctttaagaacagtgaaaactgaaaattggtccccagttttgtctggcttgtaaggtttctcctaagatatctgctgctagagtgatggggttccctctgtaagtgacctgccccttctctctagctgtctttaagattttttcttttgcattggccttggtgaatctgatgattgtgtgcctgggaaatggttgtcttgtagcatctagctggggttctctatatttcttagatttatatatcaacctttctagaaagattcgggaaatttttgtggattatatactcaaacataatttctacatcgcttattttctctcctctctgaggaatgccagtgagtcatagatttggtctctttacataattccatatttctagaggttttgttaatttttcttaattatttttctttacttttgtctgatgcttaagagcaatggctagtagttaggttaatacctggctgcattgcttttatatacttccttggggtttgcaggcatgctcttcattgcagggggacggagatggtctcctttccagttccactcctgggtcttggggaaaccccctctgattgctggtgctgcacccacatttctttttcttaggtgcagtggctgcggcaggagatgtgtcacactttttctgggccaaccctgtggaggaagacacatcccattcccactccagcccagtaacatatgtgtttcatccctctcagtgctttgagggtgggggcttctttctctcttgagtgacaaccacagatctcagctctgcactcctgaactgcatgctgcagccctagggacactgggatatcttgcagcttggattgaggttccagctgcactcggggaacagatgtgctcctgggtcaccagaaaagtactcaggtacagcaacacacacaggttgggctgtgggggttgtgctgtgcactgcttctgcatggcagctaggcatggaccatgggaatgtccagtgggcaggggggcttggagagcagatctgtcccaatcccatggggaagctggcccctccaccagagctgcccagtatacaaaagctcctgagcttcatgccatccaaaggcctgtttctgcctgctccctgagatccccctgcacatggaggatgcagggtcccctgtagctaggaaccccgaggtctgcagtgagagtgagttatctctcagcttcctccctcacccctttcttagaagctatttggggctgggaaatagccctggccttcagacaccttgagcagggttcccagcttccttcctctgcagtcttgactttagtcttcaacattgcctctccatccactctgagcattttctcttcaaagatctgtccaaaccatagcaatttaccaataatttggactctctccatgggagctgtgcttcctgactgcatctagtcagcagccttgtcccttctttggcttttctctaatctttattagttccttctttctgttagcttggagtttagtttgttctatttttttattttctgaggtataatgttaggttatttgagatatttcttctttttaatgtacatatttacagctataaacttccttcttagcactgctttctctgcaccccataagatttggtatgttgtgtttttatttttatttgcctcaagatgttttctaattccccttgtgacttcttctttggttgttttgataaaatgtttagttttcatatacgtgtgagttttttcattttccttgtgctattgatttctaatttcattctattatgattaaaaaatatactttgtatgatttcagtcttcttaaatttgctaagacttgctttgtggtctatcctggagaatgttgcatgagcacttgagaagaattcataatctgctggtgagtgatgtgtggtggtgttccgtatagggatcggttaggtccaattgtctatggtgttgttctagtcctctatttccttattgattttctgtctagtcattctattcagtttgaaaaggggtagagaagtctcctattatgattgttttgctatttcttcttttgattctgttgaaatttgcctcttatatttagcagcccttaggttttgtgcatatatatttataattgttagcgtttctgggtaaattgaacattttattattatatagtattcttctttgtctcttggaatggtttttgatttaaagtctcttttcttatgcataaatatagtcacttctgcatactttcacttattattttcatgtactatcttttcccatcctctcactttcagcctatgagtgctcttagatctaaggtgagcttcttgtaaacagtgtatagttggatcctgttttgttctgctttattttcattcagctaatcttttactggggagtttaatccatttacatttaaagtaattactgataaggactgatatggtttggctgtgtccctgtcaaaatctcatcttgaactgcagttcccataattcctatgtgtagtggtagggacctggcaggaggcaattgaatcatagaggcaggtctttcccatgctgttctcttgatagtgaataagtctcacaacatctcatggttttataaaggggagttcacctgtacacgatctgttacctgctgccatgtaagatgtgactttgctcctccttcagccttctgccatgattgtgaggcctccccagccatgtggaactgtgagacccttaagcttctttccttgataaattttccagtctcaggtatgtctttttttgccacatgagaacagactaatacagtaaactgttaactggtagtggggtgctgctgtagagatacccaaaaatgtggaaatgactttggaactaggtaacaggcagaggttggaacagtttggagggctcagaagacagaaagatgtgggaaagtttggaactttccagagacttgttgaatggctttgaccaaaatgctgataattatatggacaataaagtccaggctgaggagaggaggaactttttagaaactggaacacaggtgactcttgctgtgctttagcaaagagactggcagctttttgaccctgtgctagagatatgtggaattttgaacttcagagacatgatttgggatatctggtggaagaaatttctaagaggcaaagcattcaagaggaagcagagcatcaaagtttggacaatttgcagcctgataatgcaatagaaacaacaacaacaaaaacacattgtctggggagaaattcaagcctgctgcaaaattttgcttaagtaatgaggagcccaatgtttatcaccaagacaatggggaaaatgtcaccagggcatgtcagagaccttctcagcagcccctctcatcacaggactcaggcctaggagggtttcctaggctgagtccagggcccccctgctgtgtgcagctagggatttggtgtcctgcattgcagcttctctagctgtggctaagaggggccaaggtacagcttaggccatggcttcagagggttcaagccccaagccttggcagctttcatgtggtgttgagcctgtggtacacagaagaattgaggtgtgggaacctccaactagatttcaaaggatttatggaaatgcctggatgtctagacagaagtttgctgcaggggtgggggccctcatggaaaacgtctgctagggcagtgtggaagggaaatatggggttggaggcatcccacagagtctccactgggataatgcctagtcgagctgtgagaagggggccaccatcctgtagatctgagaatggtagattcactgacaggttgcactgtgcacttaggaaagctgcagacactcaacgccagcccacaaaagcagccaagaggggctgtactctgcaaagccacaggaatggagctgccccagactatgggaacccacttcttgcatcagcatgacccctatgtgagacatggaatcaaaggagatcactttggagctttatgatttgagtgccccactggatttcagacttgcatggggcccatagccccttcattctggccaatttctcccatttggaacagctgtatttacccaatgcctgtatccccattgtatctaggaagattgacttgcttatgattttacaggctcataggcagaagggacttgccttgtttcagatgagactttggactatggactctgagttaatgctgaaatgagttaaggctttgggggactgttgggaagggatgatttgttctgaaatgcaggacatgagttttgagagggttccagttaactatataaaaataaaaatgttctaatgtcattattaaatagcgtgctaaaatgtaaaagtgtgaattcatttctcatgggtagctgaggtcacagtagcatgtggaatatgatttcacttattccaatggcatcttgatgaaattcaaagcatgaaactcattcttggtaacattttttaatggtaaaattgaggcacagaaatgaagggaaaatgtggcccaaattacatagcaattatataatttgtgttagtattgaatctagtcttttagtcaaggatatagaaatgaattattactgatcaaagatgaatcctgagttagccatacatgaacatacaccatagtcacaaattgccattctttagctaagaatgaataaatggtatttttacaataaagaaatccatgtaaaaacatgatagatttttttaaatctttactagtagtcatagaaaaacacaatcaaataatattcttttggcctgtcaaaattctaaaatgtgtatgggtgtatgtctgtgtctgctaataagtattgttgttcatagagaagggggagacacatttatcagtatgtttcaaaggccaaaattattaatgccccttaacccaaaaattctgcatgtaataatttactttatatgtgtaattataaataccccaaaatatttatagacattctgaattatgaaaatctcaaaataaactgaaattccagtaagagggcattggcaaactggatgtcagtatgtaagaatgatgaatcataatattagtcattaaaaatcaagtttaaaaggataattgtgaggtaatatagtcacaaggcattgaaaaagaaagcaggttacataacagatgttgaatgatacaattttataaatacatgaacgttatttaggattcttagttttattttctaaaacccgttgacaggcatggggagtggaaggtgaggataagaattattaagtaccacctactctgcactgaattttaacacaggtatatttaacactaagtcatgaaaaaaaattatatttcttggatattcttctagctgaggtgttcatattaataaaactcccttttctctagtattttatttcatgaggcaatagcatccatcagataatgtaaagtataaatatttagtgtgcctccttctaggctatgaatacagtacttggaagatataatattgggagatgtagcaagtgcacacaattaaggagtgcacacaggctcactacaactcttttagaactttgtgatttcctgatctctttctttgtgatggtaaatttccccaaacttttccctagacatttcctcaagatcaagcaaggtaagttacaaattatatcatccttaattgtaagtaatttacatttataattataagtaatttacatttataacttgattgttttattttactaatatcagtgttagaagttttctactgtgttctacatttgtgtaccatttttactttctctctatgacctaaatcactgcgtgagaattttaaagcctgaagccccaacaaccattatccaaatggccatactaataagtaccaatcattttgttctcataactttaacatccccctaataacaaacatacagaggacatatacagaagaatttcaaacagactaacaaataaaaatggtgagcaacgtaaagattctgcatactaagctatatattccattctgagcacaagataacaacattttactaataaaataataaatttatgatgcatggaaggtaactacggcaacatcacagctgaaagcgctcaagcaatccacccagttcaacctcccaagtagctggcaccacaggcatgcactaccacacccagctaatttttgtatgtttttgtagatgcagggcttcatcatgttgctcaggctggtctcaaactcttgggctcaagtgatcctctctccttggcatcgcaaagtgttgggattacagacaggagccaccacacttatttgttcttaccctcaaaatagtcagaatttaatcaaatattatgagacacagcaaaaggctaagaaacaaaacaaaactttaccaggagataaagcaattcacagaaccagcctcaaagatgacttatatgctatgactatcagatggaaatcttaaaatgattgattgacatgttaaaggtcatggagaaatggtgtacaacacacgtttcaacaggaacatgaaaatttcaatagagtccaagtgaaataaaataaattttaaaaatatcagaaatgaatagatatttcaatgaactcatcttcaaactctataatcagcaaaattgaagataaataaatatatgtaacccagtccaaaactgaaagagaaaaaaataaaaaataaattaacagatttcttaagaactgtgggacaacatcaaaggtctaacacacgtataattggaatcataaaacaagaagagagaaaaccaaaaaaagaagtattgattagatcatctacaacaatttacaaaatttaattaattttcaaaaatataataaagtacagaccaagaagtcttgagaactccaagaaaaattgatacaaacaaaatgggacatacacctagaggcctaatagtcaaagtgataaaaacagatataaaaacgtaaatcttagagacatctgaggaaaacaagaaatattacacatagagaacaaaaaaaatgggtgcctgtattaattgaatctttttcagaagcataagtccatttttttataaacctctttaaaagataactaactacttaaaaccaaaacaataataatgtgttgtgggatatacagcaagcaaaggtaaaatgtctgaaaaaggctgggcacagtggctcacgcctgtaatcccagcactttgggaggccgaggcaggtggatcacgaggtcaggagatggagaccatcctggctaacacggtaaaaccccatctctactaaaaatacaaaaacaaaattagccaggtgtggtggcgggcacctatagtcccagctgctcaggaggctgaggcgggagaatggcatgaagccgggaggcagagcttgcagtgagctgagatcgcaccactgcactccagcctgggtgacagagtgagactccatctcaaaaaaaaaaaaaaaaagtctgaaaaaaagtgtgcaaagtttactatatagctacactaatcaagacagtgtggtattgacagtgggatgacacctacataagtggaatacagtacaaaaaatagacttacacaagtatgtccagccgattcttcacaatagtgcaaaacaaaggaggaaggattttcttttcaacaaatggtgttggagtaattggccattatatcacggttcaaccagagaaaaaggaccaggtgcaagtaattgaagggacagctaagcaattctgaaattcatggcacagtcaggaaaggaaaggaaaatcataaacagaatagaacttcatgggcactggccaaagctgttttccatggatggaatttctttctctcggtaagatgcccactgtgtaacagcttccagctgatgcaggaaggaacaccgagattatcgataatctctcatacttaaagtcaactaattagaagctctgtgtctgaaaagtcctattacaacagcaccaagattagtgtttgaataactgagggtgtagcatagccacgttcacacatcagaagggctatcacagacatccttaggcaaaagaaataaacttctcatatcatacataaaaattaacccaaaatggattacagtcttaaatttaaaacataaaactatcaaaagtttggaaaaaaaataagagaacaactttggacctatgactaggcaaaagagttgataccaaaaacataatctataaagaaaaagttaataaattggagctccataagatttaaaatatttgctttatgtaatcccatgaagaaaatgaaaaagctactgacaagaaaaaaagtatgaaataatctgattgtttcagatatttattgctgcacaacaaacctcaccaaatttagtggcttagaagaaaatgtatcagtttttacaattgagtaatttgggaggagtcgagctgtgcagttctatgccatggggtatataggaggcctagatcatttaacatattttatttaaaagtctggcaattcatctggtgttgtgtaaagagctgggactgtttagtctctttcttgcatgtgtgtgtgtgtgtgtgtgtgcgcgcgcgcgtaccctttgtggataatttggacttattcgaagcagggtacttttagggtagttacacacatcaattaacatccaaaattaaacatttcaaaagcaatagtctagagtgtgactctcataaagcccctgttagtctcatacttactaatgccccattagccaaaggaggagccatttgacacaggagaagtccaataagaacacgtgctgggaggcctggtttattctgggtcactaacttaacagtctatcacatcatacattcactcaggtatctattaagaatgttaagaacaccctatgagatatttcaatactgtacgggaggggaagtaatccctaaaacccatcccaaataacagctttggtaatatttcaggaataaagtttctcctgccttcttttctgaaaacaagtaatgttgagttatatgaaaaagaaatctacaaaaggtaaacacttctgctttcctgttaaatcttgcattggaaagggctcaaagcagcaaagtgaatatccatttttgtgtacctcgacctggagctttgcatccaggagctatagcatgatatataataagagtattaggtttagagtcatacaacctgggtttttttcactggtgagctgcataattttgagcggttacgtaatctgagtctcagcttactcatcaaaaaatggaattatgttacctttctgtatttcttctcacaaacgctggcaaaacacttatagaaaggaaaattgtgaataaatgcagggataataactacacaaattttctctgagggagctaaaaggaagacctaattcattatttctaaactctagtcttctaagagataacagtctagttttgttatcctggtaatctacatgttctttaaacactggatactctgagatcaagattcacacagcctgcagctgacctacataatatacctgttttctgacagtaaataatcaatgtaaaagctttcttacatcagctgttgggatccatattgacttctgtcctaaatttttcctaaaacatctgcaaaggtaatacaccaattatggaactagaagagagatgcaaacaaacaaacaaaaacccttttcttcttaataactagtactgtaacagatggtttgtgacagaacagtgatattacaacccccactaattattaaaggagagaggaaattctgcttacttaatatcagtcttaatggaattccatggcaatcccctccaaagcatccatctctgttgcttacctaagtcacaatcttggcgcccttggctcatttatcatagaaaccagcaaagcttaattatctgcatgaatggggacacttttattgaacttgggcaagttactcatgccctcagaacactaggttcattaacaaaaatgggaacttttgctgttaacccaccctgaggacctcagttggattattggaagaaaacatgttagttctaatgctgagcttcactagacatatatagttgataaaacaaagctaaagctaaatctacagctcagaatttgtttctaataattctggaatattcttatcttgtaaatgctgtgatgaaccaatacggaggtgctaaatatgtgattaagttaaatgttttggtgtctcaactatcctgttttaagtcctaagtctgcaaccaactatctgatactggaattttatatcattgagaagtatataaaaagaggactttttaaaatcaattcttaaaagaaaaaccatcataactatagttagactttatcgaaataattcgtgaaagcacttaacatagtactttagtacttaataaaggcaaaattttatattattctatttttattacaattcagtgatgcacacctaagaaattgaatcaatttcttctatctcctctcttgacatattccccccaaatcttgtaattaaacataaagtactataaaaagttggaaagtaatcaataacatttttaaagggaaaagattttttccttttccttcacaatttatagaaaaatcttgataacagaagatttttgctctatgtcccctgatagttactgtttattgggccttggaaaagtcagttctcatctttcttaggaaactgcattttctacagccataaaaaagagaaattatgtgtgacatgcttagttcggtaggaacttggaagaattaaaaactaatatttatgggaaacatttatttactcaaaaagtcttattttttgttcagatattttgaccttgtattcttattccttgaaatgtatttttagaaaataattctaatgaagaaagaaaaagtgtatttatattaattttatatttagaaaatatattattttaatatgttgttggatttatgttcctaatgttttgacaaggatatttatacctatggtcatggaggatatttgctggtaactttcttggtggcagactatgttagaatcataaagccagttgggagattccttttcctcctctatattctggaagagtttgtgtaatgtaggtattatttcttaaatattggataaaactcacctatacatatatttattttttcctaatgagaagttcactattatttatattgctcttcactctatgtaatatatctattttctctgactgccttcaagttcaatttatctttaattttccttaaactgtgatgtgcttattttttttttgtatttattattttgaaccttttgatcccaataacttgcatatgggaaatgtagtgtgatgtttttcaccaaatttaaggcaattcatctattatattgaaatagtttttctcatctgttctttctctcctaacttcctgggaccccaattgtctatacattagattgtttaatattacaatacaatttgctacctgtttatattttgttcagttatttaataattaattaatccattttgaggcagggtctcattccatagctttctgcagtgttgaactcctcagctcaagcaatcctccaaacctcagcttcccgagtagctggggctacaaggcatgcaccactatgacaagctagtttaaaagaaaaaaaaattgttttgtagagatggggtctccctatgttgctgaggctggtcccaaactcctgggctcaaggaatcctcctgcattggcctcctaaaatgctgggattacaactgtgagcaactctccccatcctgtttattttgtttcaaaatcatgtttttccatattctgaaaattggatattttctgctgatctgtcttcatactatttgtctctttctattgcagtctcaaatctgttattgttcatcccattcagtgatttattttttcctgtgaaatactctgcctgttatttccagaataaaattataggctctatttttttgctgatattccctatcagtttattcattattaccacattttttaactccttgaatctaatttaaagagctgctttaaagtctttgagacttctgatcataaaaaaggtttatcttgagttcttttctaactgactacaatttcgtctttctgaaataagggtcatatattcttgctttttctgatgctcagtatttttattgcattttgcacattgcagctatttattataggtaatttgaaatatattgttttcctttagatggttctgatttttgttttgtcaaatagtttgattaatgacagacattgtcatcattgataaaccttttttcttttgtttgctaatgtgcctttatttttcttttattcttaatcttaagtttctgctgttactcaggacatgtcctttactacttatttggcttttctggtatctcaactaagtatctgagctgcttagtgaggtttcttcactatggtttggctataattccaatgttttccaaccctgtccaacctccagtaaatttcccaagtctcaatcacacagtaacagctctctgcaaggcctcatagaacctttccttgaacacctgccagccatctttaagccaaggaccctccaggaatcagggtactgtcttctgcacctcattgtgtacaactttcttttctgtattattttgctgaggatattctcactgtctcagtaagtctgaactctatctttacctcaattgttcagtaaaatactaatctgctttattattatgccttccacccacccagcatggaagctcattcagtgaaatgctatgctcagttgagtgacagtgccatccctctctgccttactcccttgacttgactctatccgattcaccaatatcacgtcctccgatctctacatctgaagttcatctctactcccatttttatttcacaattgggttggcaaagaaaatatttgaatacatccagctttctccctgccactctgacctaactcagtgaatcttaataacagttaggtcatttcttttgaagctgacctagatttgagtctcactggtgaattttgaacttaactctttattcgcatcactgtagctttgactctgaaaagaatgacctctgattctccacattggtcacagtgttccaggccattcctctgtgacttttctgttttgctcatagaattaatgtgctcaacactcataagctgtatactccattcccacattccaatgaaatagcttttctaggcctggaatccttcactgatccttttagagacagcattcagtcactctcaagttctaggtacagcttaattcttcaaactttgaatcaaatgaaatgcctcagttcaaacatgttcaccttttaaatggaatatctaagttgttcagctccacaagctggttatttaagaaaagaatatggcttagaaacaaatgagcaatgtccatagtatttcatgtaaacctgatatgagtctattattgcaagtttggtatttttaaatactttaaataaaactaaagatgcctttaaattgtctttttttctgtcaataaaataatcaaaacgtttgttatgccccgataaaaaatgttccatttctttgcttgggatacagaaggaaaggatgtcatagtttctgctcttaagctgacaggccagtggtagactcaagatcaacacccctgaaataatggtgtccttcccgtgaaagcctatggacatttatgtggctcaaattataaaggatttacggtttcagaaactatctggctatttaggtgataatgtactgagaataagctgcaatgagacagtttgtccataaaatagatgttttcctgctccaaaaatataatcaattttctccaaattcacaaaataagccataatttatctcatcaaattctgatcaaataaaaagtagatagagttatatcaaacatacatactatacatgcttctcatacattttcctgtgtgttatctcacttaaccattacaacaacctacaggcaggatggaggaggtattttatttaccaatttagaaaaatgaggctcagtttggtcaagtgacttattgaaggtcacacagctagttaattatcttatccagtgctatttttattacaccactctaatttagctccttcaataccagtgagacatcaagacacttcaatcaataagtttaactgtttaatcaataattcaaggaactactaattgaatggggcaacatttatggatatattaaaaggcatcacttttctaagaagcactaccaaaggtcatgtgatatttgcaactcaacccactttgccataatcgtttctctaaataaattattcagattacaacttacatgctcttttgctttaaaattctgataaacacatttattctcaagctgctcactaggcacattaatatgtattttctcaaatacaatatataaatatactttgttttgaccatgaacaggtgaaggcatcaggagagtccattcaagagcaggaaaagagaaaattagtttgcactatgaggcctgcacttcaatcatgtcatttcagaataaacatcttctgggaggcaaccacacagatgctttcatagcagaatgaggagctgatataagcacccaagggtgctatcaatgaacagcagacatttgctggtgagctgagatcagtgactttaattccaagagtaaaatgatctttgaaaaggaaaaatgcccagtgttatcagccactgttgtggaatctttgtaccctgcataactaattgggtgtgagagccagctccattctggtagttgtggtagagggtaatcataacatttgcctacttgtgctgtttagagaatttgaccttctctagaaaaactcaggaaaagaaaagcttcaagctttcaaagtttcaagaaattcttttgtggttattggaaattaggaagtgaacaaagtgaaaacaaaacgtttctaagtgattgtggtgtatttctttcatgtttaaattaaagaaaacgcaaagtaaatgaattgaatatattaatttaaatcaacaaaaagtgaataggaaatacataaaaatatcaatattattctataaatgaagcatctatagagttttgttcttaactgaattgttcttaatactgtttggatatgagaagaaacagtttccatctgggagtcagattcatatgagttcaaatcctcagcagctactcaaaagctatgtgaattttggaatatacattaagctcttttggtcacaaaacaatcaatcaaacacaacacaacaaaaaaagtaatatcctaagcaaaataagggtactgagataactcattgaatccaataaataaataatcagttactggaaagcattaagatctgggcattcccgtggacttcagcaaatgaatttagaggaaatttttttctgaaattctaccacaaaaattctcaatcttagttagatgtcacagtaatgtccatgtggaggagaggccgacactctgaacctcttgttaagttgactatattgagatgaagcttgttttattgatgtattttacttttgggacacacatcgagaagtggcaaaaggtttatacaggtgaaggagctaagtgcacacacacactatatcctctgcaccataaagcagtgttatatatgtgtgtgtatatatatatatacacacacacacacacacacacgtgttatgtatatataacacatacataaacatacagaaaaatatttatttatataattttttcctttttcttttatagctgactaggttttcttccaataaagccttctttcaggtactcatgattaatctcttgtgtaaatcattgccaatgatctgctcttaactttcgttactgattctcagtcctgagtgagactaaactgctaagtattcctaaattacctaattccttcttcccatacctgcatagacaaatccagctaaaaacacaatctctcttctttcagggactttaaggtgatcagggaatgccttggggaactttaagatagaagccacagtaaaccatattaaaagtgagggggagagaaagagagagcagtcaccaacattagcttgacatcagagagcttcccatggttttgcaattctcaaaagtgaccggggaaacagtggtcatatttgggtttatatgtctttaaacctgcattgtttgcaattctattgtttccagctatcattggcccaaagagtgttttcttcacatttttctgtaaaatatgaagaaatacataacagtttcttcttctacatgaggcagaaagagatgatggtgagacataaagctgggaacccatttatactctcttctgcatcatagaccagattatttatctcaacagaggaaaaaaaagactaataatgtacatttccacacttgccatgtgttcttttaaagtgacagtggcaggtggcaggtggaaatgtaatgttaattttcatttctcttgccacatccctttgagaaaatccttcattctctcattcttaaaacatttctctcatttcaacagccgatgactgactcagggcaaattcaagattaggcaagcaagaaagccacagataagtctataaagaacaggccatttttcatgctatttttaagcaagattgttatccttcttcctcttctccaccatgacaccacgttactggtgctgaaagcctattattggctaagagcaagaaagcaaggtattaaaaagggtcattagcatgtttctgatttggtagttatacaggttgactggagtccttgtcagttctgttgatctggttaatactgtcttcctaaagtcatcagaatcaatgatataagacaaggtgctgcaatatcaagtgcctgcaggtaacaagaaagaaatgaggtatcttgagtgtaagaaaacagggaggatattggaaactgaagagtgtgtgctcatctacggtgagtggaaactcaaacccagtgttgcaaggtcttcacctatttaaaggaagctagcccctctgcctggccagctgccccgtccgggaaggaggtgtgggggtcagccccccgcccggccagccgccccgtccaggagggaggtgggggggtcagccccccgcccggccagccaccccgtccgggaggtgaggggcgcctctgcccggctgcccctactgggaagtgaggagcccctctgcccggccaccaccccgtctgggaggtgtacccaacagctcattgagaacgggccatgatgacaatggcagttttgtggaatagaaaggggggaaaggtggggaaaagattgagaaatcggatggttgccgtgtctgtgtagaaagaggtagacatgggagacttttcattttgttctgtactaagaaaaattcttctgccttgggatcctgttgatctgtgaccttacccccaaccctgtgctctctgaaacacgtgctgtgtccactcagggttaaatggattaagggcggtgcaagatgtgctttgttaaacagacgcttgaaggcagcatgctccttaagagtcatcaccactccctaatctcaagtacccagggacacaaacactgcggaaggccgcagggtcctctgcctaggaaaagcagagacctttgttcacttgtttatctgctgaccttccctccactattgtcctgtgaccctgccaaatccccctctgcgagaaacatccaagaatgatcaataaaaaaataaataattaaaaaaaaatagaatttgaattagtaactaaaatgtcctgagtttcaatttgtggacaaaatcttttaaaagctttaaacactttgttggtcatatgatttatatcttttacctaagttagattcaagggctgtcaaatttgtgatttctgtaagccaggaactccctgacagcaggcaaatggtttctgctttctttctttttttttttcatcctagaacttattttttcttaaagacctcaccagaatgagttcacagatgtcctttaggagaaactgactgatcaggaggtggatagctcccatctaggaactgagcaaaagaagataggaataagccattataacaatgtctcctggtccactccttgactgggcgtcagttagcatgtgacctttcctccctcaggtgaagtgagtactgaggagaagataagtctcctcacattccatttccggatatgtgttcctcctgtcacccaccactcacactctctcacctttttgacttgacacaaactcctatctggcgggtgtaatttactcctaaagagttgagaggcatgagactggcaaaaagtaaacagtctgataagttcaagagttggcaaggatacgtggaaacagatttagccatagatatacctctgtagcatgactttgggtggtcatagctagagatagtccaacaaggccaattgcagcagttctacttcttggaatataccctagacaaagaggatacacatttcataaaaaagtatgtataaagatgtttttagaggctcataaaagataaaacagtttttaagtgttttatctccaccacctatctctccttctaaaccagcactcaggtttccttcagttattatttcacacagtgtacaggcttgttgagtttgttggttaggaagcctagtccttcaatgagaatgctgactgggttcctatgagtttctggaaaatcaaattcccataggttcttcttttcattatgcttgtctggtcaaggatgaagcaatcttaggttaaataacagaatataagggactgggctgatacagctatgaatctaatttttagaaacacccaaaatatccttgctgcaccctccaaataaacattatcaggagattaacaacagggttttttacttggagatattgatgactaatatcaagcttattgaaggaaaaaaatgaattcatgtgatcacattactgaaaatgcatacataatagctggactcaagagttcaaattatgtgtttaagaaatagagaaatatatctctatgcattatatctctctctcttctttatcccctgctttcctttgtgacatcttcattctctggcaggttctttcctcttaatgggaaaggcagtgatccttccatgtctacatgacaacgaagagcttgggatctcagaagagcagaggtactgcctctcctggtatctaaaactaactcccaaaagagggctctgattgcctcctttaggagacaggctctttgactgactgcatttcctccttcattatgttgcatcagagaggagccattcccaaaactgaaggaatgccggaaagatacatgagtaaaatgtctttgacaatgactgacattcaggctggagtttgaattacattctaattccttccacaagtttggattaaatccacaagtttagattaaaaacacacaaagaaacacattaaaaaaaacatgagaaagagtgcacccactactaactaaaattttatactacagtgatagcaggagtaaagcaggattctaggaaacatgaggattcacagaagcaaacaaaaccaggtaattcctatgtttcaagccctgtgtgtttaatctttacaaacaaccctttgacattcattttacataaaaagaaaacagccccagaaaataggtttatggttcacaatcctcgtttctttgcttgttttctcccttgacccaaatataaaggatagcaagcataccatcagtcactgaatatctagcaataactcttaatgctgtgtgtgtgtgtgtgtgtgtgtgtgtgtgtgtgcctgtgtgcctgtgtgcgtgcatatgtatgtgtgtgagtttgaatcgggagagttagattaagcttttgtcatttaacaaatcacctgaaagtcaacagcttaatgacaatgattaacttgattcatgattctgtgggttgactgtgatccattagctaggggttgggttatctggatgtctcacagttgctgtggactgttacatgggaatctcaattcttcacatggcctctcattctttttaagacttctctgcgtgctggtcacagggcagtgcctttcttgtgtgctgttcacagcgcagtgcccaagactgggaaggtaaaagctgtgaatcctcataggacttagctttggaagtctcctaacacatcagccaaaatccactcgtcaaacaagtcatgagtccagctagtttcaaagtttagcaagtggactctacccctttataaaagaattagcaaaggtacattgaagatgggggtgcaactaagatgggaagaaaatatgctcatagttttcaatctatcatacatcccaagggtggctgtatcagcattcaaggttcaggcaaaaagtgctttgaaaacaccctcctcatttatgcctatcatgtcttagatgtctcctagatctttaaacctatatatttctgagataaatgtcacgttctagccatcgtacaacactgatattcagttagtgaccatcaatgagccacccagtggtcagccattatgtaaattatatttgcagaaactcagtttttagcttaacaataaatgtatgtatccatcttattttagactcttggcacatcaattagccttgagattgaaagagtaaacacaaacataatttatcactttgtcaagttcaacaaacaccacgttgttttgctcagaacccctaatgtagactcatgaatttacaaatctgacaattatttattaaggctatttgctagcccagctggctttgttttacctagagatgttaaagtgagtaagacaggaatctttttattcttgttaatctcacagtctgcctgctccctctcctcccctgactttttgtgccttggatgggattcagtctcctgttccttagacacgttccttcatatgataaggaagatggacaaacaaggctgcaagagtagtgcctatgactccagcagagaagtcccaaggaagagcattggttggtctttcttgggtcacatgtccagcatcacaccagttaccacatgcaggggtttgcactttcttggcaggcttgtcctgagtcacttacaaaaccctaatttccaggaagtgaatcctttgattgatagatccaaaataatagaactgattagtgaaagagacacatacaaaaatccaataactaccacaggaggtatatttatttaagtattttatagataagaaaactaaagtttaaagcaattcagtaacttatggaaagtcatccatataagtgacagagcaaaatttgacttgaggcctgattatatttacaaccttttggaaggtctagcattaatgtactgtgtgttgaattcaggacaacctaagaatagtaaaggtgttccaaactcttctcaccaactccacgaatgaaacatataaggagaatttgagtggaatgagaaatcttataaggatttgaagaaggatataggattggctgagtggaaaggagagggagatgctatttttcttagtcaattttaaccacaacaacaacaaaacattttgttcagagctttacttccagttgaaatgttatggaatttaggcttaaagacaagtgagttgacgtttcctccagttgaactaatacaaggctaagagctaatgagaagcaggtttcagttcaggatcacctgtctcatctagaaagtaaaaacactaacgcctgctgtcctactttccagagacttgggagattcaaactggtgaaggtatttcagtgtactgaaaatctaaaaacacaattcaaatggaggatggtattatcataatatgtgcttccttccatgcatgatatgtgccattgtttactaataccatttctaaaatcagagagaactattcttatcaccatagtagttatataacttgataacagaagaggtgaattttgaaccaacaaatttacctattgatttctattctgttcccattattttcattttttttattctgctgagcaaattctgtcttaactagtcctatagaacagaattcctatagattaaatgctgcacccaatgaaaggctttgctttaatcaaaattaaatctatttttaaaaatatttattactcttcaataaacaaggacatcctattggccttctccatgtgagttcttaatttgtattccttggcaccattgaagcttttttagtattagctaagcagtcctttacacttttccttgtaaaaaatctctctttctcccaaacatctccaatcaacttcagaggtctctccctgtgtaatcctagataagcacagggcattgatttatactgtgtcttcatcctctgccatggagaaacaaaacaaaatgctacatcctgtgaataattaacttagaaaacaaaaccaaaatgcagcaggataaagcaatggaattcttgcttcatcttattcatcttgacagttgcaggaatccaggtctaattgtgctgctatttaagctgaaggcagaagctggcacaaaagaaaagacatattattgtcaaagcaacccccgctgcagctgaaagactattaaatttagaagggcagcaagttatctttattttggcaaattagtgatggggattccgagtgattttgctatatgttgcattaccactgaataaataaataaccctctcacagctaccacaccaggacccaatgttcccattaatgtccccttgagtgcatgctccaggttgacctttggtctcaggtgagtgctccctctgagcagagccaatggttctgtggagctcaagatgtaggaaatgaagggggaaggttgtccttttcctttcactcagtttcttttctgggcagaaatttgggataaaaaataattagaagtattctaagaaggtgagatagaaaaatataggaaataaaaacaaaagagtctaagtagtaaatgaaaagatagagtttgaagaataccgcttaagacctatgaagcaacgaccaacacactaaagacagaaattattaaaatcaaaagccagaaattattaaaataaaagcttccagggagatggtcttcaggcaaggaacaatgaggtaaaacattggcacttttcattaaaatttaactgaattttttaaccatgccatgtattactttgatacatgtaattcataaagatactataaaataaggctataatttaaataattgtatatagaatgtggataaagttcattaacaatatagatttctactcattttctaactgggactctgtaatattagtttggtgcaaaagtaattgcagtttttgcaattgaaagtaatggtaaaaaaaccacaattagttttataataataaaatactattattttataataatacaagtatattttataatataatgtaatataataaagagagatcaatgtttattttagcaataataaggggaggtcaatgtttattgctccatttgtcccatggaaaaaatgagattcaaaaatattaggcattctcccaagatcactcagaagtcaggagcttgggaatagggagagaacgcaggtccttgactctgatggtattgttctttccatcctttcttcaccggataaaaggactgttctcaaggtaccactcataggagctaagcaattttaaggaaagtgacagaaatgaaggaaactggcagaaagagaaagccatcttacccagagagatactgacctatgattaggaatagtttgaaaatacaatctgattcaaaataatttaaaataatgtgtaaatatgccattgagtcatacaggttaagagacattagatttcagtgcgacacagccctaacaaccctgtatgggtgacaaatgtgccattccattcatcatctccaacagtaagagaacactggaactagtgaactgttgtcagatggttaggtagtgaaccagagttagatgcattgtggtgatggtgagatttagggagcaacagaggcaacaaatatatatgtctccgtaaaatgaggtcagaggtaaggagtaagaagaatgcaggctggttcataacttgtgcagataaatagcagggacagaccctagcagtcacaaccacactcctatcattcatctcagctcttttgctggagaaaaggagtcatctattccattcagggcttccctgattgtcttggtttctgtgaagtgtaaagcaggttgcaaggagctgtctgcactgatgcgtgaatgctgttttcttggagattaattcagaatgtgtttgtgcattagtctctctctctctgtctctgtgtgtgtgtgtgtgcgcgtaaatgagccttttacggaaaaagtcaaggtttaagaattttgtgctgtgtgtctgacccctaccttccttctgtgcatctctgcaccagtcctgtcctggatttacacaattctatgcatgttatacttaattttttttacgatggcttctgatgaaaacatgatatagaagtagagggtgaccttgaagatgccaaagtttgccaccctattgtttgatacagtgaaaaataaggaaggtagggagctctcttggagctaagattacacaggagaaataagaaaaaagctaatgtctttattatcaatatagcacacggacacacacaaacatatcatgttccatgtttgagtctccactcccaagagaagtggtctgactctcctttcctgtggaggactcagttaatcaccagcctatcaacccacgtctggtatccataatccgtggttctaaatcataagagggactgtgagtgtgtgtgtgcatgtgtgtgtgtgcatgcgtgcgtgcctgtttaaagtagcattcccctgtaaaacaagtcatcacccctttgtattttggtaactactgtcattgctattcacttggaaccaacactaaaaactaaaggcggccagggaaaagttcagtagtttttagggaaaatgtcagaggtaatgaacaaaacaagcagctgtgcattttcatcaagaatctatctggaagaaggaaacaccacaattattccacacagacagccccttccagactagcagcacttttctcccttctccagggatgatgtggaagacagagctatgcaaaagcagtctgagatgcaccacatggggtggtgagagatggaggagtggacagacagcatgggccaaaaggtaagagaggcagttagagagtgcgcggagagacagacaccaaacgcgctgctgtagacaaagacaaatgcagaccaaagcctaggaatgcagggagcccaagttaggacagcttcagctcgctcagtcatctttgtaacaccttcctggttttggcaatatccacagtccgtcagtattattattattgtcttataacattttctctaaatcaaatcctttaaaatattttatgtgttgtattataaccacctatgataagccagtatcacttttacatttcaaaagatcaagataacaacattacaaatcgtatgattggtttctaagtgttgctgcccatgggggatggggagatgtgagcctgaagtttcttctttatgctgaaaagaagaaagaaaagaaagggggttgctgggtgcagtggctcacgcctgtaatcccagaactttgggaggccaaggcgggtagatcgcctgagttcgggagtttgagaccaccctgggcaatatggcgaagccccatctctacataaacaattagccaggtgtgatagctcatgcctataatcctaactactcgggaggctgaggcacgagaatcacttaggccctggaggcggaggttgcagtgagctgagatggcactgagcgacagagcaagactctgtctcaaaaaaataaaagtgggggtgggggtaagataaagggaagaaaaaaataaaagagtttagcaagtgttacaagagcatggaagaaggataacaaaaatgagactttgatctaatccacaggaattttaaaagtagcaataatcagaaagtcagtcaaaacgtgtgtgtgtgtgtgtgtgtgtgtgtgtgtgagatatagcgctgtgttacatggtggtgatgttgtggctctgttccacctaaaaccactttaaactccaccttaaatcgtctgcaagatgcttgcaacaaactctgaaaatcacctatgcagtggttaagtgcatagatgggccccaaacataaagccaaacttaatattggttcattcactctgtaaacatgtgttaagcatctgctgtgtctgtcaggtactgttcaaggtgctagggatataattgtgaaagaataaaagaaacttcctccatgggtcctttcatattgtgataaaatatatctttaaaaattaccactttaaccattttaagtgtgtaatttagtggcattaaataaactcacagttttgtgtaaccacaactatgatttatttccagaatgttatcatcatcctaagcagaaactctgaacccattaaacaactccccttcctctctcatcttctcttaacctctattctactttcagtctctatgaatttgcctattttaggtacctcatataagtgaaattatatgatatttgtccttctgtgtctgatttatttcatttagcatttttttaagttgtatccatgttgtcacatgtgtcagcgttttgtctctttatggttgaatgatattatattgtatgtgtatagcatactttgtttattcgttcatctgctgatggacaccgagttctttccaccttttggctattttgcataatgctactatgatcattggcatacatgcttctgcttgaatctatgtttttcattgatttggggatataactacttctttcatggatcttacagtttaacaggaaatgcaatcagataaatggcaatttgtgaatactctgctaccaagacacatactccatggtataggagcagaaaatagccagaaaaaaacaaaacaaaagaaaaacctgtgtggagggaattttagcaagaaaaaaaggaatggcacaggtgaggattctaaactaagaagatgtacagcccattaggaaacaaagagaaaatcaggaatatttagaatgagtggtagcataggaaaaaataagattataagggaggcaaaaactgattgtacagggacttacagatcatataaaatttcacgtcttccaaatacccacacatcatccactgcttccagacattcagttttataaggtcacatgtctcattcttagaaatgctttttctgatcacctatctaaaccaatgtgatcaccatttgtttctagtctttatcttgtttcatttctctccatagcttttggagtccatagtgtgtgtgtgtgggtgtgtttgtgtggatgtgtgtgtgttcatctcccccttcgaataaaagctccatgaggcagggacatcactgctgcaccccaggatcaagaacagctgcacacaaaaagtcagctataagtattgatgacattaatgaatgaatgaaccaataagtgactaagctggccctttcatttactagctttatgatgttgagtaacttattaccttttctaaattcaagtacctcttctgtacagttttgtgaatgaaataaatgccatagtacagggcctgtaatatgtttactgagtgcccagtaaatattagttcatagaatttagagagagggagacaggtggcaaaagagggagggggatagagaaaataaagcaaaacaaagctacccatccaatatttccattttggtgagtggccctccctcgttttagactcactgtcacaaacaggaagccaaacaaaacaaaatcaacaaaagcaaattttaaacttttgattctccttccaggaaaacaataaaatcaagagaatgaagccgatactgaaaaattataatttagacttttattttatagaattaagtatccatcagtctgtttatgaattttgctttaccacgctgatctaccaacttctatacagactcggttatatgagagcatgggtctgtgtttgtgtgtgctctgtagtcaaagacgtatgttcactgagacatgaaatatatatgatacatgtggaacaactataaacaacatgggcgaagtgtgttttttagccattctctggatccctcacagttcttctagagagtagaatcatcagggaaatcagaaaactgaaaggtattttttattccccaaacaaaacaaaataaaacttcactcctgactcttggtggttgaaagcaaatgtatagacaatactgatgcttgttcctaatttaataaaaaacgaaaatccataatacagcactagtcaacatggagcccgagtgtgaaagctaatctcatcatgaggtgttaaaacacatgggaaagtgggaataatggataaggcgttttaactgtaaatttcagcttggcagtgataggcgataatgttcacccacaaggaaaggctttcatttcatccctgttttgtggagctggtgttaattctgagggaggttgcaaagactgacttattttgccaacttcataactgctcttggatctgaggagcagaggctcaaggctccttgtagagtcacgtgttgattttctaatttattcataagttatatatttctgtttataaaaagaatttgcaatggcttaaagcatgcctttacttctatacctaccagggctttgttttatcattcttctggctttgggaaaagagagctgtttctgttggattgcaggggaggaaaaaaaaggtctgaatgtgggtgtggtgaggggaagggggaaaggattgtcagttaatacatcaagatggaaaatgaaaacccatttactttgagtattttatttatatcccatttaaaacttccattacagtgcacaacacttacatgtgtgctatgatcacatgggaatcttgttcaaaaagcagcttcctaggccccaactccagaccttctttttcaatgagtcttctatcaggtccaggaatctaaatatttaataagcaaccgaggcaagtttgctgggttagaaaacgtactttgagaaatgacacagtgatcactctctctgatttattaatattctgtgcatgacttgctgatcaattcctattcctctcttccagtgacctgactcccgtttctaccctcctaaacccatttttagttcattcggggaagttaaactggtaactagtagaaaagtctccctgtaagactacaatcaccttccctggttctgcttgtaattaagagatagtggtagaagtaacagacgtagactttgagaaacattacaatcttgtttaatcatcccaatgatttgagaagctccatattacaacctattacaggttccccttaatggttgaaggagctaatgtatagagaagcgaagggaccgggccagtgttatagacaggagtagaagaggtaggaagagtacagtgtgtgggtaccgttacatatggtgtttcttaagaaatcagtgatcattaggaagctgactgtgttaaatcacatgcccttgggggaaaaacaacaaaagaaaaaaaaaagttaagtcttgtcaccaccgtcaaaataggaaagccatttcaatctaaagcatgaacaatcaaagtgaaaacataagcgtctgatttctcttttatccggtcaagttatgtgggaggggtgtgtatgtgtaagagactacaagaaaaggagattaaagacttttccctgcagagaacaagctgagtcagtgccgatcaaaggctgacatcaaacatacggcctcaataattgaacctgctgtctgtaaactctcattagcaagcaggaaagatgattattaatttctcaggtaacatattaactttgcctcatcctaatttctaggcctcagtcactttctaccatgtcattttgctgcttttcaaaatcaatttgcaatttaatggtgtgtgtgtgtgtgtgtgtgtgttttcatataataaaactccaggaaaggagatccatgtcttctccatgaaaagaacaagtggggcgggtgttaatcaaaggctgatatcaaacatatggcctcagtaataaaaactgcgttctgtaaacctcttttcaagaggaagaagcttcattgtgagtttctcaggccatgtgtgttacccccatgtcgttctaatttctaagcctcaacatattctttctttgccatctcaaattcaatttgcaatttaatgtcatggggtctatcaagtggtgaggtcttccatgtcctcagtcacatagaaaaacagaacattttgtgctggaaccttgcccataaaatacaaatgacattaagtcatcagaatgaaagaaaatcacatttcataaatttaagtttaatctatatgtaaatttagccaacattctttagggtaataattcataagtattgatgtttacactgcttggcaatttttttattagtttaagtaatgatctagatacaaaccacattcttttattttacaaaaacaggcgtttggttgtctgaagagatacagaagagagaccaatcacttactttcagacagacaaaaccaccgaatcctttcctgcgccatcgaagagctttgataccaaagagaaagctaccaattttcgctaatttataatacgtatttactcagaaaaatttaagattcctcctaattcacacttttagtaattattctactttaaataaaaaataaacaataacaaccagaaacaacgaaaaattgggattgttcagatagttatattccaagaaccaaacaaaatatctttttattcattgtatcataagagtctagcatattgattgtgatggagtgacccttgccatcaataggttttggataaatattgccttagacagaagtctcatgtttaaaagcacctatcagagtaacaccaactgccattacaagtaatttccaatatttccctaacatattagaagctttttttcctcatttgtgtgacagcagactatcctaccatcagcaagtccatgccctcaattcctttcatcttatggctacggctccccctagtgctcattgtcctctgcttccatgagccaaaggggaaaaacagggtggaaaggacaccactgcttcttagaagccttggcccagaagtgataaacatcgcttcctttcatgtccattgctgagtgctaggcatgtgctcacaccccatacccagtgtgctttctggctggccacctgcttcccagaaaagtaacatcttaaggaggactgcacattttcatgaacaaccagacctgacacaacaagaatcacaggatcttgtctaatatataaccactttcaagcctggcagtggatcagcatcaccagaacctggagagtttattcagaaatatcgacttcctgtcctacgaaccaagagattgtgatttaataggcgtggtagagtccaagattatcctgcccagagtcactgaatgctaattaatcatctatctccagtctgaaccaccaccaaatccacattgaaatgctcactttgctctgtaactcgatgtcaacatcataatcctgtttgccgttcatgaatctgcattttaaaaaattatctggaaaacaatcatggctacaccagccttttttgactgtttactaagtgccactaagtgttccaaagcctttatgtgtgctagcttacttagcttaattccttatgtccctgtttttgtatttaagcttcaagaaacccaactgaagtaggtattatcatccccattttctagagaaagatatagaggcacagaagcaccacgttgtgcaaatttattctagaaagtgtcagagctgattcaaaccgaagcaagcaaactctagagcttttgtcttcctcacttcactataaccaggtgattctgagggatgttaaagtctgagaactattgagtcatgagagatatgcaagtgcttctgatacaagtagtgttaaaaaaaacacttggagaaacacaaataaaatttttaaatgttcttcatttttgctttcaaactcagtatagatatctactctgaactctagctgtacattcaaataccttttctatgtcataattcaactcttcatggcctagaacaaactcaaactccctgctaatttctcttcctccagcactctctacttcaaaaaggacataacctttcccacaggggagcagtctgaaaacctggaaatcatcctcacatgtctttcctgcatcacccgttttgctggcatcatgagtgattcctgacactctcacctgctaaatctgtcactactctgctcttctcttctgcagtccttgctatcaccatctccccagggctttggcagcagcctggcatcttgtctcccactttttgtccccaagccattcttcatattgtggaaagagtgatcttttcaaaccatgagagatgaaaccccagatccttaatatttcctagaaaagtctgcatgtgcagctctgattactacatgggccttagctcaggccatggtccccagcccccatactccaggcatgttgatcttcctttagttctaactccactgtttctttgtcttcagcttttcacgtgggtccctgtgcttggaatgctcccctcagaagagcattgcataagttacttcaggactctgagcctcagttctcatctataaaatgggtataaaactttggaacagaattgttaaaatcgtgaaaataaaatgtatatagtcaataaattttagtttttctgcatatgttcagggctttttttcttatcttccaataatcttcatattaaaacatatcaaatgatgtttcttttcactcttttactagcagcaatttcatgaaatctcaaggttagatacgtctcttaaagaatttatgttatttcagaaattaattaaagtcatcacatatcttgctggggaacgctttccctgcggtttttaattactgtctagttaacaatatcctttagaatgttgtgtcttttacaaatgtaggtgttggatggctataattttcagaattactactttggtctacaacccatttaatgagttagtaaaaacaattaatggaatttacatacttacttgggctctgacagggaggaaaaaaagagaagattccaaataaatgagcaagtaaaagagcattaattagcatctaatttgtaattgcagagttcagtgctcaatactttagaaattaattgaactctatgttgatgtgtaaggtgaaagcatacccaacttcttgttgagataagattaatattatcctcataaaaaaccctcaagaatactgattgttgaaggaacaaacatatataacaccaagggttgtcagcagtatgagccagcaaggagggatggtatagcattaaatacatacaaaagatggaaaggcagtgaggttctgaataaaatgtccacagaaataagggtccaaccaaacatactggttattgcattattatgttaagtctaggactaatacaacttttgttaccatgtaagtcataatttattcaagaaaataaatgaatatttgaaatagggattgaaaaacttttggcatgtaatgggtaaatttggacatcttaaaaataattggataataactatttaaactccacattctggagcacagtgaattcttttggggagaggttggggttttataattctcagctgcatgtgctatgtatagttttagccagtcgatattatagtttagcacgaggggtatcataggcagatgaagtgacaaaagggaaggatcttaagcagcaggagagggcctcagctgtcttctatgcaaacctgtgtccatcgcagctctgcctcttgctgtacaaatttggaaggaaattcaaccttgctcagcctcagtttcctcattcataaattggagatgttattacctgacttacagtatggctgtgaggtttatcaaggcaattatgcaatgtggcagaagcgggattcaaacttcagcaatttgaatccagaatccacacttttagtgaggttaagctaaactcatccttattctgctcctgtgtgattctgatgcacaaaatgtggcttcagcacatagtgagtgctcaactaattgtagttatcagcatacaaaataaatatctatttgcatttttttaatatttggtcaaagtcagttgagatggtaaatgacagactttggcctaacaaagcttacatgggggccatgggggctaaagtcagcctgggggccaggtggggagcaggtgaagttgtaggggaggcaggcatggattccaggtggggtaacatacctgggctgtgggcttttgtctgttagctgttgcatctttcaccagcaatgggcagcctttcaagctagcacttgtatggggggagttactgcctctcagcactgccagacgtgtcccgcctcctgcgatggaggcaactctccctatcatgtaaatcttgaaaagaaagtatgttttaaaaacttactttctatatctgtagtcccagctactcgggaggctgaggcaggagaataacgtgaacccgggaggtggagtttgcagtgagccgagatggtgccactgcactccagcctgggctacagagccagactccatcccaacaaaacaaaacaaaacaaaacaaaaacaaacaaacaaaaacaaaaaaaaaacttactttcctcctgacgtaagtgtgaacaagcttgtgcctaaagaaagttttggtaaaacaatatgtatatctaattttaaatgcattaaagagatcactactgcaaaaattcctctaataaaacttttataacacaatttattgattattatagaatatgtaggaactcttcgggggaagaataattgaaaagatctgcctagtttaaaaagttgtttctttttgtctatacaataatcatttcttagcacctactctgtgccaggcccagaagatgtaagaatgaccgtgtcagaccctctcactgccacagagaagccatctgtggagcagacagatggggctggggacgagtaggtgtcctgaaatgtattaggtgatgaggctgaagcctgcacagaaggttttagggcactgggggcaaaatagaaaagacaagtgctcaactgcattcagatgaaggagaatcagaagcaattttaccttagagtgatgattgctcggaactttgaagaggatgtattttctggggcagcaggaaaggagcaggatttcaggctaaagacactacacagggcagcaggtcatcaaataacctggaagctccttatccattctaaccctcagttccccacttagcaaatgaaaaaatacagcacagcggccaagaatgagttctattgctcgtgtctgatagaaatgctctaccacctactagctgggtgagcttgcacacgttaatcctctaagcttcagtgtctacatccgtatttacaaatcccactggcttttccttcctatctttatctttctctttccaatcttttcctttctcttcctctgaagatttggcggcaatgtggactaaggaaatgaagggaattgcagaggcaatagtgtcaaggtggggtcttgagaaggctgcagaagtgaatagatgaataatcagggtcctcagaatgaataggcaaaaatagtgtgcccagaagccgaggtcaactggaattacagcatagccagaaatgtgttgagggtggacggggttgcgggggggtgagggggtgggggagagagagagagagagagattaaagagtataggttgtgggcaaacactggcaaatgaacaattgacaattctggatcaaggagatacatgacatgtttatactcttcttgtaacttctttataagtttaaatttacttcagaatgacatttgaataatatgaagagtgttccttcaagttttccataagtataaaattattttacataatttttgaaaatcgcaccttgcccctgaagtaccttcattcctattcaaattccttctacagcactgtataatgctttaatttctctttaagtttctgttttctcccaccagaatgtaagtttttgaggctggggatatttttttcaattttcttggcagccatgctgtataccctacgatttgaacaaagctttgcaataaccggcatttacaaaaggcttctaatgaacgaatgattgaatgaataaatggataaataagtctatgatagggtgataattaggagctgagcatatgtgtacactatttacacatgtgacacacttagcatgttaaatgctcaataaatgttttgtaataaataatataaatagatattaaaagctcaataaatacttagtaaaatgttttcactaagtaaactatggctatagtttctgttgggcagtagtaacagattaggctgaggtcaggccacacgaagaaagaactcatgggtcataacaagaaacttacactttattccataaccagtgggaagtgacttagccagatttatttccttaagtttccccaaactgtgtccctcaaaatttatatgttggagtcctactcccagtatctcagaatatggccttatttggagatagggtctttacagaggtatctagttaaaagagggggccctaatccaacatgactggtctctttataaagacgggatatttggagacaggctcacctgcaggaagaatgccatgtgagtaggaagacagccatctataggccaaggagacaggcctggaacagattcttcgctcacagccctcagaaggaacaacgtcaccaaaacctgtatttcagactcttgcctccaaaactgtcagactacatgtttctgtgattaaactacccacttcttggcactttctcttggtaactctaggaaagtaatacaatccctctgccagtcatttggcgataagaggagggatgattaaagcaggacaagtcacttaacccacctgatctctcgttttctcatgtgtaaaatggagataaaatctattcagcatatctcatgatctcacatgaaagggaaaatgtcaaaatgtataaggtagaatggtgataaacataaaggaatatgaaaattcaggcacaaaaggcataataaggtaaatacataggagttcttttagatttaggaaagcttctttgaatattcatcacaagtaagcctttctgatccaaaggatactgttgtcaataacaaattctcaccctgtttctaaagagaattttccttctgggtgtcatttccagttgctaatggacccattgatggagtgtgatgtgagcaaagaatgttagctccatggtcagaatggcattcatcttccacagaaacaatgaaatgaaaaaaaaagtctatcttggaaaataactggcagtgaaagtggggactggtcatcttacagaaactgaacacaagtgattgaaaggtcaatggataaaagaaactgcccaggagatagatggtttcctggagcacaccctactggtaacagccctagacccagtgaactttgctgttcgtggaaatgaatgaacatggcacttagagcctaaggtagctctaacagactagtgctttaatctccatttctaaaattaaagtaatggataactgcccctttcccaaatctattaacaccttacaattaagtctttaatggaggttcaatagccaaataatttgtctttaaggaaaataaattgttgacagttccctttaggttgtgtgttgttagctttcacctaaattaccaccttgcagaaagggtaggtcagttggaagtttttaaaggggttgtgctttaccaagttgttctgagtcaaagaaaaaaaaaatcacggaatactactttgtcttgtcgtagttgactatttttagtgaaaacactgtaagggagaaataatcataatgtccaaatcacaggctacttacgtggaataaataagggtatgcaacaagcaattcttagcacagtgctccgcacagcataagtgctcaaaaagtaatagtcaataataaacaatgataaatggaacacaaagatttattcaatagatattttattagcatctaaagtctgtaaggcacgatgattagcatggtcagaaagaataaatctctgccttcgaaaagcatgcactagtttcctgattttaggaagcagggtttagaagttcatacctgtccatgtttaagcgcttgcttactaacccaatgtatgccatcttttttcttatgcgcatttcagtggtccagtcatttgtaattaaaatagcccagactaacaaaaggcatacgctggccttactaccaaggggatcatcagcagcaagacagatggcattgaattggaggaaggtcagaaaatgcatcctggaggaggtggcattcaaaggaggcagggctttcataaacagattatcaatgaagaagtggtctaggcagaataagcagcatggaggaagccatgagactgacccatgcctcccacagatgtttgtatggctgactctcatcttactggtgtcagctgggatttcatcttctcaagatagccttctttgaccaccctaatatcctgagttacactccaccgtattttttgatttacagacttcatagcactaacatcctctgaaattctctgtcagtatgtttatgatctgtttctaccttggtatatgagctacataagaatactgtctttgtcatctcgctccctctcaatccccactgctcacaaagtccacagcaaacatctgttgaaaagaagaggtggctaggtgaagaaaggcagaaaataaagctagagtcagaaggcagaggctttactaacccaaaatatactttcttggtataccaaaaacacaatccataaaagaaatatttgataagctggagtatattaccattaaacatttctactcttcaaaagacactatcaagagaatgagaagatgggctgctgtctaaaagaaaatatttgcaaaatacatccagtgaaggactagtaccaaaatatgtagaatgcttaaaactcaaaaacaatgaaatgaacaacctgattaaaaaatgagcaaaatacctgaatagttacttcaccaaaggagacatacacatggcaagtaagcgtatgaaaagatgctccacatcatgtgtcattagggaaatttaaagcaataacaagataccattacttacctactagaatggcccaaatacaggacactaacaacaccaaatgatgacaaagatgtcaagcaacaggagctctcactccttgttagtgggaagcaaaatggtacagtcactttaaaaaagagattatttcttacaaaactaaacatactcttaccatacagcctagcagtcttgctccttgatattttcccaaacaagttaaaagcttatgtctacacaaaactctgcacacagatgtgcatagcagctttattcataattgccaaaacttggaagtagccaagatatctttcagtaggtgtgtaactgagtaccctcatttttctaaaagaatgaaaatgagtaattttttaaattatgttttctttttttctctttcctcctcttccccacttcctacttaactctttagaaattcaattataacctttatcttcccttcaccagacattccttatagggcgagcttatctaactatttgcttacttagaagctccagagctggaactctctcccaccagaacattgcctcaagagacaacagtcaatgtacaacctaaagtatggtctctatgaaactctctcccacctcagagggtatctcaagacaacagccaccttacaacgctgttctacccatgaaggctccagcttgaccacccagtagataagtcatgcagacccccactcacttgccccttccctgcatgctgtccatgcctcgtttccttttaaaaggccctgctttctgccccaaagtggaagcggtaccctagctttaggataaaaaatcgttttcttcatctcacaccttgctcttgttaattggactctgtaagcagtgagcaactgaacatgtgatttggttatatgtgcagtgaacaataaatgattgtacatccagacaatggaatactatttgttgctataaggaaatgagcaatcaagccatgaaaagacatcgaggaacgttaaacgcatattagtacaaagtgaaagaagccaatctaaaaatgctacatactgtatgctttcaactctatgatatttggaaaaagtcaaaactatggacactgttaaaagatatatggttgttaggggacagtaggaaaggagtgatgaaaggtgtaacatggaagattttcagggagtgttaacaaaaagagtcaaactgtaatttttcttagccaaatatgagtgaccatggtccgtgacacagccctcaggaggtcctgagaactagtgtccaaggtagttgaggtgcagcttggttttatacattttagggaggcatgagacatcaatcaaatacatctaagaaatactttggtttggttgagaaaggcaggacaactcaaagtgggagtgtgggggttgggggtgcttccaggctacaggtaaatttaaacattttctgactgacaattggttgagtttgtctaaagatctgggatcaatatataaaggaaatgttcaggttaagataaaagactgtggagaccaaggttcttttgaagtcttatagtagctgcactgaaagacaatagatgacaaatgtttctaattttcagatctttaaaatatgctagactcttacttaatctcttcaggattgagaaggcctggaagaaaaagatctagctatgttaatggagattctttacagacgcacatttttccccacaaaggacagctttgcagcactgtttcaaaatacggcaaagaaacatgttttgggggtaaaatattttgattttcttccttgtctcgttgtaatgttaggcgccaggggcaggttggaatgtaagtcatatatagggttagataaaacccatctgatgataattgatggtttgtagggcatgactccccaggccccttggataggaatttgggcaagacgaaacaatcagagcttagttagtcctcaggagggaaactattctgtatgacagtgggtatatacgtgatatgttttggctctgtcttcccacctaaatctcatcttgaattgtaattcaagtgtccccatgtgtcaagggaggaacctaatgcggggtgactggattgtggggaaggtttcccccatgctgttctcgtgatagtgagtgagtcttaggagtgctgatggttttacagtgtggcacttccttctctcattcactccctcctgccaccttgtgaagacggtgagtgcttcccctttcctttgtgccatgattgtaagtttcccaaggcctccccaggcatgtggaactgtgagtcagttaaactcctttcctttataaattacggtctcgggtatgtctttatagcagtgcaagaatggacttatatgatatgtcattatatatttttcaaaactcatagaaggtacaataccaagagtgaactctagtataactatggatgatggttgataatgatgtgtcaatgtaggttcactaattgtaacagatgtggcactctggtgaggatgtggatagtgaaggaggctgagcctgggcgtacagggtttataaaacctctatactttctgcccaatttttctgtgaacccaaaacttctgtaaaatataaagcctatttaaaaaggaaaacacataacaccaccaccttagaggcttcaggactgagacttgattcagggaataataaggatctgggggttttgagagggggagtagaattttcaagtctagaaaagacatagctttgaggagatttgagcctatgcaagaggctgactgtaggcctggacagagggtggtgagaacagtaaggtcgttgcaaacatctgaacatggagatcgagtttatctaattaagtgcatgttctacgggagcctaagtctttcctcctacatgatgtccataccaaagataacactgactgatttttttttctctcaggactagctgctctgtaaagactctttcttattttttcaaatacaatttttaaaactagaaactactgtcttctacatgaatctacgatggctattttcccccaggtaacagccttgtgaaaagatcttgtcgagggttgcttgatcagacaatgaaagcatagcaactttcaaagttttacaacaaactgaagctgtccacatgctttcctactccaggcctcaaagtgccctgtgccagatcttggcagccttatctccccttacacagactcatttctattccaagttccgctgcgatcatgttattcagttttttgttttacatgcttttatacttagtaaaattataacactgtgtgtatttctgtacatttttatcctttcaaggttttcaagatttagctaacttgatatgtgttgtatcatatttatttttccctattattatttttaattttatgaatatatcacaatgtattttttttttctgttgaggatcatttaagatgttttcaactttttctcccaatcctatacaatgatatcatggacattcaagttttcatcctcttttgcacacatgtgaaaattccttcaaggtacagagctagtggtagactcgctgtgtcaaaaggtatgtaaataatacaatttattaaatattgtcaattgtcctccaaagagaacatccctgactcaaacactgtgaaatttacaaatttgcaatgtccttgcccagcccttaggagtcatttagctttagattcctgtaagtacgatgcttatggaatgatgtcttcctaaggttttaatttacatttccctgacactatgtcagattgagcaggcgctcatgtatttattggcttttaagttttgtaaatggcatttccatacatttggcccatttttttcaccggattgcttatttctttcattttgatttgtagacattctctgtaaattctggatacttatcttttgtcagtattttgcattgcaaacatctcctcaaagtctggtccttgtctttttaccttgtttatgatatatttggatgaacagatgtttctccatttaatgaattcaaacttatctactttttcctttatggtttgtcctttcctgtgtcatttaaaaaagaaaattcttccaaacctaagctgtaaatataatgtcttacattgtatcctaaaggtttaaaagttttactttgaacagtgggtcttttgtgcatcagaatttaattttgtgtcaatcttttcctcttatggacctttcactcaagtatcctttttcattgccttactcaatcttaacttgttataagaaatcttgattcccacttcctttatgaatccatcatttaacactcaaattcttgctgacttcttcctccctagactgctaaaatatctgttgctgaatttgtaattattttatatctgaatactgagaatgtacatagatcccttcagtggccaaacagataactttcatgagagaaacaggtcagaatggacataatgaattgcgaatggtggaatggggtgaacaacagatacacaagacctccctaaagatgaggctgctccccagacctggccaattattgccggacgaaccacggaaccagatttgccagatcttttaaattttgtttttaaacaaaaaccaggaatttacactttaaaataaaatccattaatttctaaagttggcaacaatttgaaatggtaataggaataacatgaagatctaagatatataatctaacagtgtttattgaccttttttttcattatcgcctccctaagaaaccttaaacatctttttatcccaatcatttacccttggaattaaatattaaaaaataagattgtatcaagaagggttgaaatttggagacagagccacaaatcattgtaccgactaacaatttgttgcccttccccaagaaccaattcttgccttattgacaatgtaggcctaatggtttctagttattacataatatgtaatcatcatttttcttcataattaaggcatgagctctttggaacaggtctctcactctaatccacatagagccaatcacagagccaagattatgatgcatgctcaaaaactgtggaatgacagggaagttcataatcacactcagattctgggagaagaatttagaggaaattctacaatgtgatcaatgtgatctacaatgtgatcatttatcattctagtcaaacccccactttaagaaaatggcaaaaagatgaaacttctcctgaagtcaaggctgtaccactgctcttggggttgggatgtagtcccctccaagagctttctgagatatcactaaccccaatgccagagaaagcagtgtcacagtccccaaagaaggaataaagaagtgggagaagtagagaaggcctctgagcccattgctttctaggagaatccagactccttttgagtatgctcaaggcatggccactgtagttttagctcagccagatttcttaagcttcagtttcttcaccgagtccagtttacgtatagcccatggaatgggtcaaaggcttatttcttgggtccaatcaatcctagaacagggatcagaacattagattcaagttttgtgtgtgtccccaggagcctgggacaaaacagcctctctgatcttcagttttcttgtatgcaaagaatagccataagatcaatcccaagctcagtgtttgcagagatcagtggcatacagttgctgaaagcacagattcagagccccatcagacatgcatttgactttaaaacatgtaacttagtagctggatgacctaaaaaatgttatataaaccctctcggcattaattttgacaaatgtaaaatgttgataataaatttttattcacttgtttgctttgaagatcaaatgagattatagggaacaaatttgtcatatgattaactgagttagttacaagaaaacttactatattataaaagaccaaagatatattatacattatcattattacaggctattttgttctgttgtcttgagctctatcagcgtccaaaaccagtgaaatattctttatctgctatgcaaatttctgggttcccatgagaggaaaatttcagcagaatctcctttttcaataaaatgtgtataatttatctctttgaaggttataattccaaccctgccttctacatcgttctcctgggcaaggagccaaggaggctgcaagtgagcgtgacaaaaatatatccactgataggtggcaaataacaccacaatgctactctaagagcctatacacaataacaaagaccccaaaacttccaaagatgagttcctgagtgtgtgtctcctcttatgtttttgttttctaggtgtctatctcagtgatactttcttattttttcaacatccttatttagatataatttacaaaccgcgacattcattctatgattcttaccttttgtagagtatttcagatggtctgtgtgcatcagactaagtttatataaatttccttctgaatgtgtacaaatatatatatgtttctttctctgtaccagtacttaagtctatatggacctgcatctgtagatctctggatctctttcctatgtgtgatctctgtgtgtgtcggggcggggaggggggggtgtgtattactataagcatggtgtttacttctttgtgtcttgtctatgtttgcatttgtcaatgtccatagtggttctgagtacttgcatgaatgtttgtgttaaaaaagacaaggttgagcaactttaattgggcccattactgttactaaattgtttaaataggcctggtggaaaacatggaccaataattttgaattctgatttttttttcacactaagacccataccttacttaattgggtttaggcgaccctagtcataagcatttttaaaacattccaggtgatgagtctaacgcgcaattctataccagtaaagttgctagagcactgccatccttttggaaatccgcaacctgctttccttaaatttagtattaattacatcacagtggggagagaggttaatttggattctttattggatataaaagagaacttatcctctcctttcctgtggagcagggtattatcccaagagactgaagcctgtaagataacccctaaattaacctatgaaaacagctgaaaaggaattcccctcccaacccaatcctccttccattccagcagatacctgtttccttttatgagtacatctgtctaattctgtctaattaagcagatgtattgctgccttaatttccatataaattcttcagagcctctgtgggagtttggtaaacccaaagaagatttattagtataataaacaaaatgttttatttgcgggggaaaaaagtatatttgcaatattccttccacggggagggtcaggcaagagaaattatctcagttaaatatggaatctaaaaaagtgaaacttatagaagcagagggtagaaaggtggtagccagcagctgcaggggcactgcggggatggccaaaaggtacaagatttcagttacaagatgaataagttctggggatcaaatgtacaagcatgagtaccggtagattgggttaatttcattgtgatgatcattgtacaatgtatacaatatctaatcatcacattgaatatacataatctttgtcaaaaaatttaaaatttttgaaagagaaaatacaaaaggtggtgcagattagagatctaaagttaagggagggggaaaatccaggaagaaggaagaagaaaaataaaacctcagatatgtaaagcttgaaagaaagggacacacatggacaatcaagaaactttataaacgttagcaggggaaatgggccccttccttcaggctgcagactccatttgcagtacggatgagaggagactttggagtgagagactgtctggctgctgactttttactaaacctaccaccaccaatcacactccgtggagatctctcagatactgaggatttgaattctgacattcgtggtgatgaagagtcagtggatagcagactttcacttactgaggcaagaaaaaaattaaaattcccaatattctcactatccactacagcatctagaagtttacatgacacacagtaaatgctcagtaaatatctgagaaataaactggggagaggtctggttttaacaatctgctctatctgaataggctgcatagaggtatctgtctttagcagaatgaaagccaaagaatcaatgagaaaattctcttatgtctctaaatttcttacaaggggactattctatgaaataaagtaattctagaaagaccaaaaacttaataagatagaggtagaagtagggactatgagtcagagtttattagctcgatttaataatgtccacttttatagaagaacaaagtaaggaaacagctttatgccacaacttacctagaaacatcagccatattttaaacaatactttatagcttctaaaaatagctcagatagaggggtttgggtggataaaaataacaactatcatatattggattgtccttatgtactagcactatgatttacatggaaggcccatttcacattcccatttggctcagtaggttggtttagtagagtcgtaattttataggtaagaatgattaaaattcaataagttaaatttacttgcctaaggtcacaagactagtgaaagataattgataattctaactcaggccagttgactctagaacccatataattaaccactactctgacttttcttaacctcaacagtatcaggtgccaaacatacttacaatcactgaggttctgactgacaaaaaattaccaaatgtggtggagaaacttgaatggagactacttaacatgcgtatgatccaacttccttaaacaacacacactaagatacttaagtacagtgcaagatatatactgtctctgtacagatctttgggaataccttataggaaagatatgaaattactttgcttggcaagttttaagataggaaataatgtctgtcccacagaattttatagctgcccttgggactattaggttctatttctgtcattttttaattgagtaacctatagtcctgaataaatttgtccagtaacaaaactagtcaataataagattaggatgagaattgagttctgcaaactccttatctacacatcttttgatgatatcagctgtttaatcttcctgagaactctttagaagcaggaagacagatttgttgacctcactgaccttgactggactaaaacatcccttggatatttctgtccattgatccacaataaattcttaataggaagacaatgtcttcttgaaatgggaattaataggttccttttctctgtaccttggcattgttaacatggaaaacaggggtacaagcattattcagttttattacttagaataaatcctttgggatagtttttgttattttgacctctgacttagactgataaacttctgaggcattgggagggatgcttatactctaataaaatcaaatctctatatcataatctgcaagaaaaaattcaaaatataaaattttttctaattttgttttccccaaaatatccctgaaaaaatcaagattttagagttttatgtagtattatggagtctattaatcaatcattagaaattagcaaaaaaaattgctaaattgattctactttcaattagatccagctttcatctcaccacccccttgtttaataccactgtggctacttagctttaaaatggaacttcaacctattggtgtaaaatttcccttggaaagaggaaaatagaatcttaagacaatgaggatgagaaacagcaatttctaggttaaaacttggcaggttgtagaagatactaatctgaaagtgaccatttgattaaaaaaatcaagaacttgttcctgaggctgggggcacagagaatgaagaaagagttctttaaatgtgatgaagtttcttcttcataaataaaaatgtaagtggaagtctcaactatttaaacaaacatttttactactaatcagatatgtgcaaattaattaacagcaagatataattttacaagaggcaaattagcaaactatatttctcagtgatgataccccatgcaaattcacaacttttcttgatcctatcaggaagatggaattgcaaggcaataagctagaaaaaatgtctaaggaggggaaaaaaaactgcaaggaaagacaagatgcaaacactggcttaagtaagatagacacaagtggacactggtaataagagtttggttgaaaatttggtagaagacaggtatgtactggtgataaagcttaatgtccctgaggatgacagaaattccagatgtcaataccctctttgggatttttttatgtagttaccccagcaagagcttacaaaaaagactgtagtgagtcctaacaaaatgtttcttgaggtacaggtttgggggagggaatagtaaccactgccagagaatcatgcaactccattggacactgttctatctctgttatgtgagtcgtaaaatataatgggttgaatagtgacctctcaaaagatattcatgccttaattcccaaacctatgaaattaagtcatatgacacaaggtataattaaattaagggttttgaaaacagaactttatcttggattatctgggtgggccctaaatgcaataacatgtgttcttataagatagacacacagaggagaagatagaagagagggtgatatcaagactgagttagagctataagcctaggaatgccagggccatccctaaaagttggaagaggtaaatagtggatttttttttttttttttttttagagtacccacagggagcacaaccttgctggattttagacttccagcatccagaattgagagtgattattttgtcttaagccaccaagtctttggtaattttttagagcagcctcaggacactgattcagagggtaacaaactgtggcaacttaaggacactagtgaaaacctattgcagctagaggagggaaacagattaaaaaaaaaaaaatctatccctggagtaggggtggagaaaatgccgaatcaagatctatagccatggaatatcaggagtattggcaagaccacacacccagggcccattgtgcctgctaaaaccaagaagtaatcagaataacaggcaatatcctgcatgcctctcactaggctaacaagattcaaatcataaaaaactggaaaataatgttgtacaaggataggaaagggacatgagtatgaaaaatatcctttcagaggtggaatgcaaaagctcagtgtgatgtagactatgagaaaaactatctgacaaataagcccctactctaaacagaaagttttgctagaggaattgaaagcctgtgacccagcaaagataatcacattaataaacttcaaatccagcccaaatcccaactaaaaaaactcaaatgcttacactgaagtcctatcaggaagaatgctttggccatttttagacatatagttaatcacacaagtctctactattcttatcaagatattcacctttccacaaaaatatggtatattaaaaataacacacaaatacacaacataattccaaagacaaagcaatcagcattagcagaatcagatatgacatagatgttggaaccatgccacagcttcaaaacaaccatgactaatatgctaaaggttctaaaggagaaggtgaaccacacgcaaaatcagaagaatttcagcaagaacaaaaaggaaaatataagaaacattcaaatatgaacaattcaagtgaaaaatacaactgagaagaggactgcttttgacaggtcatcagaggactcagtagtgctgggtagaaaaaaatcaatggctgtaaagttaatgacatttacatagctcgaggagaaggctggctgccccaccctaatcttattatgtaaatgaactttccccttggcccgtgccatcttgtctgctccttactgtatacctggctggcaaagaagagaagatggagctgccattttgaacttgactggtgcagctgttggcatctgcgtctgcagctcgactttacaggctgctctttgttagaaatgaaaatgattcggggctgcctttcattaaaaggaaaaacttactgaggacttcggtatcctcactatcagccaaagtaatttcttcttaactcttgtatcaataatgatgggaaacttggatctgcacaacaaaatggccagcattgtaaatgaaataaatgaatataaaagtcatttttttaaatttgtaattgctctaaaagataactggttatttagagctaaaataatggcagttaattttgtgtttttaatgtatgtaaatgtaaaatatgtagtaataatggcacaatgtatgaaacagaagacttgggaatatactgctatgagctcttaaactacatgtggagtggcacaatgttatttggaggttgattcacattgtttagaaacactaaaaaaattcttgagcaggaaggatgtgtgtatttataacatatattaaatatttgacagcgatgacacaaatataggaagacttgagactacataattgtatggttctaaaattacatattaaaactatataacattatatgaaggtaatcttcaaattaataaagatatataatttaaatcctaggaaagctactaaaattttttaaaaggttttaatgataagtaagtagcagagataaaatggaatcataatatatttaaataatgcaagaaaagacagaaaaagaaggaaatagaaacaaaattgaatggaacacatacacaaacaaatggcagattttagtttaatttttatcaataattatattaaatgtgaatagtaaacatactattgaaaaggagaaatcataaaattggaaagaaaagcaagaccacataaatgtcatacacaataatcccattttaaatataaagaaatgttttccaattgtatttcttacaaaaaagcttcagttgagaatatagaaggtttcaactcaaaataagaccaatagcccaataaaacatgggcaaaatatctaaacagacagtccaccaaagatgatatatgaataacaaataagcacatagtaatatgatcaacatcattagtcactggagaaacacaaataaaaaccacaatgagagaccactctaaacctactagaatggcataaatcaataagtaaataaaatttaaaaataatagcaaatactgggagtaaaaggagcaactggaactctcatacatcactggtaggaatacaaagtgatagtcactatggaaaagaaaatagtttggcagtttttcataaaattaaatataaacatatggtaatatgttgcagatattctactcttaattattaacaggtgtgaaccccaaaaatctgagacacgtctcagttaatttgaaagttaattttgccaaggttgaggatgcacacccatgacacagctgcagggcatcctaaagacaggtgtccaaggtggtcagaacccagtttggttttatacattttagggacacgagacatcaatcaacatatgtaagatgaacattggttcagtctggaaaggcaggacaactagaagtggggaaggggacttctaagtcatatgcagataagagacaaatggttgcatttttctgagtttctgattagcctctccaaaggaggcaatcagatatgcatttatctcagtgaggagaggggtgactttgaataaaataattcaaagcttaggcaggtttggcttaagcagttcccagcttgacttcctttagcttagtgattttggagccccaagatatttttctttcacatggtaatctacccaagataacagaaaggtatttacacacacacacacacacacacacacacacaccactgacacaaatgcctacagcagctttattcaaatgcgtcaaatttttaaaacacttagtaaatttcaagcagtgaagtatcattgtatacccatataatgaaacactactgagccatttaataaaaaggaaaataaagagagatagttaagtaaagaagcagttcttatacaatgatatgaataaatctttaaaacattttgctaggttgtaaaaagcaagaagcaatagtctacttcatatgatttctatttgcaatgaccaaaatcacacagaaaatagaccaacaatggctagaagtgtgggtatagtgggttgctgactaaaatggagaagcacaaagaacttcttggggttatacaactgttctacataaaattgtgttggtaaatatctaatttctggtagagttttttgggtgttttcaaatggtagaactatgtaccacaaataatgaatttaactgtttaaattttttaaaaatctacaaggatacggagggaactcaagatagaatgtagattgtaacaaatgattctgagttatcaatgaataatctcactcctttgaagaggatggacctgaataaccattttcaaagctattttgattggatgctgtaagacttaagacaaagaaaaatcacaaacactgcgtgtggtcgataaacttgtttaagagcaggcaagtctatatgcacactagtgttgagtgacagtttcagagaaaccataagagaaagaagttacaaataagagtgaagactagaataaataaaacctcctttgctagattggaatcagatgttattatggcctatttaaaatatatatgcaaaaagacaaaaataattatttatatatatatgtgtgtgtgtgtgtgtgtttgtgtgggttattatacattcacgcatttcctagctctgtttgttgaaagaatgcaggaactgtgacaccacagtagcattgaaaacaccaaacacctaggccctagtttataaataccacaccccaataaaacaacttactaggaaaagtgattgttttcaggacggataggcaaaacccaatgtgacgtaggagcatcttgtggtacctaaaagaaagcaagcctcttcaccatgtgccagatagaatgggtacatattgcaaggagctaatctgcaaaaactacaacggtcacagcaagaataatattagcaacataaataatgatagtattggatcataatcaaagaataatataaatatccatgagtccatgctaatgtaagtacataactgaattaataaataagtatgagtattgggaaacagttctttcttacaaaataatctcaattaataagtgtactaaaatgagaaaactagaaaatcaccattacagcatcatagaaatatttggtttggttttgaaatacatggatttaaggtttttgaaattgataagatgcaaaggctattcacatagttttgtactatccagtggctccaaaacactcattaattacaggaaagtagttgtggggataataccctctcatatcatgcccaggggtctcatgaactttacataattaatcagctctatctgatttcaaaaaatatcaaactcaaattgaaaaatattctacaaaataggtaaccagtattctacaaaactttggagtttatgaaaagaaaagtttaagaaaatgtttcatattgggggagactatggagacatgacaactctaaacatttggaattctgaattttatcttggtacagaagaaggattttcatgtaaaactgggtgaaatctgagtaactagttcagtaagtggcattctctctgttaacttcttaattttggtaattgtaagatggttatatataacactaaaattaggaaatgttgaataaagaacatctgggaatttttagtactattttgcaactctgttctaagtctaataatctcaacatagaaagttaaaaatatataaagcacagtcttatcatttttagaaatttttaaaaaataacttatataacattcactgtattatgaaaagttaggaaagtaggtgggtaagtggagatggaaaataggtaagtaattaggttaggcaaggtgagttggtttgaacaggtaagtaggaagataagtctgtagagatagctggattgagcctttggaccttcattcattctaccactctcaaaccccctaaccacagccatagttcatccatgttttagacaagatacaaagtggggagggccacagtgagacaggttaagatttgggaacctgagtacatggtaactactggaaggcagagttaagaacatcaactactgtgttgaaactgtccataaatgaaagcatgccaataatgtgctttacaacacagttttctcaataatacatccccataatccctaattctagaactctgtatggaaccctagactttacatagtaattcttagccccaaggactctgtaatctagcttctagaaatgtccttgacaaccaaggtgctcaattgtttctatacagaacttagcagcaaccagaataagaagagagggggttgtggaagggaaggaggaaagaaaggggagaaagagagagatggagaaagagagagatggggagagagagacagaaagaaaatgagcaatcaacataactgaaatgttccttcaaggactctgaacaactgattttagcaatcctatttgaaatgattccaggaaattttaaactttagccaacaataattgctttttaaaatgagtaatgatcccgatgtattacgtgcatttgtagagtacatgttgtccacttttttcttttgcacagctttatagaggtatgattgacaaaatgatatataaggtgtacactgtaataatttgactatgaaataattaccataaccaagctaattaacatatccatcaccacatagttacccatttttttttttttggtgagaatacttatgatttctcttagcaagtttcaagtgtacagtacattcattattattgactgtagtcaccatactttgcattagacctctaaaaattattcatcttttaaccgaaggtttgtaccctttggctaaaatcttcccatttctcccactcccccagaccctggtaaccaccatactactctgtttttatgggttcaatatttatacattcctaatgttgatgataatacgtagtatttctctttctgtgtctggtttatttcacttaacataatgtcctgtatcactcatgttgtatcaagtggtagaatttcctcctttgttaaggctgaataatatttcattgcatatatacgcacattttccttttccattcaaccactgacggacacttaggtggttgttttatcttggctattgtgactaatacttcagtgtacatagaactgcagatataactttgaaatactgattttatttttatttttggatatatacccaagagtaggattgttgtatcacatagtaattctatttttacatttttcagttacttccatactgtttcccataatgggtgaatcgatttgtattcccacccagagtatacaagtttttttttttttcctacatccttgtgaatacttgctgtctttgactttttgataataggcattctagcaattttgaggtaatatttcactggggttttatttgaatttccctgacaattcattatattgaaattttttttcatatacctgctggtaatttgtacatcttctttgggaaaaatgtctattcaggttctttgctcagtttttaattaggctgtttgttgtcttgttttgttgctattgtgttacattaattccttatgtgttttgtatattaatcccttatcagatatatcatttgcaaatatttttccttttccataggttgccttttccttttgctgatttagtttaatctagttaaaggcttaaaacaaagagttgagacccaagtaaataaaatcagataatgaaagaggagacaatacaatgaattagaaataaaaaggataatatgaaaatattattaacaattgtaggccaataagtccaataaactggaagaaacagataaatttttacttatatacatcctaccaagactgaatcatgaatgcatagaaaatgtaaacagaccaataacgactaagatttaatcaataatcaaacatccaccaacaaagaaaagcccaggaccatatggcttcactggtgaattttaccaaacatttaaagacgacttaatgccattcctcatactttttcaaaaaactaaagagggggtaacatatccaaactcattttatgaagccaacactaccctgataccaaagccagatgaagatactacaaaaataatattttaggccagtatctcttgtgaacatagatgcaaaatttctcaacaaagtattaccaaacaattcaacagcacattaaaagttcatacatcatgatcatgtgggatttatctttaggatacaaggatggttcaacatacaaatcaatagatgtgattcaccatattaacataattaaaaatataaatcatatgattatctcaacagatacagataaagctttttaacaaaattcagcaccctttcatgataagaactatcaataatttaggtgtagaaggaatgcacctccacatcataaggaactcttttttaatatatatttttttcttccattttttaaaatatcacaggccctactgtggtaactttgaggaacataggtaagtttcttatgagccatttacctgtttgatcatcatacaataaaaaataagtcaaagagaagtcaaaatagaaactatttgaatgttgtgtaagttagtaaaagttatcaactcactggccatttctctaaacattcaaagaaagagcctggataaagagagtgaagtaaaggtgcttatatcaaagaaagaatgaagttaaatgtatacattgaacatgttggcctcacctttacaaggtggtcacaagccatctaaacagaatcaatgaagcagaaatggaagatctggtacttaagaactctatctcctctcaaatgcacatcttttactaatagtattttccttttgtgtaatttaccataactgagtcacctggaaacccatagttgcaaggaaaactataaaaggggcaataacattaatgcaattaacactacccaccctgccaccctcttgcccagaaaagaaaaaaaattactgtcaagaagaagcactgttaggtagaaggactactgggtagactataaccaagagtgtcttccaaagctatttattttggctgaatcttttcatccttctaagactgtttctgaaagagacaccaatatgcaaattgtagtcatgtcatgaaccctcatactatctctctttaaagattaggtatgtgctcccatcctagttatccgattgaatcaatcagtgttaaaataagctatctgagtcagctttcctaaatgtgcttcactgaagattagtcctaaaataaagcctaagagaaagacattgttgctgtaaactatatcggggattctcttacacacagtgatatgttaaaggctctgaacaagttctgttgttaaaaatatttaatacgatgttttccaaatgacaaaacatagtttgtgtaatacatgttaccatttcctgtaattaatttggacaatattgattaaacgattttccttctctcataaacttggaaaaccaatcctgattttctacagagatgttttccaataaatccactgatatttcagtggatttctaacagtgctcatttctaacagtgctgctcttcaaaattgttcatgtttttcattattttttagttcaggcaattgtatgaggttggaatgaaaaagggaaattgctcttttctagttaacaagtctctggcagaaaccaataggttttaccaggtaaacaaatttaaaaatacgatgtcttgaaaaatggaaaaagcaaataatatgtgataacattgagagagattaagaaaaattggaagcaatttttggtgtgattattcaaataaaaatttcattaattcattgtaaatacagccctgctttataccatagctgtgtttccaggaaagagagaggccatagacttaatatttatgatggtatttcattttattttatgcctttctccctcctcccatcctactttaacttttattgaatactggcctcaagtagttgaacccaagctaagtcaaagtctaaatctaaagacaggctacgtcttggcgttcagtaatattgatcctagtgctcatgtcttacatgttagcagacaaactccacatttcaaggggtgagggaggtgggtaatgtgatcattagatggtgcacataaggaatgatcacagtctaaacaggccagttagacaaacacttggttcaaataggaaaatgagaaagtactaagaaactaacacaatcaccacaaaaatcccctcacactccaaagactctgaagaagacataactttgatgtctgatgaattatccaacagtaataggttttgataattcacaatgaaatgccagaacttttcaccatgattggtaaccttctccccacaaatactaaattcaaacccattggctgtcaagagagtcaaagtcttatgacctagcagcattttactgtaaatcctaactgtaaaaagacaggcatatctgagctttagagctcatatttctttaacacacacacacacacacacacacacacacacacacacacacacacacagagagagagagagagagagagagagacagagagagagagagagacaaagagtgagaaagagagagagagagagagacgcttgccttgttttccctctttctctgatggggtgcatcctcagcttaacactgaatgttctaggctaagaggacagcacaaatgggtggaaaatctggagcctcagagaagtctagtgaacatgtctgaaagggaaatcctgcaagtaatttaatgtaattcttactcagaagtggccaacattcttgttcaattccattttatgagaatttccacgttcatgcagatgcatctaaatgttatcaaatgcaggcttagagtatcaatatcttggtaaactctcttccatattttaggtcttccacatctattccttccacaaagtttccccttgcactcttagtccttgcctcaaagaagttaacagacttatccgagaatgcacagctattaattagtagagctcagatttgaacaaaggtctatctaactccaaattcatcaaggctctgaactctctgtaacagcagttacattctgactctctcatagtaggaggtggacttgcaaatcccagtccagatggtcctagtgtaggctccacaccattaaagacttcatttctgtcatctgcagagagaataccgggattgttggtcacactctggttagtaaaatccatgtactttcacataatctcaactttttagcctagaatcatggaaatattggtgaagtaagtggaagaacactgtgcagaagatttgaagaaaaaaagtaattgaagaaaaaagtaattgaagtatctcacagtaacatctccacagacgaccagctagtggctttatgtgcagtttcaaaccaacattttggacatgccccaagcaagtgattctataaagcgaggttcaaagtccagtcaaatgtatgatgcagcttacacattgactttaccgtgacatgtttgtgtgagtaaagcatcgggaaaacaactcctcttgcatttatttctgacaagcgctagctattttctggaaggcacaagatgctagaagatctttcttcaaaagaaaatacaatttcttttctgcttagggtgcctaaagccgctccttaggcctggatctagcgtcaaagcacactttaaatcaaaatctacagaggactttttatcttttgcacattctagggaagttagctgttagatttgcaaattaaaacataactagagtgaggatttaaacaatttactcagaaatgtactcaggaatttgatactgttgctgccatcaaatttgctgtctctgctgggcatagtggctcatgctggtaatcctatcactttgggaggctgaggcaggaggaccacttgagctgaggcatttgagaccagcctggtcaacatggtgagaccctgtgtctacaaaaacaaacaaaaaaatagctaggcatgatgttacacccctgtagtcctagctactcaggaagctgaggtgggaggatctcttgagcccaggaggtcaaggttatggtgacatatggtagtgctactgtgctccagcctgggtgacaaaatgagaccttgtctcaaaacaaaacaaaaaaaaaaaaaacactcacaagaaaccattgctgtttcatagaaaaatgacttagcagaaaatttccataatactttcaattcttcatcatccctccagcaccacctcacttaatctttaccgtaacactcgatgcatccattaattaaccttcagaagaattgaagtgctctgaggatacttttaaacaaaaaaaatgtgtggatcaaaccagtcttctcagtggtgaattgtagctcagtattccaattgtgctgtttcatgaccattttgctctaaagctttctcactgaacttcagaaccagctcacaagttctcttccctatcctgaaggaactcctctcacctgtaaactcacataaccctttgtttattcttgtcttgtgtcattgataatctgcctttctttagaaaaccttattctaacagcctacagattccatgaaaagatactggactttattcatctttgtgacctcctccatatctagaaagaacctgactcatataatatattcttactaaatatgaatatgtttccaaaacccagtactttgacagctagttccatttaaatgatcaaacactacctaaacattctgaaaagtaaaaaaataaagaaaaggaataataaaagtttaaacttcagtattaaatggacttagactcagattcagctctgaaaattactacctgaaacacacaatgggcaatgtttgcaggctcattaaatttcatattttccttttgtgaaagggggatattaatgcaacataattctcagggttattgggaagaaacacaatgcctgccattataataaatgactaataaatgttcactatttatatttggctaaatgtatcagggcatcctctcactctccccccatctcctctgcaaattgagcacttttgcttccaatcgagatcgctaatgttcagcagccacccctgcctttttcagtgacaaccacctctgttgaattcctcccaaggttactaacagctcaagcaaagaatgttgggatatcaaatattctgcaaatattcaaaccacctcttgagtaaatcccagtccctgtgaatgaacctcccttaagcagcatttatttgagagagtgggctgatttgagcttccttggggagatacaaaattgagagaatggaaagggattttaattgcagaaaacacacgcagagcttcaaaaacagatgccagagtccttcaaagctgtttatgcttctttacacattcatttactttaccaaaattttacttttggcaaattcaggacttttccactgtactgagcaagcatttaaaacaactgtttctactgtaagcaaaagtcagcagaggaggaaagaatgcagaggaaaaattgctgaagtcttcctacaaactggaggatcaggaccaatacatactgcttatataaaagttgtgacccacagggttcatgcctggaaccctttaatgaggccattaaagacacataatccagatatactaaagtaattacacaaaatgacttgagtctcttcatatacatattttaaaacctactacaataactcttcctccactctccttaaaaccccattgaaaacctactagccctataaaaatacgtagctttcataactctaggtaccagtgaaaaatattagacagagatcgctatcattattttactttattcctattgtcttcctccctttccccttctccagatgcttcctaggaacatgagggaagaaaagagattgagagaaacaaaaaattcctctgtaaacatcatgggaaaataggaaaggcaaattctgaaaatgtcatattaataaatctttttcagcacataaaattaaaatgtaatacttgactaatattgggatatttttattgccttgttatcaactttcctcttggtccagcaacagattgcctacaaacactcacatgtattaaaaattatttgtctttcttcttttaaattttatctcaacttcctttcaaatagtagtacctgagacttagaagtctttaccctaatttaatgctgacctaccaagaggatatatgagtttcaacttagagaataaacaagtgttggggggttgtaaaagttttctttttacggaagtgctgatagttggttaaagaacactagtgaaccatttattttaacagcttttcatttcctgtttcggtttgtaatacctgtgagacttagaaagtaagtgctatcctagacaagtttcatttggtaaacattgatccatttgcttttattctgattagagctgaaataaactgttctctctccctattttcattctgtgtcatcccagttggaagtcctgagctgagccatggctttcgttcaaagtgctttcagcataagcaccgcaagatccttaggtgccccactttcttatttcagcaaagaacaaaaagtgaaggtttgtgttgcttcctcttgcacggaaaacaacaagcctattttagaaaaggagaaaatctaatccttttgaggtaccatataactcttggataaagtgttcttaacagttttctgacagacctcacttcaaatcatgggatgatcatctgaccttgagcaactgacctcatttcatcggaccagtttctccatcagaaaaataaaattaacaatagtactctcttcagagcatcattatgaggattcaatataacagtgtttaataaacagaagatctaggaaaagtcttattaccttattacctatggattctcttcacatatggtactaggaaaaaaataccactgggaggtattatatatacttccccagaccaatgttatatttctgagagatgcatcaaatatagtcttctgtgtgtgttaggggtgggagtgagtgaagggtccagataaaatataaatgacttgataattgttgaaaaagaaataaggtacataggagtttgtcatattatcttatttttggataagtttgaaatattccataatcaaaatattaaaacaaacagaaggaaaacaaaactcttgggatgttggtccccaggactgtgggagaggcaaaaagatcacataaatttggtttttcttgtatgcatacattccttgtatttttgtctagaaatatcttatcctcattcttgcctgtatttctgccagaacacgttgctgcgtatgtgctttttaagcatctctaagaatatacttggcagtcatatttccccttagagaagtgggaggcagagggcacagaggaatcttgattccccaaggaaaaaattttctccttggttattaacatgagagctgccccaggttgctgagagattacaaatcacatctctgtttttgggggcccttgagggaaaggaggccagggaaacaaactcactgggaatgatgtgtggcatccatggaagccatctggagatacactcgtaaaaaacgcggtgttgaaaagaatatggcagcagcttctgctcttcttctggaattggcttccaaccttcttcatttaacctcctttagcccaaagtgcaccataggctgagaattccaaaggccttgttttgacatgaggcattaatcaatgttatgatacagtttctgcataatgggatgctttcatgtcaatcaaccactgactcagacttctacgactacgaacaatccaatatgtctacattcgtgtggttcatagtttgtttgatgtctgtcttcactgagaaaaattatgacaaaaaattttactcctcctccccttttttaagggatttggacaagaacttaaagaagacatacaaaaatgaggctgaacaagtcttggtcccagcaagtaatggtgtattaattatctacttctgcataacaaatatcaccaaagtagcaacttaaaacaacatttgttattttctcacaggggctatggtcatcactggatcacctgagggaggtttcccttccaagttctcacatggctgttgttaacattgaattcctcataggctgttagactgagaacctcagttcttcactggcaagcctactctagattgctataataagccaggtgattggtttcattaattattatttttgtcttttcttcttgatagggtgaaaaccacaagtttactgtaaaattcaacttacgatatttctacttgggaaacctgcacaccccagcctcaaaatgcctcagtgctacactgatttgagttgcctggccaacctctactgatccatcagatctcaacttaaaaggccttctcataaaattagttagggaggagtccctccttttcaattgtttgaaatagtttcagaaggaatggtaccatctccatcctgataccaaaaccgggcagagacacaacaaaaaaaaggaaaacttcaggcccatatccctgataaacatggatgcgaaaatcctcagtaaaatactggcaaactgaatccagcagcgcatcaaaaatttatccaccgcaatcaaattggcttcatccctgggatgcatggtggtttaacatacgcaaattaataaacgtaatccatcacataaacaaaaccaaagataaaaaccacatgattagctcaatagatgcagaaaaggcctttgataaaattcaacatcccttcatgttaaaaactctcaataaacatatatcgaaataataagggctatttatgacaaacccacagccaatatcatattaaatgggcaaaagcaggaagcatttgctttgaaaactggtataagacaaggatgcgctctctcaccattcctattcaacatagtactggaaagttctggccaggcaatcaggcaagagaaagaaataaagcgtattcaaataggaagagaggaagtcaaattgtctctgtttgcagatgacatgattttatatttagcaaacccccatccccatcatctcagcccaaaaactccttatgttgataagcaacttcagcaaagcctcaggatacaaaatcaatgtgcaaaaaatataagcattcatttacaccaacaatagacaaaagcagagaacaaaatcatgaatgagctcccattcacaatcactgcaaagttaataaaatacctaggaataaagctaacaagggatgtgaaggacctcttaaaggagaactacaaaacactgctcaaggaaattagagaggacacaaacaaatggcaaaacattccatcctcatggataggaagactcaatactgtgaaaatggccataatgccaaaagtaatttataggttcaatgctactcccctcaaactaccattgacattcttcacataattagaaaaaaactaccttaaaattcatacggaatcaaagaagacctcatatacctaagacaatcctaagcaaaaagaacaagctggaggcatcacactacctgacttcaaactatactacaaggctacagtaaccaaaacagcatggtactgacaaaaacagatacatagaccaatggaagaggatagagaactcagaaataggaccacacatctacaaccgtctgatctttgacaagcctgacaaaaacaagtaatgggaaaaggatctcctatttaataaatgttaccaggaaaactgactagccatatgaagaaaattgaaactggatcctttccttataccttatgcaaaaattaactcaagatgaattaaagacttaaatgtaaaacccaaaaccataaaaattctagaagaaaacctaggcaataccattcaggatataggcaggggcaaagacttcatgatgaaaacgccaaaagcaattgcaacaaaagtcaaaattgacaaatggaatctaattacactaaagagcttctgcacagcaaaagaaaccatcatcacagtgaacagaaaacctacagaatgggagaaaatttttgcaatctacccatctgacaaaggtttaatttccagaatttacaaggaacttaaacaaatttacaggaaaacacaaacaacgccatcaaaaaagtaggcaaaggatatgaaaagatgcttctcaaaagatgacattcatgcagccaacaaacatgaaaaaaagctcaacatcactggtcattagagaaatgcaaatcaaaaccacaatgagacgccatctcgtggcagtcagaatggcgattattaaaaagtcaagaaacaataaatgctggtgaggctgtggagacatagaaacacttttacattgctggtgggaatgtaaattaggttcaaccattgtggaagacagcatggtgattcctcaaggatctagaaccagaaatactatttgacccagaaatcccattactggatatacatccagaggaatataaatcattctactataaaggcacatgcacatgtatgtttattgcagcagtatttacaatagcaaagtaatggaaccaactcaaattcctgtcaatgatagactggataaagaaaatgtggtacatatacaccatggaatactatgcagccataaaaagaaattagatcatgtcctttgcagggacatggatgaagctggaagccatcatcctcagcaaaccaacacagtaacagaaaaccaaagactgcaagttctcactcataagtgggagttcaacaatgagaacacatggacacagggaggggaacaacacacaccagtacctgttaggagttggaaggtgaggggagggaattagagggtgggttcataggttcagcaaaccactatgacacacgtatacctatgtaacaaacctccatgttctgcacatgtatcctggaatttaaagtaaaatcaaaataaaataattttttaaatgcctttcttgtgaggatatttttgcctccctgaactaggttagtgtccctgtggttcaatcttgtattacctttaccttgaaaagacactgatccactataattgatcattatttaaggtatctacatctgcaaaattgcaagctaaatatcaggaggaccgtgtctgttttgctttcgcttatattctcatagtgaagtaaagtgtgagcatacaatacacatttttttaattgcttacttgacaactattagcacatattgagcacttcctatgttccaggtagagtagagaaggcttaagttcctttctgactgttattgtctataagggaaaattttgttaggtttgtaccactttgatgagcttaagtatttgcacatccaaatgatgaaaaacaaacattgccaaaaaggtacagtctatccaaaagaactacaaaagatgttacaatttccagtctttgtttcctaaacccagcaccattggtagtctggttcatggacctctcttctgtactgttgaacaaatataaccactttggccccaggagctgctaagtctggatgggtataggaagcactgggcctctacccgactagagtggggaaggaataaattaagtggtggttttatagccctgttaggactctgtcttgcctacctgtggagtgtccttaacaaagaagagaggatgccttgagaagaagaccagtctccttgggcttccttaaccctggtttatggcccatggtcagaacatcaacctggtattttattttagaagcatgatagaggtgaagcctctgggtggtagaaagacacagctaacatcttctcttcccaggacttcctgtttatgtgtatctatgaaaataagcatcaaacatgaaattggagtatgtgaattttaatcttcctgctgctctctaactggctgacttagataaagtaacctttcctttctgaatctcagatttttcatctcccagataaaaaacttgggctggacaattgtacatcctcttgtagttcgggtgatataatttcctttaatccatgacataaatgattcctgctgtctccaccgcctcctcatcatgatgtacccttctgaatactttccagtatttggcagtcacattccagccagagcacatcaaggcagaataatcttctagcacagaaggtggtgttcatatataccatctgagcaccaggaagcctctggtagcttttatagcacaagggaatgatttatccacactctttccctggatcctatattgggacaccagcactcacttctgttgagtctgtttctccagaatcacacactttctatcctggaatccagaaataatggaacacggacaactcctcctttcataaagtagatgctcagtaaatgcttatatatgaattttaataaaataatataggatgagtggtagaggaataaagttccattcactgtctccttccctccttggctctgtgagaacattcctaatcatgctgttatgatttgaaagaagcaaggtctccagagttgtagaatgataccttgcaccggaatgctttgataacagattttagtttcagcaaactaaaaatgagtatatggatgttttactaataaaaattaaacataaaactactatgtactttttgtgttttctaaattggcaacctaaagatataaggctcaagaatgcagagctgaaactttctcatattcccttgtctccctgttctgtcttctgcctccctgttctgtctttattctctcacttttaaaaagagaataaagccctcgacccgttgctttttccttacttccaaaaactatcaaagactgataaaaatgctagggaaggaatatctgcattttactgtagaattctccttcctcagaacctctaagcctttcctccatacctttctgaagatgcaaaaagtcacactgtggcatcgcgtcgcccatgccctgttggagaggagaggaaatcaaatccatgccttagagttgcaccaaccttttccaaaatgtacttttcctgatttttagaaaaagagaaccttgaattgcatgcatattgtatagagaaaatgctgtcttttttttttttttttttcatgacgaaatctcgctctgtggcccaggtaggagtgcagtggcacaatctcggctgactgcaagctctgactcccgggttcacgccattctcctgcctcagtctcccgaatagttgggactacaggcgcccaccactaagcctggctaatttttgtatttttagtagagacggggtttcaccatattggtcaggctggtctcgagctcctgacctccggtgatctgcccgcctcagcctcccaaagtgctgggattacaagcgtgagccaccgtgcctggcttgtcctcttttttaaagaaacaaaaaagtcaataaacaccaatgctctgaaacttttaaagaagggaacaagattaaacttttgtaaacagtgattaccatagactaaaggtttggtgtgaggattccggtctagaaggtccctatattccttaagaccatctgtcctcctagaggagaacagcagggcctgagttttgatggtggcccctcaacagagacatgcagcatgttcaatggctgggagaaacattgtcctcttctctaggtggcagctgctctaatggaaagaacactggattgaatctaaccaaaccagccattcaacttgcaaaagttgtgcaaagggaaacaagagtgcatgcttatcttaattgaatgttgagtgttgtgaggatgaatttgcatgatgtgaatgtgctttataaattatgcatgggaagataaatgggggtgttttaattgctttcaatttatatgattatcagcactgagaactgactatatgtcaggtactgtggtattcactacatatatctaaacccacttactcttccctgaaacattgggagacacgtattatgatgctaatgctacaaagggaggcaggaggactgaagcccacaaaagttgagtaacttcaccactattctatgttgtcacatagaaattctgcagctcacactcaactctctgcccccatactttaaattgcaacagcaattcatctcttttccttgttttcttctgtcttccatgtaatgcacataggacaaggaaaaacctttgacacagatcttaactttcagtaaagttttaactaatacccctaccatatcatgcagattgactgccaatgtgtctctcttgggtctcagctgacaatacactctgcctgccctgtgagatggaaattcaggactaggagtcacgaagggaacaatgtgttgagccaaaaggtgacattttatgtggtccctttgtgggttgtaactacattccctttaatgcccttttatttctcactctcagaggtgggggagcaagaagggaattaattatagcgagccactattcctgcctgctgacagaatgttgctcataaactatgggctgggaatagacgtccctataaaagcataaaatgagaggccactcctcccatagaaatgactaaggatgggcaagtctctacttttgttgagaaatactcagactactgaaagggtgctttatttctcaatctgtggccacagttcttgaaatgacaaggtcatcagatgttctaaaatacctgctcagttgcatatatggacccatattgtatacatgccaggcataaatactacatatgtgtgtacacagacatatgcattcacacacacacacacccctgaaactcaagaaggaacgaatcaggacttatattgctggccctgagtctgacagactattcttcaaattccaagtccattataagttaaccacattctttgtaaaacttgtacattaatagctttagaaaaatacaatagaaatagatatgtatgtaaaaagtgacatgtttatagtgtgttcttttttcagctttattgaagtataattgacaaaaattgtatatatttaagatgtacaacttgattttttatacatgtatacatgtgaaattatcaacacattcatatcaccatgattctaatctcactctttctctttgtaataaataagcaatttggggaacgtaattcaaaattatgtaaaaatccagtaaagatttaaaagccctaaaagacacttttgaacataaagcgatgaacatggggtataacttttaaaatctcttcatgtgaatataatatacagccactctgagaactattatcccagatgtactgacttgggaaaatgtctgtgcaagaaaaggaattgtatgcagactataattgcatcaccaaaaaaaaaaaaaaaaaaagaatgaaaacatgtgccaatctagtaatgcatataaacaaacattttaaaactctgaattataggaatttgataatgctgggtatttataaacagataagtgtttattgcattcttccctattttttcttgtatgcttatattacttaataatgatattttaaataatatttaaaatctatataagtaaaatcttaacacactggatatctcccagtagtaaaaatagaaaataatgatcatttttaaaattttcacacttgtgtattatttcaatttatttcaaaatgtgagtactcttcttggaaaatgttgaatgctgaacgtaatacagttttttaaaaaaactgataatgaaattaagtctcatgcagttagcttattagctttcagtcaatatgctattgcccattcctacctggctgcctcatgctaaagtgacccctatgggtcttcttagttttttaagcttctcttagttgattttaatacaatatctcatagttgtgaggcttaggaaagaaagcatacaggtagtgggacgaatgtgtatctcctagatgtaaaaggagtctcccactgctccagtatgagacctgctttagggaacatcagtgctccaatgctttatcattgttcataccacatgcaaagaaatacaggaagaattctttaaacctagtcaatgagaagatgtaataggagagctgagtcccaggacagatatctgaaacatatctcaagagtcttcattatgctacctagagggaaaaaggagactatatagtaaataaatacattcaaattttatcaaaatgatttccagatctcaaagaaatagcaaaaacaatatatttaaattggttaaaaaatgagcaagattgtgggatactggtacactcaaatgttggcagcgaagtaaattgtttctataattcgaaaggagagtctgaccaggttacaagagccataaaaatagctttgacctagtcatctactgctgggaattttcataaataaaaattaacgttaaagcaaacaaaaaaaagtctaacatctagaagttgctcaaatgccataggagtttgtaaggtaaatttcagtgtgtcggctcaatagaccattgtgtaactgtaataattaaactctctgaagcaccatgattatttttggggaagttgatatgaaatcatcggggcagaaaaaagctcttagagaaagatcttcatggtttaggatactcagtatcaattttggagattccctattcatatcctaagacctgaaatctcaactgctctttcagaccatgctagaacccaggcttggttctcatgcttgcctctccaaggcatgctcttcaccagcttattatcagactgaatttctgagaaatcagcagatatattcttgctgtctttccaggagtctaataggacttttgtaatcttccatgttcctgacctggagaaattcagataatctagagcataaattgtttttagaagagctaggccctgccaatcccagccattcttctccacctgccttcctgtttgacaaaatcactaatagataaaataagtgtcaaagaatgcattagatagagccaagtcgcaaggaaaactctactgaaggcaattgcaataggctagagagattgaaaactttctgttaaaatgaaaggcaggaaagattttgggggctggggtgagctagtggaaaactactagaaggcactggggagaagtttgtctgatgcaattagactttctctgtttgctaatttctgcttattaaagttaggttcttactctccaacaaagactgggagatagggattctgtcttttcttgattaatatattttaaagggatagcctccaggtccttgagaacgacattcttggattgtatgactagcaaaagcctgaaagaagaattaacaactcaaaggggaagagaaagaatttacaattgcaaattttctaaggtagtccaagaaaagggaggtcaggggctcataatcaggatgattatgcagaaaataatgagggaaaaacatgtctaaaatttcatcaagctaaaagaatgttgagccaatcctggtcaggagaaaacaaccatgagagggcagctggctgatatcacgctggtctgggaaccagaaaagagtcccatcttcttagacggccttgtattcataatggtaccatgaatgacatcgatttaatattttatcttaatgtctggccaacttcttaccaattacatctgtcacaggtcatgtggaagcagtctgggaagctgacaattttctggggagatttctcagaatcaagtcctgtaagggaagtaagaaaaggagaagtagagaggcactgcaacctcaaagtctcaatcgatcagacaggggagttttggagctagtaaggccctgtaagattgcatcttattaggaattaggtgcctaggcctttatatggaaagcataatggagttaggtgaggccaatctacagccaaggacaatcgcaagagggagaaactcaactgaaagatattagttgctacgccttctagcaactgacagaatgagtaccttggacctaaaatggaagaatctggattccatatcacagtaacctatgtctcagctcaaataccccttcttaaaagaactctccctgattatccaatttaaaacatcccattcagactcttttatcataattataaattatgctttataatttttatactcatcatctgaaatatttttataaatgtttcctttagaatgtaatctccatatagacagagagcttgcctaacttaatcatttctgtattcccaacacttagcaaggctcatgacttgtagtaaacaataatatttgctaaatgaataaatgtattaaatattttccatgcattaacaattaggaacctctgtgagagatttttgaccttgtcttattggaagcttatctctgaaaagctctggttttgagtaagtccatcttctgaagattgtctcctttacagctttctatggatcattcctattcattggggaacaaagttttattttatttttttcactgtagcacttacaacaattcctggcatttagttaatgctctgtaaagatttgatgaatagataaatgaatgaatgaatgaatgaatgagataataaattaatcagccttagctctgcccattgaagctgtaggaaataagtctgaaactcttttacataacaggcaggttttccccgaagctcctggccagttcctacttctctccctgcaagacatatatctaaggtatctattcattctttggaaaaattgcttccaaattatttcagcattctctcttctctgtgttaaaatcaaggtgctctggtggcatactcaggttttatggatttatttttttcctccactactaagatagaagattctttggagcagacgctgtgccatattcactctaattcccactctacctagtgcagcatttcccaacagcaggtgctcagtaaatatttgcaaataaagttttagccactttcaagattgcaaattgaaaaagtaagtctaacttagctgattggttaagttgtcatgaccaaacctttcttctcccagggtctaattaaggtttctgaaaattatactaattctcaggagacacgatgccttaaattctaatagtaagcacttttttataaggtgatttatttttgcccacagatcttttaatttgtatagtaagtaataagatctataagagaaaatcagaagaatcaatagataaagttaaagaatgtgggggaaaaagcatgaatttgttgtaaataaagtgtaaataaaaacaacatagactggagaaagttaaaatctacagcttaattactaatactctgcttatttaatgcaaatggcctcattccaacaactctaaaaataatttgaacaatgtattactccataaaaaaatctaccattgaccagctgtgcatgtccccacaattaccactaaaaatttttgttctaggccttgtttatgcatttatttaccctatatatcagaaactgtttattgccagtcattcagtcatagacgagacaaacatatctctgaattcttggaatttcattctcacatagtagacattaaacacaaaattacacaatcaactaaatacaatggtaatggatgtttcttgttaacttcaggcatatattgtcttggaagagtatcagtctgtcatttattgaatacccactgtatgggcagtattttgaataatggcttattaatttcatgcaaccctagcaagtgactattagctttttcattttatagctgaacatactgatcatcagagtgtaatgaataatattgataatatcatataagatgtattgataagatagacccctatctacactattttatttatcttcaatggacacccatgagaatgacgaagctcagagaagtcaaagggctttttcaagattatctaaccagcacttagaaaaggaaaaatttaattactgtcagacccttgttctgaaccccaagctgtgctaaagacagttgagcaaactgaggattagagaggtaggatcacaggcccaggatcatatacataaaagatgtaaacccagcatgcttgactccaaagtacatgctcttattattaaacatgaaggattaatttcactaatgttgtaaattggggcctgagggtattttgatttaggccagtaatataccttcactttccaaaacagagctagccttggccctcaggcatgggagaaaatggacatcactgcatcctgctcagtcactgctactcgccaggataaattcccctctcttttccgctggtatttctgcctcccttctttccagtttctctttaaaactccttacctccattgagccttcactctcattatatcccaaagctgctgagctctccctactctgcatcctccgagcatttacaaactccatgggcactgcataaagctgcatctatttatgtgctgctctgagaatgttcttaagtcattttcatgagtgtgtgctctttcatctcaattcagctttatgttcctgcaaggcaggaatagaggcctttatggtttttgcagtggcttccacagagcctgattcaattctttctcattagggttaactaaatcaagccaccctcctcactcccttgaacatactgatgcaaactgcatggtgaagaacagaggacagggaaatcagaagagaaagtgggcagttcagagctgttattgtggggacaaaacaagtattttcagacagaacacaagatagaaaatgtggcatcaattgggaggagtcagacatagcctcagaggaatatatggtagtgagataatccttccatttgaagggtagaggacataccagggtagatatggtgaagatagcatctgtgttgaactgtaaaggatggtaataattgggaatttacaaaggggtggacattgagatagatggaacaaaagaaacaatggtcttcttagagtaattgtggtcagacatgagaaagaaggtaatggtctgtatagctgagctattgggtgcagcaatatatgcagaggagaaataatctttgaaaaggaaatagagtctcaatagaggagagcttgaatagcaggagtttaaaatctaatctctgtagacaatggggaaccataggagttcttagtgtcaaagagtgacataagcagtgctttgctatcaataatagattttggggggcatatgcaggcaaggaaactagttaggaaattattctagtagaacagaaagaaggaacaaaggtataaactgaggtaagagtggtgtggagggaaaggagaggatttgtgggggctccacagaggacaaacgcacaggactaatcacagattcttacatgggggccgggaagagggaagaataaatccaggactgaaatctctcatctggtgaatgagaatagtgataactaatattttgtgggtgctcactctgtcacaggcactgtgccaagcatagagtacctgtcttagctcacaatctttgtaacaactgctttaaagttgttagaaactacaaaggtacatacttcaataaacctcattttatagttatagtaaccaaggcaagaaaaggtaaaataacttgttcaagtacactcagctagcatgtaacagagctgggatgatgaacctatgaggtctgactgctcagcacagaccatgaagcttaaccattaggctctactgtagtgttgaacacagaaaaaataaaaacagagaccacagtgagtgtgggtgagcaagtaaagggtaagaggatgaaagtaacccaagaaacatcactggaaataagaagagactgtggggagcatgagtttgcattagactcaacaaggaagacacagggaggaaatagatccatttattgaatggtaactgccaaaaactgctcaacacactttagatacatttttgttaaacctttctaagtatatcgtgtggtagatgctattattactgtgcccttttagaagatgaaggaattgaagatcagagtgatcaagtaagttgcctgagatcacacatatcttacataagaaaatcaagagttgaacccagggctctatgttaaagcctacatacataaccattatacacaccatgcccaatgtgacaaagggtcgatgtgaacaaggactcaggaatggccatttatgtggtcactaaaacataaggttgactacataatttattcttcaatctgataaattgtttagaatttaaaaacgggcccattactatgagtgccagaatgacaggcatatgctgtcactatcctaggtgaattaagatgtatggatgccctaccaggaggaccttggcatccttcaaaagaacagtattagtagaaccttgagagtggaggccggatagcagtcggttcagaagaaaactggagattagtgaaaaaacttaagaattacttggattcatcaaacaatatgaagaaataaactaagtagaggggaaccctgggcctgtccaactgtgggctgggctggcacaatgacacattatgggcactcaataaatacctaatgatacactagcagggatgaggaaagaggctgctctgttagttttgctttgtgttcatttatcttgtttattttctgagacagagggatattgaacatatttgtaggcagagaggaggaaccagtgaaaagaaaaagatagatgatgcaaatgtgaggggaaaataaaacaagaagggttggggagttccacatgttcaagaagaatttgtcttagaaagagagagaaaaaaattattaaagaaataatgcaatgtcttggatatgtacaagtatgaaggagacagttatccattaagaagtgctcagattcctgggtgaggatgaagtgatggcaacatccatctaagtcttactcattcagtgtaaatcacatggctgctaagcaccctgcacatgagtatgcatcttaaggtaaagtcaggcccttcctggtagagacaactcaagcacagtgacgatctcaggctgagaaagcctacagcatgacaaggtcccaggatgcagctgaggaagcctggactcagttcccagttggatccctgatttgctgtgtaactttgaacaagttagttttcttctcaggtcttcagtttcctcatctgtcaaaagggaacctgaaccagttcagcggtttacaaatgcctgtaggttcatatggggctgtgatggcgtttcttttttaaaatcctaatcaaagaacagtatagcaaaatgtatacctaaaatagtgtacaacttgcttaatttacagaaaatgaaaagatgtgtgtagtatcatctgtaacacacacacaaaattactagcaccctagaaatgcccccacccttccttccacacaccctcccatctactacttgacaacatcccactaccctgacttctatgagcagaaattagcttcacctctttatcttatttttagaaattgaaccacacagtttgggtcatcttgtgtctggcttctttcaactcagcattgtttgtgagatttattcatattgcagagtataatgctgtatattatactctgttgtatagtatcgtagagttcaatgacgtgttttgaaagttaggaaaagtttaaattgaagtatattttatttaaaggtaaatatatacaaaataaattattttgattttagattacattctttcatcctttttgtgataaaatgttctttatttgaaatcccttgttaattgctgaagtttcattttgtcattgtatttacttttactttgtcttaattttaatatgctaacttagcaaattcagctctgtattttatcattctaaaaaatttgactgggtcttgaagtccccaagcttaggttccatgggactagaaggcccctaaatttcttggctctttttataagccagcttaagcttctggcctttcgttacagcctccttcgacaaacagctcatgtgcacaaattctaagaggtgcccagaaaaaccacaaagaccaattattgattcatcttgaggtggatattgggaggggaagccttttttttaatgctcataattcacatgcataaatagcaaataaccatatcaattccttcacagtattagacgagtttaggtcttaccagatgcccttgagaattgccagaaagcctggactagaagaggacatatgacccccacacaggaaaggacgagagaacagagataccgagcatgagactgtgcctcagacactgtgcctcagtggaattctagaaaggggaagatgttccgtgggctggtggtcctctaagaaagcctcattaccagaagtagactttaaagagaacgtagggacccctagcgggcactcaactaacaaatatgatttatttaatcctttggaaaacaggataaaatcaaccactcgagccatggttgaaatactatgtattgtagaaaaagatcacatacatgctcacacacaccaagaaaagggggaaaaaaaaagaggattcctcctttggttcttgagagataattgcctggttgaagtaatgggatttgtgatggaatctttcatcaagatctattgaagagaggagcttcctgctggcagaattcagaatgtgcttccccaaaggagtgcaattacatattcagcctctttcctagaagaaagcaattatggggcaatttcacttttaaacaaaatcaatttgaggttctgttttccattagtagctgcaaaaagaagtagcacctgaattagacagtacatagttacccttttacaactgaagtaagatgcattgtaaatgaaggttttcagaaacctgtgggttatataaggcaacacacacacacacacacacacacacacacacacacacacacacagttgtttttacgtttgcttaaagaagaaaacttttgtttctgcctggtgagcattcaacacctccctatctctgtttttatagcatttacataccctgttttattttttcagcactttgaatcttgaagctaagacgtgtctgaatcataccatccttttgtagaatcttagctgtagctcctgctgccctatcccctggggtaatgataactttctgtaaaaatctcttcacaccattaaaatatatgtatttatatgtattaaatatatgtatctatatataaatataatgtagctatatataatttatatatacataaaatataaaaaatatattgtacatatatacataatagagaaatatgtatttatatgtacacataagatatatgtgtatataaatacatatatttaaatagtgggaagagatttttagagttatatcattagtccagaagatggggctaatatatatttatattttttatatataaatccttatatattgatatatatttaaatgtaaatctttatgtattgatatatatttatatgtaaatctttacatattgatatttatgtttttatttattgatatgtatttatatctatatacatacaattaatattctatattatatatagtaatataattctatattataattctataatatattctctattatataattctatatagtaatataattctatattaaaggtataccatatattttcatgcacatatatatcaccatataaaggtaaacatacaaggtgatgggtatgctaattagcttgattacacattttatttttgatagagataagtacaattggattctgtggcttgcaaacaagaacagtttctgaggcatatggcatgtgaccaatatacatcaaatacatctgaatttttcaaagacgaacgcttttttatatttccatattataagtggcataaagcagatgtatagctttaaaacaatgagttgttcctgcctgacattgcccaaggcaggaaaaacaattagatgaccttacagccccagggttcaaagctaattatgatgtttcctgaggagagagagatggaaacaccttaaaatctcctagagtgggtatggtttcaaacagtagagttttgatattgaaatacaagaatagaaattactctgatgtgtttctgctgtagaattttctattaccaatgtcattattgtaatttctacagcaaaggaaacaatgtttaattaatgaacattgtcttcatatggcaataaggggacatatgttctaattagcatcagatctaactcatacacttgctctctaatcccaaataccataaaggagagagcggagcccaagagaggggagggaatacagatgtgtgtgtatctttatactcccaggacatttcatccactggggcccagactcaccccaccttttgccattggacacttgacgtcatgtaccttaaactctactctgtctcaacccctgagaaaccctaaacaacctcccgaatatgattttgtgtgactgcacatagtttacttcataactgaaccaagatgcccctacctcttcgaacacctctagctcatctgaagtgtctgtctgaatctgaaaatgaccaaagcccagctgaggaaggcttccattggacagacgcagagaagcctgtggagtcagactgctaggagttgaatactgtctctgccacaaagtaactgtaaggtctctgtgagtcccttaatttctctgtgtctcaagtttccccagctctaaatgtaaaacagagctattaacagcacccatataataggtctgatgtgagtggtaaatcaaatgccaaacgtttagaccttagaagagagcttggcacattaaaaactattcaataaatattcactaatatgttgctttaacacatgacctttgtgatccccaaatccatactctctcaccccactaggtcagtacctctgccctcccagggaactgtaaggtgtctgggcagaaaatcgaagctggatcttaggcaaagaggataatttagtagattggttcccaagcctgatcattaataaggcaaaggtcctttcttagacatggacacaggggagtaacaggaatttcttggaaagataaaattcagaatcagctcatcactcagctatggaaggctaattcctcttgactgagaactaccccctcgtggctttcattgtgtaagtgacaagccagatccctgtggtgtcatcattttgtcaaacgctttggagacactcatctttgcagtggccttcatctaaaagatacttttggggattttaagatgaagagtctgtgtgtgtgtatatagatagatagatagatagatagatagatagatagatagacagatagatagatagatagatagattcaggttaaggttatttggggccaaatgtaggtcttaacctggagatgatttttggtgtagaatgatgaatagtaatgaaatgacattattgattttcttctaatgcctgtaaactgccattaaaagtataaatgccaaatattaacctcattttcctcactctattaaaaactataaaatattgaaataatggaataaaatattaacttgtctctaggtagtgcacaagccctgaagaaacatagaaagcaaaacatgcaatgaatacctttaattgtagtatttaaaatctcactggctgtgtccgtatcatttatgggcagtataattaaacaatatcctaatttagcataaagagactctagggaccatattttatcccttccaattgcaagtgtgaaaggaaggcttgtttctcaagcctttgtccttgtgatattttggcaacgtggaagccctcatgggtgtgtgtcaaacttctctggtcacctaggagatcaaagaggacggcaccttacctgctttaacacaggagacaattcaccatacactatctagcaaccctgtttttcatggaccccaaattctgattttgtattgtatcaacctgacaacctttatttctgtagcacaatggttccaaggagccaggttgcagctacgttcaccaatcacaagtatcttgtggagtactgatgaaattttctataataagcagaatttttatattgtaatggcttttaattcaggatgcatctgataattgatggaatatagcagtcactattagctatatgttagttatagtgctattgtatgaaaactttctgtagaaagcttctgggaaaagcagaacggtgccattgtcaaagcttcttagtttcactgaaatatgagtgtacatagctaacatttattgatcactttctatgggatggtgtagcagttatctattggcatgttaatgctgtgtaaccaactaccacaaaacctgtgtcacacaatagtcaatatttatcatttctcatgaatctatgggataattgagcaattctgctaaactaggccagacttagctgggctcactatgggtcttcagtcagctacaggttgcataagtgtttttgctgatcttggttgggctccagcatgtttggaagttggctggctctaggctggttgtatgggacacctttgctatcttcttgtgatctttaattctcaggcaggttagcctaggcttgtacttatggtagcagaattccaagagaaggtgggctgatacaagtagggttttaagcttctgcatgaataatacctattaacatcctactgtccaaagcaagtcacttgcttgggaccagagcgagctttagaaacaaaactcaaaagcttttcggctctttctctgagttttctttgccagagtgtaacatttggctggagatggacatccactgtcctctttaggtagggcgatcattttgaccctgcctgcctaacttatgaaccttacctgcctgacatttgtggcttcatagactatgaatattatttaactcttaatatctacacctttaactatcattgtaattaacaactatagtagagctttgagaatagccaaacataccttcttgtcaaatccactcatcctccaaagattcaaaaatactagagctattaaaggtctgtccaattgctcatgtagaatccacatgggaattccatttcatttccccccaacactggaaacttaccagttgttgaacaagactgaaatcttgcttaagattggtgattacaatctcagttccatttaaataacgtcacaattttatactctgaatcaatctaataaaagatggctgataattgttggaagtaagaattcttagtgctacacactaattcttggtcttgtacataacactttaagagaaagttaaagtggtgagacaaagtaatagaatctactaatctggatttattaatattttatgatactagccatttggccatttttccaaatactttaaaaattatttatacagaagtaaggaagggggccgggtgcagtggctcacacctgtaatcccagcactctgggaggccgaggccagtagatcacctgaggtcaggaattcaagaacagcctgaccaacatggtgaaacaacatctcttctaaaaatacaaaatttagctgggcgtggtggcatgcacctgtaatcccagctcctcaagaggctgaggcagaagaatcacttgaaccccggaggtggaggctgcaatgagctgagattgtgccactgcactccagcctgggtgacagagcaagactctgtctcaaaaaacaaacaaacaaaaaaaaaaacgggctgggcacggtggctcatgcctgtaatcccagcactttgggaggccaagttgggcagatcacaaggtcaggagatcaaaaccatcctggctaacatggtgaaaccccgtctctactaaaatataccaaaaatttgggcatggtggtgggcaggcgctcccagccactccgtaggctgaggcaggagaatggcgtgaacccgggaggtggagcttgcagtgagcccagatcgcgccactgcactccaacctgggggacagagcaagactccgtctcaaaaaaaaaaaaaaaaaaaaaaaaaaaaaaaaattcctgaatcatctctttgagatctcgagtattacaattttattgtgattttcagtcatcattggtttgtctcacccagattggtggggaccagtttgctccaggtttgctgcagctatagaatcccgtgactcctgacaaaatcgtggtcacagatgagatttcttcccacatcaggttcccagatctctgcctacaaagtgtggtcaaagcaagagtagtaggagtttgtctttttccctttctacatttgaattagcaggaaaaaaacgtcaactagttcttgttcacacacatacatcaatgtggttttttttttttttttggcgggggtatgagtactcatgttttctgaccccttccctctcagatggtcatttttttttcctttttctatttcatgtgtcataaagaggagaatcagagggtgagaatcagagggtaagaacacaggcataaggcttagataagcttattatttgagctggcctcacagccaggtaagtccacagttctcactagagtgatgtctgtttagacaaactttgctgtagggtctctgagaccacaaaaaaagtgtgaggttctccttttatcttgttttatgtcctgagaatctggctatttgaccagtgagaacactgtctttggtctctgccagctggcaggcaagtgtgccggcttgcgtcggacagccagttgaataggctagaagctgcagacacaaagtcacaaccagcagtatctgtttaatcctgatagttctcaagtgagtttgtcttaatgagaggttccaatccataagggcctttgttgtctcaaccttcaatttcttggtaagcactgagaaagtccagtctcagtagtgccttattggtgtcaccaatgacacataatggttcagtgactggaggcaccccaattttctgcgggagaccagagacaccgttttcacaagtactgttcttaccacctctggcaatgaaactctttgctttcttagtttatctctgacagttaactttttagatcatggggactgcattttcggtatccactttaggaacaccatttccatcatggtattctaaacctgaaaagtcttttcatgaaaagtcttacggctttgagttgcttctagaataaataaattggttaaatttgaaaaaagtttgagagagctctcatcctaaacaactgtcttattggtgcatatggaaaaatcaaactgaaaagaagacacaaagaaccgtaacagattgccttggagacttccttagcaatattaaaaaggagaaatcagatttagaacaaagttaaaattctttaaactgaccataaattcccttgtctgccctcattacttccctatgtccatgtccccgaccctctaaaagctcatttgatctttgggtctctaattaaaacccatcttctgcaaattcatctcaatttcctcagtaaactcctttagctcaggagagaaacatttgtaagaatttatttgaattatgactcttggctttggagtacccatttgttactcattctctttctccaaaggagagctgagatcttggcttggccttccgcctgccaggggtatgtaggttgggagctcccaagaatatggtcagaaagaaatgttggttgcaccccatttgcacgtagtataccaactgttgccaactcacagagacactgtctttcttctgtatgtgtttggagtgactaactcttggaagaaatgtatcattttacttttgcattgaagatgggtgcgtctgtggttcagcacccataaaaggcttattagttttagaattgagtcacctgttaggtataactttgttttagaactttggtttatattcagagtgtaacagaatttaggctttctctccaaagctaaaatggaactatatgcatagaaaggaaaaaaaacagtttactataacatttcaaagaggaacagttctaaatatagaataaaggaatcttttgatttccatcttagtgggaaatcttctccctgatgtaaaggagcaagttgaagataatgcaggatggatgagtcaaacccttgatattatttaggttgcaacccaattctttgaagaattaaaaacaactgtccttgttttacaaattgagtctttacaaagatagaagtgtgcctctagaagaaattcaaactcacctatccttcttactaattcccaaacctcatctatgtatctcaagatgcttgtagatactttagaaaatcaagacattgaaaatggaactgtcctgcaattaagaaggaaaagtttaaatagtaattaccctagacatctgataataggcaaatatgcttccaaaaactgcttggtaaatgtgcattcttcctctgtgcccttgagatgtcttacccaagaaccattacttttgaaatgcaaatttaagaaataattctcagataaaaacaaaagaaagaaaataaaaaaacaaaggaaggaagaaggaaggagggaaggagaagactatttggaaaccagcaaatggaaactcttaaaagctttaaccatctgagcaggtaaccttactttgttcaatatgccatattcactaagttttgaattactatagctgacatggggctaaagtttagagtgaaagcggagttatctgttctgtctgtgtttatggatggctacatatatacatatgttatataatatgatatttttctacctccaaatgacctctacttaattgacttaaggaaaaataagggtttaaaaaattgttagcttagtaaactttggtcaataaggatgtcattggcttaattaaaacaacatgtctttagagttgttagcattaaatataatgtagatacacaacttttattttcattagatgtttaaaatcctaagataattggttcaacctaagaacaaatgcacatgagaaagtgcaatgtccattactttatgtatataaagcacagccaaaaaacaaaagcccaattatttaactttttacattcttgattttgtgatacttgcctaaatgcaggtgctataaaaatagtcgacagggaaatacttgatatattagacaaagctagtcatctcatttaaatttcataagtaatctaagcataattgcaaggaacaagtgaatgaaatagatataagtagaataaatgtttataagcttttagacaataatcatgttatgtctacttaaaatggtttcccaatctctttggtaactatacccttaggtgatggatattaattaaatgtgtatgtcatttccaaataaaataaaacactgaaatattaattgctgaatacaagtttcagtttattttggcttgttagtttataaaaagaaaaaaatagttgagtctctcagtaaacatgctctgtttcatattaaaaaattgttctgaggaagcatgtgttcctagaaattataaaatgtgtattcagaccatttaaaatttcttattcctaggttttcacaggaaaatgggttactaagacttaacattctaatatgtaaatcaaactcctagtaataaggaaaacaagtgtatacaaaatgtacaaggaaagtaagatgttgtaaggtatgaggatgagattttttgctgagaaaaaaatttctgtctaggtaagagattttgaaaggttgtttaagaatgaataaggaagaatgaataaaaactgaatggatatagaaagtctgaaggggtgacaaagggaaagagaaatttgagtggtcaaactgactaaaatggaatgaatttattatgtttttaaaaaatagcaattaaggctacttttattactttgatattaaatcaaagtatagagatgtaaaactagaatttgtcatcccttttaaaagcaagatgttcttggaatattggtaaaatatagcaagtaaaatttctttaccttttgattgttcttaaggagggtggggaagattgtgttttgtcaaaataactgtttcatgttttaattattatatctttgattacttgacaatcaaatattctcaatattaaaagagctaaggtttttttctacaactatgttaattttctccatttgcctttgaaatcttgtgtcattttgatttaatttcattttatctacaactacgttaattttctgtatttgcctttgaaatcttgtgtctctttgattttatttcaaagtgttctgtggtcttttcatcaaatactttaaaccttttgatatttttgagaaactcccagtaattcacttttaaattaagtcttttttgaccttgaattagtttgagattttctaaacaggcttctgagatttgtcaagataatttttttcttttcttgtaaaagagacatgttaggctaattaggtttatttgatatgttaaattatatgggaggcattgtcaagtaagaaatgatgtttaactgatattatatttagaaaacaccatcctctcagccctaaggcttaagctggtaagcaacttcagcaaagtctcaggatataaaatcaatgtgcgaaaatcacaagcattcatttacaccaacaatagacaagctgagaacccaaccatgcatgacctcccattcacagttgctacaaagagaataaaatacccaggaatatggctaacgagggaagtaaaggacttcttcagagagaactacaaaccactgctcaaggaaatcagagaggacacaaatagaaaaacattccatcctcatggatagaaagaatcaatactgcgaaaatggccatattggccaaagtaatttacagattcaatgctactcccattaaactaccattgacattcttcaaagaattagaaaaaactattttaaaattcatatggaaccaaaaaggagcctgtatagccaagacaatcctaagcaaaaagaacaaagctggaggcatcagctacctgacttcaaactatactacaaggctacagtaaccaaaacagcatagtactggtacagaaacagacacatagaccaatggaacaggatagagaactcagaaataggaacacacatccacaaccatctgatcttcaacaaaccagacaaaaacaagcaatggagaaaggattccctatttaatacatggaactgggagaagtgactggccatgtgaagaaaattgaaactggaccccttccttatactgcataaaaaattaactcaagatggattaaagacttagatgtaaaaccccaaactaaaaactctagaagaaaatctaggaaataccattcagcacataggcacaaaccaagatttcatgacaaaaacatcaaaagcaattgcagcaaaagaaaaaattgacaaatgggatctaattaaactaaagagcttcttcacagcaaaataaactgtcatcatagagaacagaaaacctacagaatgggagaatatttttccaatctatccatctgacaaaggtctaatatccagaatctacaagaaacttaaacaaatttacaaaaaaaaactagcaaccccattaaaaagtgggcaaaggacatgaacagacatttctcaaaagacgacatttatgccaccaacaaacatgaaaaaaagcttgacatgatggatcattagaaatgcaaatcaaaaccacaatgagataccatctcacaccagttagaatggtgattgttgtttgttgttttttttttttttttttgagacagactcttgctctgctaccaggttggagtgtagtggtgcagtctcagctcactgcgaccctccacctcccaggttcaagcaattctcctgcctcagcctcccaagtagcttggactacttggagctcaccaccatgcgctcagctaatttttgtatttttagtagagatggggtttcaccatgttggccgggatggtctctatctcttcacctcgtgatccacctgcctccgcctcccaaagtgctgggattacaaacaggcgtgagccaccatgccgggccggtgattattaaaaagtcaagaaacaacagatgctggagagtctgtggaaaaacaggaatgcttttacactgtggctgggaatgtaaattagttcaaccattgtggaagacagtgtggcgattcctcaaagacctaggaaccagaaataccatttgacctatcaatctcattactgggtgtatatatacccaaagaaatacaaataattctattataaagatacatgcacatgtgtgttcattgtggaattattcacaacagcaaagacatggaatcaatgcccatcaatgataagactggataaagaaaatgtggtacatatacaccatggaatactgtgcagccatgaaaaagaatgaggttatatctttgcagggacatggatatagctggaagccattattctcagcaaactaatgcaggaacagaaaaccaaacacatgttctcattcataactgggagctgaacagtgagaacccatggtcaccgggaggagaacaacacacactggggcctatcggtgggagggggtaggcggatggagaacatcaggaaacataggtaatgcatgctgggcttaataactaggtgatgggttgataggtacaggaaaccacctatggcacacatttacctatgtaacaaacctacacatcctgcacatgtaccccagaatttaaagtaatagaaaattaaaactggaaaaaaatgatatttaaccttgagttatatgtatatacattattaatacgtgttccagacattttgtaaaattcctagaaaactgataagtcctggtaaatcagtcataatcccagttatttttaaatattatgtttcagagataaccaaattttattgtcaattacattttaataaactctcatcagatctttaatcatgtctatttttaagtcttttgtcatctacagacattaagtatgtaaaatccaaaagtgctttatcttcaagaaaattcatggaaatgactgacaagtacagactcctgataactttaagatcataccattggactgggtatgaccatccagtgctctagtgaagatatggacaggttaatgaagctgttaacccatcaagtagagcaagagttacatgggtctcaatggatggatggtgataattgtttaatgactgttttttttgaaacattgcttgttctttaaatgtttatttttccagatttaagaaaaccctctttttcttttaagctatctataccatatagcaatttggtaaagtacaattttgtgtataaaaatgcaaacatttacttttcccccaacttgatctctccagaatttggacactcttcatgaatattcctttttttcttcccccaatggcaatatagacatttgcataagcttaataaaaaaaaaaaaacttgttcttcttgtaacaaaacacaattggaaacagtggttatgctaccaaggctttgactgtgatgtcttactttctgatatgaacaaacaactttaaggaactagggttgacttcatggggccaataaagcctatgggaaataaatggtgtggtacctggaatacatggttcacatggttgcttgagagacgggaaaggaatgtcactttctcgcaggcccaggaacctcaagatacttgaggaactacaaagagaggaattcacccctatctataggtattacaggcacggtttgatggtgagtccttggtttggctttttagttctgagaagcttttaaaagcccagtctgaaatttcttactaaaagttctagcaaagcagacttagagcctagaaagaggcagaacaaggtgactgaatagaaccctgcagtgatcatacccttgcagaagcaccaaagttaacaactatccacacaagaaagcatcttcataggaactaaaaaatcaggtgaacaatcacagaacttggatttaacgtcatagcaaggaaagaggtgctgaagagggtaggaaagacagtctttaattgtcaacaccactctttccccatcccctagcagtgcagcatggcatggagagagaatctgtgcacttgggggagggagagcaaagtgtctatgggattttgcattggaactcaatgctaccctgtcacagtggaaaacatcacagggcagaattgggctgcagccatggagggaatatgtaggccagcactaaccagagaggaatcatccatcccagtgatcaaaacctgagttttagcatgccccactagcgtggactaaagtgctctaaggtcttaaataggcctgaaaaacagtgcagaccacaaggccagaaattcctgggcaagttttggtgctgtgctgtactcagagccagttgacctggggtacataagacccagtgaaacaactactgaggtgactaaggaagagttgtaatagccctccctccaataccaggtaacatagctcacagctccaggagggagtccttctgcttgaggaaaggagaggaaggagtaaagaggacttattcctgcaacttggataccagctcagccacagtcaaagcaccaagcagggttctaaagttgccattccaggccacagctcctggacaacatttctggacccatcttggccaaaagagaacccactgccctgaagataaggacacagtcctgccagaatttactacccgctgactaaagagcccttaggcattaaataaatggcagtaatagacaagcagcagttgccacaggcctagggcaagtcccagcattgtgctggcgtcaggtgtgacctagcacattcccaggtgtggtggccctggggagagactcctggcttgatgaaaggagagtatgaaagacattgtcttgcaacttgggtaccagctgagccacagtaaaataaagcaacaagcagactcctaaagtcccaagtttcaggccttagctcattggagggcatttcttgacctaccctgagccagaagggaactcatgccctgaatggggtgaaccaggcctagaaggacttacacttgctgattaaggggtgcttgggccttgaaaaaaaaaaaaacccagcagtactctgattgtagtggctctgggccttgagcagtggtaatcatgagcagtgacttctgcttgaggaagggagagggaaaaataaagaggactttgtcttgcaacctaccagctctgcctcagtaaaataaagcacacaacaggttcctaaagcccccgatcctggccctaagctcctggatgccatttctagacctaccctgggccagaagggaactggctgcactaaaaagaaagacccagtgctggcaagatacattatttcctgtctacagagtccttgggtcttggagtaacacaagtggcagccaagaagtaagcatgccaggcctggggcaaggaccagtactgtgccaacttcaggtgttacccagcacagtcccagtaagtagtggccacaggaatgcttgtgtcacccttccctcaactccaggcaactcagcacagaaaagagagactctgtttgggtggaaaataagggagaagaacaagagagagactcttcctggaaatccagggaattctccacaatcttacccaaggccactaaggcaataattctacaagtctgtaaaagttacagcattatggggcctgcagtgccctcgaatgcacaaatgggtgcagtgaccacagatttagatcacaacactcaattccctttaatacttggaaagcctactcaagaaggatgggtataaataagcccagactgcaaagaccacaataaatacatgatttgcagtcccagatatcagtgaacatacacaaacatcaagaccatacaggaaaacaagacctcactaaatgaactaaatgagacactgatgatcaattccagagtaacagaagtacatgagttttcagacagataatttaaagtagctttattgaggaattccaataaaatccaagataacacagaaggaattcagaatcatgagataaagagtgaaataataataattaagcagaaaatctggagctgaaaaattcaattgacaaactgaagaatacatcagtctctcaacagcagaactgaacgagtggaatagtgagcttgaagacaagctatttgaaagtagaaagtcagaatagataaaagaaaaaataaaaattaataaaccatgtgtataagatctagagaatagcctcaaaagggcacatctaagagttattggccttaaagagcaggtaaagactgaggtagaaattttatacaaaaggataataacagaactttccaaacctagagaaagatatcaatattcaagtacaaaataattatgtaacatcatggagatttaagccaaatagactacgtcaggacatttaataatcagactatcaaggttaaagaaagaatcctaaaaacagcaagagaaaaggaaaaaaacacataaaggagctccaatatgtctggcagcagatttttcactggatattttacagtccaggggaaagtagcatgatatatttaaaatgctgaaggaaaatatatttatccttgaatattatatacagtgaaaatatccttcaaacatgaaagattttcccaaacaaaagctgaggaattttgtcaataccagacctatcctacaagaatattagaggtagttaatcagaaagaaaaggacattaaaaaccaataagatgtcatctgaaggtacaaaactcacaggtaaaagtacacatacaaatacagaatattttaacactgtaattgtggtttgtaaactacccatatcttgagtagcaaaagaggagcctatcaaaaataaaaactaaaaactttttagacatagactgtataataaaatataaacaataaaaaatttaaaaagtaggggtggagataaagtgttgagttgttttagttttcttgtttgtgtgtttgttttgcaattacatttaagttgtcatcagtttaaaataggttataatgtgttaattgcaattcttatggtaaccttaaatgaaaaaactaacaacagataaaaaaatatgaggtaagaaattaaagcatatcactagagaaaatcacttccacaataaggaaaacacaaagaatagaaggaagaatgataagaccacaaaatagccaggaaagaaataacaaaatgacagtagtttacttatcaatagtaatattgaatgtaaatggcataaactctccaatcaaaagacagagtgattggattaaaaaacaaaacccagtgatctcttgccaataagaaacacaattcacctataaagatacacatagactaaacataaagggatgaaaaaaaagataatccatgcacatgcaaaccaaaaaagagcagaagtagttatatcagacaaaatagatctcaagacaaaaactgtaaaaacagacaaagatggtaattatttaatggttaaaaaaataaattcagcaagaggatatcactatcgtaaatatatatgcatccaacactggagcacccagatatgaacaataaattttattgatactaaagagaaatgaatctgaacacatggatagtgggaaatcttaacaccacacttccatcactagacagatcatccagacagaaaatcaacaaagatccatcagatctcatctgcactagagaccaaatgaacctaatcagtatttacagactatttcatccagcgtctgcagaacacacattcttctcagcacaggaatcattttcaaagatagacaatatgttaggccacagaacaagtcttaaaatattcaaaaaattgaaataatatcaaatatattttctgatcacaatggaatgactagaaatcagtaacaagaggaaatttggaaagcatatgaacatatagaaattaacccccaataatcctgaataaccagtgggtcaatgaaaaacttaagaaattttaaaaatttattgaaacaaatgaaagtggaaacacaaatagcaaaacctatgagatacagcaaaacagtactaaagagggaagtttgtaggaataagtgcctacaacaaaaagtagaaaaacttcaaatgaacaacataatgatggatcttaaagaactataaaatcaaaagcacaaccccaaattagtacaaaaaagaaataaatgtcatagcataaataaaattcaaatggaaaaatacaaaagatcaattgaaaaattgtttttttgaaaagataaacaaaacttaacctttatcaagactaacaaaaaaagaaaatccaaataaaatcaaaaatgtaaaaagacattgcaagtgatatcacagaaactcaaagaattattagagattattatgagcaactatatgtcagtaaacttgaaaacctagaagagataaataaactcctagacagatacagcctaccaagattgaaacccaaaatgtgaatggaccaggaacaagagattgaaaccataatagtcttctaacaaaggaaataactttacctgatgacttcactactaaattctacaaaacatttgaagaactaatgccaatcctactcaaattattcctaaaattagtttgagaatattccatcccagaagaagggaatacttccaaactcattctatgaggccagtattccccttataccaaactcagacagacatactaaaaaacaagcaaacaaaaaacaactataggccaatattgctaataaatattgatgcaaaaatactcaatattagcacaccacattcaccaacatattaaaagattatttatcatgcccaagtaggactcatcccagggatgcaaggatgttttgacatatgcaaaccaatcaatatgatacatcatttcaaaagaataaacgtaaaagccatattatgctgaaaaggcatttgatgaaattcagcatcactttacaaccaaaaaatcccagacaactgggtgatatggttagattgtgtccccacccaaatctgattttgaattgtaatccccataattcccacatgttaagggagagaacacatggagataatttaatcatgggggtggtttcccccatgctgttcttgtgatagtgagttctcatgagatttgatggtcgtataaggggctcttcccactttgtcacttttccttcctgctgccttgtgaagaaggttccacttcaccttctaccatgattgtaagtttcctgaggcctcccccagccatgctaaattgtgggtcaattgaacctctttcctttataaattacccagtcttggacagttctttatagtagtgtgaaaatggactaatacactggttatagaagaaacatttcaacatagtaaaagccatctatgacgaagccacagctagtatcatattgaatgaagaaaaattgaaagcctttcctctaatatctggaaggagagaaggatgcccattttcaccaatgttattcaacatagtattggaagtcacagctagagcaatcagacaagagaaataaataaatggctttcaaattaggaaggaagaagtaaaattctttgtttgcagattatatgatcttacatttgaaaaagactaaagattcaataaaaaattattagaactggcaaattcagtaaagttgcaggatacaaaaccaacatacaaaaatcagtagcatttctatatgccaacagtgaaaaaatctaaaaaatcaagacagtaaatccccttcacaatagctacaaataaaataaaatacctataaataaactcaaccaaaggagtgaaagttctctacaataaaagctataaaacattgatgcaggaaattgaggagagcacaaaaaaatgaagatattccatgttcatgtattggaagcaatcaatattgttaaaatgtccatactaatcaaagcaaactacagattcatgaaatcactatcaaagtaccaatggacattcttcacagaaatataaaaaacaatcctaaaatttatatggaaccacaaaagacccagaatacccaaaaccatttttagcaaaataaacaaaactggaggaatcactttgtgtgacttcaaattatgctacagaactatagtcaccaaaacagcatggtactggcataggaaacacatacacatacataacggaacagaaaagaatatccagaaatagatccatatatctacagtgaactcattttcaacaaagatgtcaacaatatacattgaggaaaggacagtctctttaataaatgttgctgcaaaaactaaatgttcatatgcagaaaaataaaactataccccatctttcaccatataaaatctaatccaagtggattaaagacttaaatctaagactggaaaatatgaaattactagacaaaatccttggggaaattctccaggacattggtctgagcaaatatttgagtaatattccaaaagcacatgcaaataaagcaaacatggacaaatgggattaaatcacattaaaaagcttctgcacagtgaaggaaacagtcaatagagtgaagaagcaacccacataatggaagaaaatttttgcaaactatccatctgacaacggattaataatcagaatatacaaggagcccaaaacaactcaataggaaaaaatctaacaacccagttaaacaatgggcaaaagatctaacagatatttcgcaaaagacacacaaatggcaaatgggtatatgaaaaggtgctaaacatcactgatcagagaaatgcaaatccaaactaaaatgagttatctcaccccagttaaattggcttttatccaaaagacaggcaataatgaatgctagcaaggatgtggagaaaagagaacccttgtacactgttggtgggaatgtaaattaatatagacactatggagcacagaatggaggctcctcaaaaactaaaaatagaacaaaaccctcttctaggtatatacccaaaagaaaggaaatcagtatatggaagagatatgtgtactcccatgtttgctgcagcacaattcacaatagccaagatttggaagcaacctaagtgtccatcaatagaagaatggaatggataaagaaaatgtgccacatatacaaaatggagtgctattttagtcataaaaagaatgagatcctgtcatttgcaacaacatagatggaactggatgacattttaagtgaaataagccaggcatagaaagacaaactttgcacgttttaactcatttgtgggaactaaaaattaaaacaatgtaacagatggagatagtagaacgatggttacccagaggctgaccatggtagatagggatggtgggggagtggagatggttagtaggcacaaaaatatagttaaataccatgcataagatctcatatttgatagcacaacagggtgactacagtccagaataatttgttgcatattttagaattgagggagtacaaatcgaatgtttctgacacaaagaaataatgaaagcttgaggtgatggatatcctatttaccctgatgggtatattatatattgtatgcctgtattaaaatcccatgtacctaaatacatacacttactacgtacccataaaaattaaaaatttaaggggtaaaaaactttatgttgttacattaaaaagcctatattaaacaatcactattcttgcttctcttatgtaaataatcaggccaagtttcatgagattaaagttatcttacaaacaaactagtcttactgtgattatctttggtaaaattgggggtgactatagagggaaattttgcttcagtataagcctacctatattgtagctattaatagattttaatcctgttctttgaggttttgttattcaaccttttaaagtggactggatcctgaatttctccagtatttgcctagaattcttcaaatatttacatttttctcccgcctttctcacttagtatgactaagaacaaaaatcgcccttttcctgaagctctgcatgctgaagctggatgacttgatatgaacattacagagatgaacattacagagatcacaacttttatatggaaaacctttgtgcctgttgccccgtgggccactcagacatcaccagagacatttagacaccaaaagatacttttaacctacagtttagaagttttgactggctgccctacagactcagaaacatgatttatagtctgctgcaattattaactttccttttgttgccatagaaatgcctcttcagtgggttattagatagtttaccaactcagtttctggattttaaagcttcttggggaaatttcagatggagtaatgttgaggctcaggagacaccaaagtatgaacatacccccaaaatatgatgataggggaccagaatataccaccctaaaatatatttggcagttttgagctgcttattctggtaaatggcaggtaaaggagtatccctgaaaagctgtcctattataaaataaatttatatccataaaggaagagtatattcataaaagtacctgtattaaaaagaggactgctgaagataaaaaatccctcagatagtaaaagttaattgcaaacaagatataacctttattcaccaaacatttccttccctctctctcctatgacttatgtcaccaccaaccatccctcagaagtccaaagctcctattcccttctgttgctcaggatgctgtagaagcttcaatcatgtgacttttaaggctcatgttctgtcggacccctgtgcatacatacataattaaatacagttttactcctgttaatctttcttatgtcaatttaatttgtagcccaaagaacgtggaaggatagagggaggccatttttcattccactgtactgttacaatttcccactcagaatcatgtgatgaaggataactgataataattgtcaaggccaggcatggtggctcattcctgtaatccatgcactttggtaggccaaggaaggtggatagcttgagttcaggagtttgagagcagcctgggcaacatggtgaaatctcgtctctgcaagaagtgcaaaaattagctgggtttgtggcgtgcatctgtagtcccaggtactagggaggctgaggtgggaggatctcttgagtctcggaggtggaggttgcagtgagctatgtcagcccactgcactccagtggcggcaacagagtgagactgtcaaaataataatttttgagaagccagaaccctcagtgctagacaggtactaattgctgaacttgtatataaaacttagaaaagaataaagtaatgagtcaaagaaataggatttgctcatctggatttattttatgactttaatgaccattttctccaatttttttttgaaaagttatttatatacaaatgaggaagaacatttctttcatattacatttttattcctgagttatccctttgagatcttgcttattaacaattttgttgtgatcttccatcttcatcgggtcatgccatctactttatttctctgacttaaatgctaactgatggcaaggtccaggcaaaaagcttcagacaagtagggtaactggacattttttgtttcttgggcttaaccagcacctgccttgcaggctgcctttggaaatggcaggcttaacagcctggtgagcaaacaggagagttgctttcacacttgagttatgatctgtttaaacttcgagtcaactaccattcagggctcacatttcttgaacatgtgggataggaggagtttcagaataacagacaattgcccaagcccaaaggggaggtttccaggtttttaaaggaagtacaaattatggattggtctttaaaaatgttcgaggagaagcctcccttagtgtaacctactgaaataaatttgaggtgtaagcaagtaaaaataaaaaatattctaaaaatgatctatcatgtatcaaaatttaggctgctattctgagacataactttaaaagcttccccaggttggctacaaatataaccccaaactggtaaagttttagggttctactctgccatttcattatttagtacctccatataaaagctataagacctaaactggtacttctgccttactattaatagataaacaaatgcttctggaatgaagtgactaactcagattaaaagaattccttattcctggactcacctgttggcttggcctggcccttttgacttctgggagttatttcctttatatatggaacttatgaccacctactttgctctgccttcagaatttttgcctctgaccccatcttcctatttgagtccttttttctggtctgtgctgactataccagccctgatggctctgttcttacttggaacacctacatattcatgcaactatgcccaggtcattgagccttccatctctttggcaccaataccctttacagaatgggtttttgagacctgttaccctctgctgactgacatccagactctggagtgagcagctatttttgtgaagagttccatggatttctggtgatgtgacaagaggttaacttacttgcctctcttctcctccatgggaaaactgggcaaatgataaagcaatctgtttctcttttcttttatgcttcagaaaacgaaggtaacaattggacatttgcaataggctaatggccctgaagtccatctacaggttttgtaagaaacaaaacttcaatggtaggatgttcaaacttaatcctttcaatggagggatgctcaaacttagctgtggctcctgctctgatgaaagcctagtttcttcatctcctactcaaaatccaaccacctcacaatacttacggaacgaaggataggaatgcttcttgcaggtgtccaagcaaagaaaagaaaaaaatgctttccctccttccccagctttattgaggtataactgacaaataagattgtacctatttaaagtgtacaatgtagtaacatatgcatatacattgtgaaataattgcaacaatcaagttaattaacacatctctctcctcatatagttatctttgtttttttttggtgagaatacttaagatctagcaaatttcaagtataatattatctgcagtcacccatgctatatgctagatcctcagaactattcattttataattgaaagtttgtaccctttctcctacgtctctctccatttccgtcaccctttgtacttagcaatcatccttctatttcatgctgttttaaagagttggagttttttttttgttggtttttgattccacatacaagtgatactatatattgtccttctctggcttctgtctctaagaataatgtccttcgggtttatttatgttgtcaaaaattacatatttgctttttataaaagtaatattgcattggggcatatgtgtataaaatttttttaatccatttgtccactgatggagactaagattgtttcaatagcctggctgctgtgaataatgctgcaattaacatgggactgcagatgtccattagggaaattaacttcatttcctttggctttatatgaagaatacagagaagtgagattgttggatttaatcatagttctttttcttccccccctatttttttaaggaaacttcatgctgcttttcagaatggctataccaatttacatacccaacagtaacacaaaggttcccttttctctacatccttgctaacatttatctgtctttttgataaaagtcatccacacagatgtgagacgttatctcattatggttttgatttgtgtttgagtagtaatgctgagcaccttttcatgtactcattgaccatttgtatgtctttttttgggcaatgtctgttaggtcctttgctcagtttctaatcagattatttgtctgtatttgctatggaattgtatgagtatcttacgtattttggaaattaacccattattggatatatagagtttgcaaatattctctcccattccatagattgccttttcattttgttgtttcctttgctatgcagaagcttattagcttgataaagttccacttatttttacatttgttgttcttgtctttggtgtcataataagttataaaagaaaataattgacaagactaatgccaaagaatttttcccctatgttttctccttggaatttcacattttttcagtcttacttttaagtcttttatcagtttggagtaaatctttggaagtgctgtaatataggagtccagttatatttttggtatgtggaaacctagttttctcaacaccatttatttaagagactatcctacattttgcattagcttcctgtcaaagactagctgactgtatacttgtgggtttatttctgggctctctgtcctgtctcaatgctctttgtgtctggttttataccagtacatacttttaaagttactatagcttggtaatatggtttgaaatcaatcagtaaaagataaccagcttccttctactttctcattactgacttggctactcagggtcgtttgtggttctatacaaattttcagatttttttttccctgtgaaaaatgccattgggattttcatagggattgcattgaatctgtaggtcccttgagaagcatggacattttagcaatattaattcttccaattcctgtgcataggctgttgttccatttatttctgtattcttcaattcctttcatcatcactttatagtttttggtgtaaagatatttcacccccttgattatgtttatttctacatattttgtggtttttcgtgctgctgtaaatgggattgctttctcaattttactttcagtaagtttgttattcttgtatagaaatagaactgatttttatgttgattttatggcctataactttactgaattagtattaacagttttttgttgagtctttagggtttcctacctttaagatcatgtcatctgtaaacagagacaatatttcttcctttctaatttggatggcttttctttttcttggttaattttctaggacttacaaaactattttgaatagaagtggcaaaagtgagcattctggttttgttcctcgttcaggaggaaaagcttttagtcttttactattgatgatggtattagctgtgggtatgtcatacatggccttcattgtcttgaggtccatttattttaagtctaatttagtgtttttatcatgaaaggatgttcaatgtcacaattcttcttcatctactaaggtgaccatatgatttttataaatcgtttggtaaatatggtgtatcattttattgcttagcatatgttgaacaattcttgcattccaaaaataagtttcacttgatcatagtataagaaacttttaatgtgctgttgagttctgttctccagtattttattgaggactttggtatacatgttcatcagggatattggcttatacttttcaggtagtattccttgtttggctttgcatcagagtaatgctggccttgtaaaataagtttggaagtatccctcttgaattttcataagggcttgagagaaattgatgttaattcttccttaaaagtttgatagaactcagcagtgaagtcattaagtcttgggcttttctttgttgagagatttatgattattgattcagtcgtacttattattattggtctgttaagattttccattcattcatgattcagtctcggtaggatgaatatttctaggaatttatccgtgacttctaggttattcaatttgctggtgtaaaattgttcatagtagtcttttatgaccctttgtattgtgatgctatcagttgtaatatctcctttctcatatccgattttgtgtcttgtttttcttgctaaagtttagtcaattgtatttttaaaaaatgccatttcttaattccatttatctttctatttttttttttctagtctctatcttatttgtgctctgaattttgttatcttccttctcctggctttgtacttatttttgttccttgtggtataaagttaggttgtttcttgactttttttttcttagtgtaactatttattgctatgaatgtttctcctagaactacttttgatgcattctgtagattagaatgctgtttccaattttgtttgtctgaaggtatttttgatatcacttttgacttattctttgattcactgattttttcaggagtgtcttgcttaatttctacttatctgtgacaatttctattttctttcagttaactgatttctagttttatgccactgtgcctggaaaagacaccagatatgatttcagtcttcttaaatttgctaaggtttattatgtgatgtaacatataatcttggagaatattctgtgtgcaaaatattctattgcattgctgtttatttctgccttccaacctgctaatatttgcttaatatatttagttgctccaatgctgaatgtatatatttataatatccttgtaattaattgacccctttagtattatataatgatcttttttgcctcttgttataatttgtgacaacgtttattctgtctgaagtatatctatctctgctaccttttgttttccatttgcatgaggtttctttttccattccttcatattcagtatatgcttttccttatagctgaagtaagtttcttgaaggcgatatatagttcagagtttgggttttttgttgtttagtttagtttatccatttatccactctggtttttgattggagaatttaatccatttacattcaaggtacttactgatagatactattaccattttgttcattgtttactctgttttgtagttcctttcttgctgtcttactatcttcccttgttacttgatgatttcctttaatggtatgtgtcttagtccatttgtgttgctatcaaggaattcccgaggctgggtaatttataaagaaaataaatttactttgttcctggttctataggctatacaagaagcatggtgtcaacatctgcttctggtgaaggattcaggctgcttcccctcatggtgggaggtgaacgggagctggcatgtgagatcacataatgaaagaggaagcaagagttgggggaagtggcagattctttttaacaatcagctcactttctctcatctgctgtgatccgctgaaaatgtgctggggtttgttctgctgtcactgtttatgctgctggaacttagcactgtcttgatttgaagcatatgattgagagccatttgaagcaatcttcattaacgcagataaaacaagtttacatgtgcagagttagaaaatgacatgttcaattctgtaagtggtgactttttgagcacctttcagtattatgtatttgtaaaaaccattgtttttggatataaagctaataagcactttaaaaaggaaaaggcagcctttactattttttctggttgagtcattgctcttcagacctagcatcagcaatagatctcaaagattaagcgctaccatgaagtgtgtaaatttttcgttttgccatattgaaaaattatttgcatagtactgcatgctgagacacagcttatatgtattcacaagaatatcttgaagtgtgtttttgacacattaaaagaaaggaaataaggaaaaaaaataaacaaaacaaaacaaaaaaaaccaatcagctctcacaggaactaatggagtgagaatttactcattgcctttaggatggccccatgccgttctaaaagaatctgcccccatgacttgcacatctcctcttaggcccagcctctaacacgggggatcagatttcaacttgagatttggaggggacagatatccaaactatatcagtatatttggattcctttatctttagtgtatccattacagagtttgtgtgtgtttatgatgagacgtacataaaacatcttttagctataacagcttatgtaaagctgttaaaaacttaaattccaacacatacaaaaattatatttttaccttccacccacattttatatttatgtcaaaattcatatattttatatattatgtatccattaacaaattattgtacctacaattactttcaatatttttgtcttttaatctttatgtgagttaggtgatttacacacaaccattatataatattctgaaattgacactacacttacttttaccagtgagttttggaattttatatattttcttgttaaataacattctttcattttagcttaatttccctttattccctttactttcagctttcatttgcctttagtatttcttgtaagttaggtctagtggtgatcaacttcctcagcttttgtctggaaatgttgttatctctcttatttctgaaagacaactcttccagatacacagtttttggatgatagtttttcttcctgcttttttcttttagcactttattctcccacttttttctagcctgcaaggtttctgctgagaaatccgctgataccattatgggagtttcctcagatgagtttctcttgctgagaagcttgttttcaaatggtctacaactgagactcaggatgcccgtaattctaaattttgtaaaacatgacgtgtaaagatgactaatcataagtctcccctacctgtgatccacatgctttctccttttctgatttttaacaagataattctaactatcccttttgtctgtgtttggactaaagttagtagattaatggtctggcaattcctgttcattaaagttataccatggggaaaggaatgataaagtaccttcactcctttttattataacctaccaccatgaggctctgcctaccagatataggcactctcactaccaagaccagggggtcatcttggtaggttacttttcatctttcttaatagacacatgaggaacatacttaggaggttctcctctgcaaaaacagaaacctatgacatcagaaaagccaggagacagtctgctggaaacatcccagtgcatcaggaccaatgaagttaacaatttttttttttctggactagagatgaagcacagatggaatgagaatgtatctggacttcccttttgtgttggctttttgagaactcaactgagtctaagcaaccagaacgttctggttggttttgttttgttttaaaagtcaactatatgccattatctcaaattagccactccccagaagatatggcgaagtttacatccattccacaaagttggtattggccatgatgaaagaatgcagctgcttctgttagtggtaatgctttcagggagatatgagaggcctctttcaaaaatgatcacttctgtgttgaaaggtcccttctatctgccttgttatataggtttatggagctatttccaattctgtgatttttgataattatcaaagatgaagtaaagccctacatctaagaccctacaggactccagtatcagtgtaagaacaggataaagcaattgacaattgtctttcacactaagttagctgtctagacatcacttatttatgtgagtcacaatctatttactaaattttcctgatgtatttcacttacagtgcttgtaaaaaaaaaaaaaaaatgaattctgattccttctattttggcgattggttctgtaagtctgctgaggagtaggggtactgccactcttaacaagcaccacagacagctgatctagttgtatgagcatgtccgagtttttgctgtcctttgtgctgtccgagttatgcactaacaaaaactagggcccaaattatgtgactggacagcacacctgggacctttgattcttggccgagttcaagtgcattaaaaatgttcttcctgatatagaaactcaatttccaggaaaattcctgacatcagaggaaaggggcagctgaagcccttggtgggcccattgttccaccaataagtgaaacaacccaaaaacttcttgttggtcataaagatcaccagtgaaacatgttaagtttaaatttgaaaggtagtatttacataaacacacaccaactttttatttttttccagctttccagctctaacaggatcggatccacttgtcctcataactatgctcacttatgcaaagaaatgggtaaagttactaccccaacacttggaaaataaaaccctgctgagggaatttagaggtgttgtattctccatttctcaaagagaatagacttgatgttactgaaaacttaccacaaattagggattaaaatagggagttcattgggtaaattatgatgtattcattcaataagatatggtgatgcaagcatcatgataatacttacaattggtagtggcatgggaaaataagatataatagtaagagaacaaaatgcagatccacatatgttgtataattccaacaatcacatgtgtgcacataatcatgcatgtggaaacatgatcaagatataaggtattaaaatagttttttttttttttttttgcaatagctgggttacaaacagcatttattatttacatgttttcaaggtctcttattttactaaaatttaatgcatctccatttttttcataatacaaaataacatgcttttctaatcatggttctaggactcaaactattggtaatattcaatgcctccagagataatcagggaagcttttagaaccaatcccagaaggacccttgagaacattcagaaacacctaatgccatgccctgtttcattcatgaatccaaagaaaaatcccaaaaggcagagcaggtaaaggagctgagacaataacttgacaacaactttaaaaaaaaaagtgatgatatttttacagtatttgtcaatatgcgtaacagtttaggaatgaaatttattgttgagtccagaggcgaaacagataaaagttactagagggcataggaagacgtttctaacaatcagatctcccgagggcagctccacaggcatgtcagcattccaactgaatcaagaggatggtatttgtctaggatgctggtgaggggaatgaatgcctccaacagataatggctccattagaaaacatgtaaactccctccccagctcttgaaccctaaggtttcagaatttaaaacttgagtttttatttggccaagcagtcaagacaggcatgactatccacaacatatagatgagaaatttaaggctcagagagatgaagtgaatgcccgaagtgatacaactgaaaagtggcagaatcactaatttccaaaccaatgctctgagctctggtactcaattaacacaacacatacatgaggctaggatatcagtagttcagggagatagacccctgaatggcagacagaaagtaagggccactttccttccatctttggcttttgtgctagcctaccctcccgcaaggggcatcttcatgtttcatccagtgccatagcttgccaggaaaaagggtcacagctgcggccacagtcctatcctaagcttttttctgtgagaagccctttgagttccctcaggcggctcaaagcgactcactccatgtagcgctggtaattgtgttggctgggtctgaggctgacacagtgggaactgctggaacaggaagggaaaggccatgtacttccacatgggtgaagcaacacctgattccctgagtgaggaaatgagtctgctgtatgaaagcaggaaccttctacctctggtttcaggaaacctcctgtgctcagaggtaagtggctcctgaggaaatatgtgaagcattcctgccaaagaaaacccaggaacacagaggactaaggaggaagggcagtcctttttcactttggtttctgccagtttggccttgctgtagttgctgttgctctgctacccagagaaatccggggaaagaacaaaagagaaaaacaagtcaggtaagataaaactggaagcattagatagattttcctttactttggagatggtcatagtgttaacatttgtaattagcagtgtactcagcattccaattgtgatgattgctgattttactcgagtcagggtttaaaagaaataaaaattatgctgattaacatgtattgagcaactaccatgtgacaggcactctgctagaacacttaaatgtgctgatttatgtcagcctcttgaaaatcaaatgaaatggctatcatttttgtgcttaaagataaggaagtatacacaaagaattttcagtaacttgcccaggtaagcatttagtaactggtaggactgagaatcaaactcaggcagtctcaatcagagcccatgctacactggacggcagtattacgcttgcatcccagatgaggaaactaatggttcagtgacttatctaaaagggcattagtttgcccattagttcatttgcaaactaatgaatcacaaatcagaactaaaactagttacctagatcaggtctgagatctttctccagtcaccaagtgtctcctagtaccttacaaaactccttgactcagaaatttcctgaacaaattctctagacaagattgacaaattgaaccaaacattcactggacatctggagtgagctaagcccttcctgtgccagccgctctcataacttctgaattcctcgcaaccaaagaaatgggtattttcatctccatatttattagtaccatatttgagattgtagaatcgatcaacagcagaaaatgacgtcagtatccttaatccaggcctctttacctcacatgtttgcctccacaaatcaagggagttcttgaaacaacacagtggttagagccatttaaacctcaatctttctcactgtgaccttaatacaatgttgttaaaaatttctctaaatgtcttagcctttagtaattaattaaatggagctcgtaaactaggtaagccccactccactgtaatgagccgctttactctcccctcatataattttactgatgtctgcaatcactttttgcaaaagcaatgtccttaaggaagcaagttggcttctctaaggtttagcccccatgtggtcttctcacagaacaagggatccaaacacacaactcaggtcaaatgtggaggcaagcatttccaaaaggaacagaacggattatttttaatcaggatgagcctttggcaggggagtgtggagagagagacagcaagtgaaagactttatcacacaagcagtcagtgtgtgtaggaatgaactcagccagctactggcacttaatgaaactcagggttttacactgatgctctcagtgaagtactgaaatcagcagcatgagaatactagcatcaagaaagtgtaaaacagtggtctgttttcagaagaaatgaaattgaactggaacacaactactcacattagaatggcaagggattcactggacagagatcctgagcatacagaggtgctaactctcggaataacttcattacatcctggaacagaataaaatagacctgagactgttactgtccattagtgaaggaaagtctttgccaaaaagtcttaagacttttagtagtttactattactattaatagcaacacttcaattcaatcaaaacttttgctttctacagagtctgttaagctgctttcttaattaggtttttccattagccacattcacaatttccattagcaatggagcattaaacgtcattgctgtgaaccattggtcaactgtcagtcacacattctaattgctctttctataccacttcccacatcttctcagtctctcacatcaagccccaactcaaatcctatttcctgagatacttgcatgcaggataaatttgaagaaagcgggatgcaagagaagaaaattaatggaggagcatccttcattactaatttatttattcattcctaattgaacaaacaaacctttttttaaaagtcctcaggaatttgttggtatacaggactgataatttaatggactggacagaaaactttgattccctcaattttttaacgtgaaaaagaaaaccttgttatggaacaaacacatagtcttttatgacaactgagccatattaagatatttcaagaaagggtgggtatgcatcagaaatgattttggtagtaacagacttggtggatagaactggcttagcaattttatccagtaattcaattattcatcaattctcttgacttaactcatataaagtttatagcagccattgattcacatacttttcttgaccatcagcattaataatgtacacctcattcaggaagcttcagagagatagccagatgatacaagggttcaggagtagcagctcatctctgtgctaccatgagaagatcatgagtttattgtggacctcaccaaccttgagaatggctttgctcaagaatatgctggcccatgtatctgatcaacacgttctcctcctcagggaaagttcatagcacaagtccttactcctgtacttctgctcagaatgacttgtagggttaagcacgggatttgttatttgacatccagggcagacactgtagggaaccccaaggttattcagcacacaggactcagtcaggcaacaagagttattcatatcaggggcttctgtatggtcatcattgatttaaaatcctgcagtaaggccagaagccagatgccatagactgaatgcttttgttcccctcaatttcacatattgaaattctaactcccaacgtgattgtattgggggggggggggggcgggtggcgcattggcagttgattagatcacgaaggtagagccctcatgaatggcattaagtgcctttataaaggagaccctggaggactccttcaccccttctgccatgtaaggctacagaaagttgatgtctgtgaaccagcaagggaaccctcatcaaacgccaaatctgccagcactgtgatctcagacttcccagcctccagaactctaaaaaatcaatgtctgtcatttataaggcactctgtctatggtactttgttatagcagcccaaattgactaagacatcaaagaaaatcatagactatattctcatgagcaagtgtagccaagctgaaagtaagtgcatatgtggacacacaaacacatgcacacacaaaattaccctcagcggtactggaggctccatctaccttgcaaagtacaaacaaaagcagagtcgaacagcatttcctcttccttactggcaactccacatcccgcatccctgactttcccctatcataatgcataatgccattatccactcaactgccattgctggaaacatgagcattttcctccttgagtgttcttttccccaccttcctttctagattccccaagatcactaaaatatatcctacaatctatatcaaatcttctttaatctatgtcaatgcatgttaatatttcacttgctaatgctgccaaccaaaatttcgtacctagattgtccttctaaatgctctcttcacctccattctaggatatctgtattttcaggttgtttcataagacatttgctgatttctgaggatgcatgggagcacaatctgagtagacagccgaacagtcatctaaaatgttgtaatagttttattgcacacacacagcaaaaatatttcaaaatagcacaggcaaatataaaaggaacagttaaaaatttcttcatgatctaggagagaggtgaacaaacttctcctgtaaagggccagatcgcaaagattctaggctttgtggaacatacggtcactattatagctactcaacactgctgttacagcccagaaacatcgatagacaatacgtaaaaaaacaaatgaatgtggctgtgttccaataaaactttattaaaaaaacaagcggcaaaccaaatttgccccgcaggacatagtttgcccactcctgtactagaccatcagtcttatggcccaaattaacaattgttaacagtttcttgtaaaacacattgctgtttgagtaagtcttttaagcagccccagctaaacaaaatgtagcttttacagacagcaagaatacacaatggtttacctgtgctattttttttcaaagagggaaaaatgacaaaatcactttttctataaagaagagaagtacaatgtggcttgggtacataccaattaccttttgttcagtggctctggagagtcaaaaaaggacaaagattcaaggttttggctaccacaactattcaacatgagttctaaactacaggtttttttttttttttttttttttttttttaccagaaatgaaattgccaatactagtttgatgcttggataagcatgtaaagtatctaacccacctgatggcaaaaatcacagcataagccctaacgagaaccctggcattctgtggtttgacctagaaatttaaccactacagcaaatactgtttcaaaggtaacatgcattctgagccaaacaagaaaaaaagaaaaaaagaaaaaaagtttgaaaattcaggagccacatgaatacacctttgcaaaaaaactgtgggtggcctgtgccctgcaatctggtgcacatttcgtgggtaattgaatagcgcagtgtagcatctgtgaatcaaaaattcagaacttccaccaaatgtagaaaagtgtattagtatattaggaaaaattgtgactataagctcatgttccactttggtactttttaaaaatattgattacaagttctccatggtcattgcctttcttttctgtgattctttttgtatctctgaatctccatgtttctgacttactatctgtttctgactttgtcttttctctttcttcatctctcggtatctcagtatctgtctctcaccttctcctccaatttcctttgccttaagatttttccatttaagcagaagaccatttaatacctcacctccatgagtgaggagttacaggaagagtataagtgcttgacttactatgtataatacctatggctaagtgcatgtgtgtgtacatatattaatatctatgcatagacagatgaatatcaacctcaagctaatgtcagatttaaattgaaatatatttatatctatctaaccagctatctatgtatgtatctactcattcatatatattctctttgttggaagcacaggtcaccagaatgtctaaaaactgtatatggtctcgttggtgcaaataccttcaaatatatctcttctgtaattaaaagaaaaagaaaactcaagaaaggagtgaaaatatctgctattatacattcagaagagaagagtgatcttcttgccacctttgtcatcaaaaccagctaccaaccgtagcaatcagatacattttgtcaaatttagtcacctaaaattaagtataatgaggctaagttcatcatccctttttcagcctgcaattatttaagaaaatcatacaagtagtttatgttcataaaataatcagaaaatacagaaaatttttaaggataattgaaaccctcagtcataatgtggtaacattttagccacatctttctagatttttacagcttcattttattttacaaaaacaaaaatgtattcaacaaaattgagatccttttatataccagatgcccaattagatatttgagaggcataagagaactcagacaaaaatttttgtcttaaagtcttaatgtttttcaaatttatgattttactttgttttgctacacatattttacaagccattacatatagattctacatttaatgactatataatattctctcatattcttgtacaaggtcataagtcttattaacttatgcttttctgcaccaagaaaagttaaagaaaaaccagcataaatttagtatttactctgggcaaatagttacaaatgttgtaagggagatgtgaacaacaaaacaaaacagcacaataacaaatacagtaagaaatagctccagccctcaaagaggaaaagggtaaaaaacagaaaagggagggagcacattataaaaagatagtaatatcacaagtgatagaatatatatattatatatataaagtcggtattagatattgtgattatcatgattgttaataaaataacaataacaaagtaataacaatcaacatctaacattggagtgtttattatgtgccaatcactattttaactgctagatatctatcaacctatatgtctcctaacaaacttgtaagaagggtatttttttacatatgatggcagagtcacaaagttatcttcatgaagtcactaggctaataaaagttggagaaagatttcatatctaaggcatctgtttccagagtcattgctactaaccattacgctacagccaaaagactgtacccctttatcctcacaacgcatacattattcatgcggatatctaggtatgacggttccgtgtaactcattccaactacaagaattactaatcaaggtgcttattttaacaatagaaagatcactttccaggaaaaggcattgtctcttcttgctaaagagctggcaggacatcctacatgtgcaacaataaaatcctgtagggaatggttttcaatcttcagtatttgtaagaatcatctagggagttattaaaacatgaatgtacctgtttattctcctggcccctccaacagaatactaattctggagtctaaatttaggtaatgcaaatacaggcaagtgaagtccacactgaatagctggtttagcagcctatgagaaagcccagaacttcctagttcaaaaatccatccactcggccaaagccagggaaagtctttggccgactttcccagggggactggagacagcatttccaaaccagagtgacaaatcctctgatgattgtaatcaaaagtgccaagagaattaaagaggtcaacaagaacttttactttccaaacaggagagccctacatcagatggcccacgagtttgggttctgttattctggttaggaaatgtcaccagaaccatcaaacttttggctcaagggcacaatctgattagacagttacctgataccatgccttagtagccctgtcttgaaacaagtgtgcacaaatccatgctgtctctctagcctcaatggccagcatggagaagtcaaatgtcaagaccccatattttcttcctggaaaatagctgaaaaatgatatacatgaatactaccataagagttactcatagggatagacgaagggcatgaaaggaagaaaataggtcagtaacagaatatgtgacacgggaaaggggcacacttagatttttccactcacatcaagagttctctctactatccctctcaatgggcttaggaaatctccttgtaagaaacttctagataaacccatacgcaactcaaatatctgctctgccactttttagatagctaatttggggcagatttcttaactcctgtgagccccagtttcaacagtttgcatggagatatctactttacagggttgctttgacgattaaattgactaacgtagtaatattatgcaatgtgcttgcagaaaattgctcaaaagatgtaatttttagctttttataatgtggatagcctatgtggctagagcagagttgctctagtgttcagcaaactcccccagccccattgccaaccctcagcccccctcaggtacaagaaaagctaaaaaaaaaaaaaaaatggatagcttcaatacaatggtgtcagtatttaaaataacattcgcatcaataggcaatgaataagtggtttgtacagtgttactatgcatgttatcccagcttgttatcttgggaggatgtgtgagagctggtatttgatttctctaacttctaataattttaggcaagtgaaatctagtaaagccaggtgaagttggagcatacacattggaagcgctaattataaagagggttgtcagggtcaagagtcaacttggataacttaaagcaatgaagttgtccatgctgtctctccagggtcagtagccagcaaggagaaaacaaacaccacctctcacacatcctccccagataacaagctggggatgacatacattcttaacattgtgcaacccacttattgtctttccctcttctcatcttgcctctattgccttccttctcaccttgcactacacataagttggataaatacctgagcaggcacctcgctcgcagtaagtcttattaggtctttttagtaccctgtaaggtcagttttgaaaggtgagtaactcaggagtcaccctagactaagcaacttgctctaacacagcacagcacatataacttgtatatgttctccttgaactcttcttcccaatggtggtctcttatgggcaggagcacagacttcagccaaaataaaactatgaataccattgtgtctctgtcccaagatcatgtcaaaacaaaaaacaaactccatgcaagtccaggtatcagtagaatgctgcatcctaagtttcagtctcttcttccaacaactgatgtgtgtcaatcgcactgataaatcagcagttcttctgtttcatctcccatagaatataaatgatatctgtcttatcccttaggactatgttgagaataaaactgaagtaatgtgacaaaattcttcagaagtgaagcattttaaaaagcaaaaaggtaccttactgatctaagggtagtatagaaacattgcagagatctatagaaatcttttatgtacgtgtaggatttcctacagagcattctggtccttttttcctctgcctatattttaaattagactctgttctttcactacaaaacttgcacagtaagctttcacctttgtttcttgccaatctttaactattgcatccatttgatctgagcagagccagctcacgtcagaagtgaccatttcatgccatgcagtctggttcccctcacactgtccatgtgagaaaccagcatgaagaaacatccaagatgagatttaaatgcgcaaaccagggcaatcacgtctttaagggctaacagatttttcctgacatcgattttcagtttctcactgggcatgaaatatacctacattcattctaaagtgatcttacagatgagtgaatcttaatctctcttctccctacatttgttcttgcagttcctttatctatcctgtacttacagccatttcaaaacactccttttaaacttatccctcctattcatgatctaggttaagcaccactcttgccacagccttcataaccatctgagccagaaggttcccatctcatctttactctctagcacttttgtcattcaggtaacatacatcatctactgtctcatatgaatgatcataacattttgtaccacttcacacacatcccaagatcagtgactggaacatatcaggtgctcagaagatatctgcacaatttaaagttaataagaaaaagtatataaggttgttagcattttctctggaagagttaatactccataaatatttgcaattcttaacagcattaataaaatactgcatgtatttttgtgcccagttctatgttttgtttggtttttgttttgagacagagtctcactttgtcacccaggctggagtgcagtggcgtgatctcagctcactgcaacctccacctcctgggctcaagcaattcttgtgtctcactatcctgagtagctaggattacatggttgtgccaccatgcccagctaattttttgtgtgtttttagtagagacaggatttccccatgttggccaggctggtctacaactcttgatctcaggtgatccacctacctcagcctcccaaagtgctgggattagaagcgtgagccaccgcgcttggccaattctacggttttgagagtcctttctacgaaacatgtaagtcgttctcagagtcaatattatcttttctagggggtaacagtaaattcaaaaagatttaaattctgttcctagattatgcatttggtagccaagtattgcatgtttgccaacacaaagatatcagactaataatgcttttatatcttactacaaatatcaatacctgatttaagtattgtctttcaaatttcgaggcttctataaacatatgcatatgaataataggaaaaagacccaacataatgttttcacactctcaagtcaaaggcatagattaatgtggtatctgtttccccagagctttacacatgcaagatgctcaatgctttcaggttgaagacactaatatattgaggggagcctgggcagggcctcacaaaagctactgattattcttcagaaagcagaatgcaggtagtctacttttaagatagatattaatgcggtcttatatttgaacacaggtctgtctaccttcatatcttatacttttttcttctataacaccttgccctttcatgccacattgcatttgcattttttattaggatcagagccctgatcataaaaaagatgtaggccaggcgcggtggctcatgcctgtaatcccagcactttgggaggctgaggcaggcagatcatgaggtcaagagagaccagcctggccaacatggtgaaaccccatctttactaaaaatataaaaattagccgggcatggtggtaccatcctgtaatcccagctattcaggaagcttaggcaggagaattgcttgaacccggcaggcagagattgcagtgagccaagatcgtgccactgcattctggcctggcgacagagtgagactccgtcttttaaaaaagaaaaaaaaaaagtaagtttgctaaagaatgccaattatactaaaatctaaaaagccaagtaaaaaaaaaacttatacaataaacaccagttttcagtcaattctgaaataaagtcagatttagttgctcattcagaaatgtattaacaaagaccagatctcaagattttccgatgacctaataatcaaataatcacccaagcattgacttcaagactaaagatgaggaggacagtgtgaaaacaatgcaattactactgaaagtaaagaataaaatgtgaagagatttacctttcataagatgaagcttccattaccaacatttgcctgcttgcagctgccgctaaaatccacgcaagatgaataattttacagacagttcttaaaaggatctgatttctaagttctacattaaaaaactataaggcagatttggagtgagatcaatgtgaattccacattgtgttctatcattgaccattcacatcatcttggccaagtcaatgatccttttttaaccttagttttgtgtcattagagtgataatcccaccttcacaagattgtgaaaatttaaaagatgctaaataaaagcattttattaaaacaaaaaacttggcccagtgtaattaccaccaaggttgtgttgatacatgtcgtgcttaaaaatagctgatggcacacaagcagatgtcaagcagccagtcatgtaacagaatgcagcattaataccatcataatgatgtaagtaatatactgcagataacggtcttaggttaatatctctttgaacaacattgctaatgctaaagagacagtgaaaaagtgaaacattatgtttagcataaaaatgtgaagagaaaataccatccacctaattagaattttgtatggattaactagctaatgctggttagcatttgagaatgcaatggaagacagaattatacacattcacagacacaaagtactacatattatatgtaaaattagatcacagcacatgacatgtataaaatgagtggtgcagatgaaacacgttcttgctcgcaacaaactgtccctactcagcatctttcatgccacaagattcccccactgggtctagcaaaggtttccgttgagaaaggcagtcccatataacaaggctgtattagtaaatgaatttaaataatggctctcaaattttgggaattgcactaaacacattcacaacaaaacatacaaaacacacacagaggaaagtactaatcatgtacaagttttagtatatttagtgctttgtgtctgaatgtgtgtataaattctgtcttccactgcactctaaaatgctaaccagcattagctaatgaatccatacaaaattctgagtactaatcatgtgcaaggcagaagttacatcttcaaaaggcttccccaaaagcatcagcaaaaggaacaggagagaggaatgctgcaaggaaaccatccagaattcttgaaaagttagatgggcagctcataatgaccatctatttgtacctgtcgttcagatgttattataatcattagtctctcttagcagcaaacttttagataaagatcagagaactccaaaggatgtatattatggcgtatggtgcttctttctaaggtaggatatctaagtgagaaaccataagtcttcaactttattattagatttggggttaatgaactgtcctttattaatctgagagaaagaaaaatagtggaaaggcagtgacacacccatgtacaggactttacaacaataatgccctgttatttctatcaaattatgtgattctgtggatgaattctgagtggcactgaccccattttacagatgagaaaattcaaacgcagattactacaacaaataggacttgtcaagggtacataacaaataagactacaagtcaggtctccactctgctttcatttaattcagtttcctccatctaagtttcatctgatcctcccctgctccaatttacaaaaatagctttaaacgttacctccttcatgatgctgaaacagataaatgtgtttagatgaaattagccctttttgaaaacatgaacatacgtactgaaaaagtgtgtgtgtggctgaggaggttggcgttaggaaatacaagacttcagaggtgagagatctcactgcttagcaaactttgggtgctaaaacactaagtcacttcccctattacttactacattcaatagccttagtagacttactgcaaaagccacctatccaaagcctgacccacacttgtctctactggacttgtaagtataaatgtgtgcacatgtacacacacacacaatctgacaaaacattgtcatttaagtgaacatttggtttgccaaagatgcataatctctccgtcaggccaaaatatttcaggattaataatttgcagcttagtataacagtatctatttctagtccaaaagttttgtttcccagtgcttataatatttgatgcacttaaagccagcaactctgagttaactaccaaaagaagggaaacattttttaagtttagatttaagtgagatgcttattttagtggtgatgtgttaatagtattgaatattttactgatattaaaagatatgattgttaacgtaggcagtgaagtcaaatgtctccaggagctggataaaatctctactgcagttacctcaataaaattctacagaacgacataaagcagaaccctttgtcctaaggtaacatactagagctgtgtggatgttctcaggacaggactatcaatgctaaatgccgttatgatttgcctcaatacaatctataagtatgtacaacagaattcccaaggagtaaatgtgttgtaaactgtccaaaactgttattttaaaagctaataatgggaatacagtgtcatgtctctgggaaggtttcttgcaattgcattacaaactaaggtatggtgactgatactgagctggataatcagtgcatatttcaaagagcaaactcgcaatttccagatctaacttctatttacttatgtgttccatttttacccacttttgattaccgtgttctcactgcctgttctgtggtagcctcgacaacttttaaatggtctttaatcaccaaagctgttgttttactatttgtcactaagtttccaggttcactttaagttgatacttctgataggttaaagagtttcagatttattcactcaaacaaaaaaacttcctgacatggccggggaaaaaaaaaaaaaaaaaaaaaaaaatgactagctgtcagccctgctactttgtcttgcaaaagctcaccacacacccactctccctccccaggctcagcctcctggaatcttaatccccttcttcatatggaaaagtctttatttcaggtttcactagaggtggtcaggcaatgaagagtgaacagggagttgtagtcccttggatattgatgtttccaggactaaatcacattggagaacaatcaattcacaagctgtaaagccccagctttaatcactttctctctcagaaagatggtgcctgctctccatgtaacttccatctcctcagtgccagagacagggaccacactagaaggcagtgattgtccactgagattttgtcccctttaaattaacctagacatttgtcatcacagacaggagcccccagagtaagcttacagcaagtgaagtgggaatccttgagggcaatgtcagcctgccctacaacgttaaccctttcaccaccgcatactatgcacttatttaacaccctactctgcctggtcttcagcttcacaagccatattgacagaaaccagggatttacattcttacttgaaagctgtttttttccaggtttggagcttagagatgaagatgggagttccaggaggactgaggcccatcttggagatgaaatacttcctggcgaaggcaagcatagcctttattttgcacacttcaagtcagaagcctcaaatcaccttctgcccttgaccctccaagcccactttcacactccctccccgcttcgctccccgaccccaccccatcaccactctgctactcgcaacgctgcctggtcgcacccaggaaccatctttgtgggtggggttcctcgtctccgcggacaggctgctagtgagccgcagctcctccatccggaagccagggatcttcatcttgccgcggagttccatgctgccgtcgcccccagtcttcagggactttgcgctcccgcaggctcctgctcacctctcccatcgttgggcgctggtggcaccccaggaggagagaggagcagcaggagcccggtctcgcagtgccggcacggacagtactctgggggtctgggccgcgtgccacgaggagcagaggagccaccggagccgcttccgcagacgccctgacacggaggacccagagcgccgcgccgcgccgccgaggaacgcgctcaccggcgccaaattttcccatcccgggagcgagggcggcggcgaagggtccgggacccgaggtggcggcgcggggctctgcgcgggcggctgtgggtgctggagctcaggaccctaactttagcgaagtcgggccgcggcggggcgggtggaggcggcgtgggcaggggctgccgcaggtgcggagtgaggcgccgccacacgggcgggggcaggagtctcaggaactcggcagccgccagcagagcccggtgcgggaccgggagctgccggggcctcagctccgctctccccacagctctccgtggctgcaggttgaggtcgaactgcaagcgccacggaccctgcctgctgtttactgcgttttcactggagactccagcaaatgtcctggagaggagagggattcctgctctgtccattttagtctctacattggcaccttggtgtaaacccacagcagaggctgcgtgtcctggctgagaaacacagaagggcagcggggacggaggtggggccgtgtgcagatgaagtatgtttatgaagtacatgattgtgagcgtcagcgtatgtgtgtttagggtttttcccatcagtctccagctttgctcccttttcttgaccttctgtagcactcactctgcccaaagccagtcttgcgtaatcccatttgaaagagcactttgttactagccatattctaaatgttttgtgagcctacactatggctttagaaaaaaaaaccacacacaccacactaggggaaaagaaaggaactcaaaactgtggcttgggaacattttcatttggagcacaccaattagtcccagggtttagctctaaacccaagattccgtaggaaatcggacatctattggagacttatctactacgtttgttatatgactgttaaaccaattcattgacctgtatcacattccccacctcaacccttgaagcagctggcatgccgtctgaaatcttggaataaactttgcatatggttagcaatcttctatttgtgtatgaaggtgctcaccactaatatgctgtgagttcctgagaatcaccacacttggttgcttaaagtttgaaaatgaccaagttgtaactgaggaacttttctacaaattaaggaacagtacgttccaagtgtcaacgtcacgaagttctttcatgacttaggaactgtcccagattgaaggagatttaggagtaagaaaatacatcctatgatcctgaattagatcctagtccaacaaaaggacattaggtcaattggcaaaagttgactaaggtgtgtagaatggtcatatcataactttttaatttcctactagttttgaagttgaactgtggttgtgtcagatgtttgtggaagcagaatataaggtatgtaagaaattttaaaaatagtcttttttaaatgacaatagaaaatttggtctgataaacataaaaggattggattaaatgacctggaaaatcttttgagcctaaaattcaattgtattacaaaaatatgtgccaagccaggtcccctgctgctggctagtataaagttcaagtggagattttaggaaggaaaaggaaatttgaaaatttcaaattatttttttaagcttaaaccttttccagtagatagttttatttcagaaggatgaaatgtcttcagattcctttgcggtctttacaaaactaataacactcttgtatgtattagtcaacaatcaaatatccaaaagataacagctgtaacaaaatagtaaaaattctagtgtgtgtgtgcacggacacataactcatttccttcatggtaacttcattaaaattctcaatctgtgatcggaccactttgaagagtagctgttaataagtcagcttttactaacttgtaatgggaaagttttatacgcaagctttcataaaatatgcttttggaagataaatttcattccatagaccattctaagacacaaaagcaaatgccagcagatcaactatctcagcctttaaatttcagtgcttccatgaagcacagtgtcctaaatggtaagctggctagttcagtcatgaaaagaacatggaatatgcctccaaaaatacctttactacccaagagtaagggcttatctttggaaaataaacctgcaccctactaacaaagcagtattttggccagttgtgttgtatagatgggagaaagtaatctgggattctcgtggcatcccaaatcacaaatgctactcattagcccagaagagctgtttctcatttcacaaaagcttcacagatttgcagaattacttgttaatgtctttttgtaagccttacttctttttatgtcaggataagtgtgtgagaattacactatgtggagtaattactccatgggtaggaatccagattaatgtatcaaagtacagatagatccctatgcaaaaatagaactggaaaaaagcaatgaaatttaagggtaatcactaatgattttgaaataatgttcttaatattttaggtctacattatttataatcattgtagcatgctagcaaaatggatatgtagacaattcccagaaaaaaattagcaaaatgcaggtgttttgctttgcttccctccacataaatgctacttcttcatcctgccaaatatacatccctacacctacactgaagaggtagtccaagagactcattaatgggaattcactgaagttgagcatttcttttaccatgttttaaaaaattttaggataggtgtagagttatagaaaaattgtgataatacaatagagagtgctcagactcttgagaaggtagctgctcagtgagagggcaatcttaagagatctgaggctgcttcccaccttacatcaattgtcatttggcaactcaaggtcactcaaattacggcctgttgctttccctgcctggagcaccagagcagcagctcaaatattttgcccagaatgagaaacaggatatagaacagagagctccttttatacctgtataccccaaaggatgagattgaaaaagttcaaccctgagagcactcagcacaacagtgaaagcgacggtgaaaagcaactgggaaattgattcattgctaaatgataggttcacagttcagtggagagaagaggacagtgtcagcagaaagagcactactggttcaaacaaatatgaacactgacctcagcaactgtccctttaaagcagcagtttcccaacattttccgcaccaaggaccagtttcgtggaagacagtttttcctcggacagtgggggatggtttcggcttgaaactgttccacctcagatcatcaagcattagactctcctaaagagtgcacaacctaggtcctttgcatgcatggttcacagtagggttcactctcttatttgaatctaatgctgctgatctgataggaggcggaactcaggcaataagctccctcaccagccactcactttctgctatgtggcccagatcttaactagccacagactggtaatggttgggggcccgtgctttaaaggactctaaatttgattaacctgtgatgggcatgccccatcgcatcagtgaaaacaacggcacaattggtcagaattggtcatcagttagaacatagcagctgtgtattagggaaagagacccttaatgaaggccttataatcactgttgtcctactaactactgggatacccaaatgtgacagtaacattactctaagatgatattgaaaaataggaattttacaaaaaagacaaatagaagttctggagttgaaagatatgtaattaaaataaaaattcactggggtgagggtttcagtgacagctttaaactgatgtaaggctttagagaaattatatagacctatagagattatacttccaaagggcaaaaaaaaaatgaacttcaggggcttcacactacaggggagtgaggaggagagttagactgctctaaaataatccagactatcactaagtaagtaagcaaacctcagtaataagctatggagagttgaagtgcctagggttgctacattatcttaagtttccaattactgtgaacaaaaattgaggaatgcaaagcagaaacaaacagattaagtatgaccaatacaccagaaaaaacagtccacagaaactgaaagtgataaagttgagatttaggggtaaccattataaacagctcaaagaattttaaaaaaccttggttaaaagtatgacggtaatgttgctttaaaaagatagtattgaaataggaattatacaaaaaaatagaaattctggagttgaaaaatataattaaaatgaaaattcactagagggtggtttcagtaacagctttaaactgatataaggctttagagaagttatatagatctatagagattatacttccaaagggcagaaaaagaaaaaatgaatagagcatcagagaaatgtggggttactattagatacacctacttatctgtactgggagtaatagaggtagaaaacaaaaaaaggaacagataaaatattcaagaatatgatggctgaaaaacttcccaaatttattgaaaagctgtaatctacaaacttaggaaacacaacaaacaccaagtagaataagagcaaagagattcacaaatatacgtcatagtgaaaatgctgtaagaaaaaggcaaaaagaaaatcttgaaagaaacagtccccccagcactgtgtaactactctacgaaaatataatcaaattgtcttcataagaggatctctgttggggtgatcagacccaacaccagatcgtgggggtgacaaagtccagcggggttaaaggattgagaaaaagacagcttgagagagaaaaaaactaggaccagagagccatccctagcatatggaaaccgcgaaagcccccagctctgggagcccacgctatttattggtaagccaacagagaaacaggtggtgagaatgtggagctcaaaagtgcacgttgcattaagcacatgatttacagctgtgatggtttagcatctgctctgctacttgagataatggagagcaggttcttttaactcaagatacaatcaatcctgggagagcaaggagcaaggagccagcaagtctagacacattgcagagccacgagtcctggattctatccaggccacgagggattttatgccctgggtttagatgatggtgcgtcacggtagactcccaccctttagcacagagcttggtgttccaaaggccacagggggttttagaccctggaccccggacatgttccaaaactcctttacattatgtcagacatgtaagccctgcctcggcttctcccaacactcagcttttcccaatagatctctgatcccattccttcttactgggcaggacctgccaatcagggttctcagccaccctgccagtgctcttctactgatggagatttgaaacctccctggatggagatgccagaggtagtgacaggctgctatctttggtgtttggatgacatagctattccggccttcagactctgggtagtccaaggcgactggggactgaggtgcacccctggcacagaacaactaccctataaaaatgtggccagactgcttttttaaagtagctccccaatcccattcctcctcaccaggcaggacctttcaactggggtctccagccacctcctaaaggtgcatttcagccatcaacaggtctgtaccttcttgggacagaactctcagagcgagaggcaggctgctatgtttgctgttttgcagcttttgttggtgatacccctaaatactggaaaatctgaggtgactagggactggagtgggcccctagtctatcacagcagccctacagaaaagtggccagactgtcaaattggtgcccattcctgtatcccctcactgggcaggtcctccaggcctgggcctccagtctcctgccatcagagctattgagccagtagcaacttggcaactccctgaacagaacctccaggggcaactgaaagcttctctgccactgactctgcagtggaactctccttgctaccctcagactaaccaacgaacaaagaccctaagtgccttatccacatctccaacaagctgtagtcaaaataaagagaggaggccagtccatctcctacaggtcccacataccacacactgcttgtcaccagacagggatcctgtggcttgggctcatagcgcagaccctttaacctgggctgattacactcagcaattgctgacctgcatctctgtgaggtggagcctccagaagaaaagcaaaagaccccttggccacaccactactgaggtccctttgctgcctccaagctggggaaagaacataattactgagatcaccccagagctgcagtggctaccccaggagtaccaagccatgatctaccgccagcactcaaggaggagaggaacccacattttcagagcattgagagggaacacaactgcaactgtgagaaaatataggggagccacacaaccaagtaagagtctaccaactgaccaataagcctaagagcccctgctggatcacactccagatcttccataccaaaaataccttgctaacataaccccttctgaaaccatagacaagaagtcagcttcaaataaagaccctgcagaaagccttgaccctatgtgtacacccagaaaagaagtctgttgactgtactcaatctacactgtaggcaaggaacacccacatgcagcgatgaaaaagaatcaacacaaaaactccagtaactcatgtggccagagtgtcacatgtcctccaaatgagcgcaccagttctccaacaagagttcttaaccaggctgagctggctgaaatggtagaaattaaatttaagatatagattggaatgaagatcatcaagattcaggaggatggcaaaacccaatgcaaggaaactaagaatcacaataaagcaatacgggagatgaaggatgaaatagccagtataaaagagaccctaacctacctgacaaaggtgaataacaatataagcatttcacaatgcaatcacaagtattaacagcaggataaactaagttgaggaaagaacctctgaacttgaagacttgctctctgaaataagacagtcagaaaaaaaaaagaataaagaatagaaaagaatgaacaaaacctctgagaagtatgggattatgtaaagaggtcaaatctacaaatcactggcatccctgaaagggagggggagaaatcaagtcacttggaaaatatattttagtatattgttcatgaaaattccccaaccttgctagagatgccaaaagtcaaattcaggaaatgcagagaactcctgcaagattctacacaagaagatcatcccaaagaaacataataatcagattttccaagattaaaataaaagaaagaatgttaaaggcagctagagagaaagggcaggtcacctacaaaaagcattccatcaggctaacaaaagattgctcagctgaaatcctagtcagaagagattgggggcctatattgaacaacttaaagaaaaaaatattcaaccaagaatttcatatccagccaactaagcttcctaagcaaaggagaaataagattcttttcagataagcaaatgttgagaaagttcattaccaccagacctgctttacaagagatattgaaagaagcactaaatacagaaaggaaagactggtactagctaatacaaaacacacttaaacacacagaccagtgtcactataaagcaaacacacaaacaagccaacataagaaccagataacaacacaacgactggaccgaatccatgcatatcaatactaatcttgaatgtaaacaggctaaatgccccatttaaaagacacagagtagcaagctggataaaaaagcaagacctaatggcattctgtcttcaagagacccatctcacatgtgatgacacccacagtgtcaaaataaagggatggaggaaaatctaccaagcaaatagaaaacagaaaaaaaagcaggggttgcaatgctaattttggacaaaacggacttcaaaaataaaaaagataaaaaaaatacaaagaagggcattgcatatggtaaagggttcaatccaacaaggagacctaactatcccaaatatatatgctcctatcacagaagcagccagattcacaaagcaagttcttagagacctacaaagagacatagactaccacacaataatagtaggatacttcaacactccactaacactattagacagatcaaccaggcacaaaattaacaaagatacttgggacctgaattcaacattagacaaaatgagtctgatagacctatacagaactctccacccaaaacaacagaatatatattttctcattgccacatggcacatattctaaaatctaagaactgcctatggttactgcatgttcatgcttgtaagtggcagctaaatgatgagaacttatgaacacaaagaaggaaacagcagacactgggtgtcttaagtgggagggtgggagtggggagaggagtagagaagctaattttaagtactgggcttaatacctgggtgatgaagtaattagtacaaggaacccccatgacacaaatttacctatgtaatagaccttcacatgtacccttgaacctaaaataaaagttaaaaaataaaaaataaaataaattatgtttgtaacacttatagctactatatatacagcaataatagcacaaaaaagggaaggtgagctccatggattagttttctatatcttaccggaattaagtctgtgtaaatctgaagctgttttgacaaattagaataaaaatgataagcattagggcaagcactgaaaaaataacacaacattatatgaaaatatcattagagaaatgtaattgctacattaaaaaatattgacttagtgctaaattatacaccaaagaaggaatagagggggaaaatgtgatacatagagaaaataaaacaaaaggcaaatataaacccaactatttcaataataacattaaatgagaattaatcaaacagtgcaactaaaaaactgagattaaattttaaaaaatgatccaacctataagatggctataagaaatatactttatatttaaataaagaaatagattgaaagtaaaaggataaaaaagatataataatagtcacgaaaacaaagctggagttagtatgttaaatattagattaaatagactataaaacaaaaaaattattaaagaattatttataatgataaaagggccaatccatgaggaaggtaaacagttataaacgtatatgcatctgataacatgtcaccaaaatacatgtagcaaaaactaacagaagtaaagagagaaatagacaatagacaatgtgacaataatagaaacttcaataacccagttttagtagtgaatagaacagttatgcagaatatccaacaggaaatggaagacttaaacaatattataaaccaactagctctgtcagacaactatcgaacactccactcaacagcggcagaatatgcatttacttgagtgcacatggaacagtctcagcttagacctgttgctagtctataaaacaaacctcaaaaaattgtcaagtatagaaataatacagagtatgttcttcaacaaattagaaatgaataacaaaaatttgtgaagctttcaaatatgtggatgttagacagcatgctcctaaataaccaatgagtcatgaaagaaaccacaggtttaggcgaatgaaaacgaaaatacgacattgtaaaatgtgtggcattcagttaaagtagtgcttagagaaaaatgtataactttaaatatccatattgagaaagaagaaatttctcaaatcaataacttaactttttaccttaaaattccagaaaacgaagagcaaactaaatctgaagcaagcaaaagaaggaaataattgattagagtagaaattaatgaaatatggactatacaagcaataggaaaaataaatagaatgaattagggtgtgctttatggctcagtctatcttgggtttatcttggtggatgttccatatgagcttgagaagaatatgtattctgctatagttagatggaatattctataattatccattagattaaactgattaattttgttgtacagattatattcttacttattttttgcctgtttgatctatcaattacttataaaccataggcagttcttagagaatatttatagacataaatgcctatattagaaaagacgaaatctctcaaaccattagccttagattctaccaaaaaaaaaactagaaattggagagtaactaaacaaaaattaaggagaagtaagaaaataataaagattagacaccaacaaatagaaataagaaaaatagagaaaacaaatggaacaccaaaacaaacaatttacaaactcttagattaactgaccaaagaaatagaatacataaaatgtcaacactaggaacaaaagagaggatattattaccaatcccaaagaaactaaaataattacattatgaacacatttgtgctaacaaattacacagataatttagatgaaatgagaaaagtgcctggaaagacataatataaatgactccagaagaaataaaataatcttaaatacatgtaataagtgaaataactgattcagcattcttgacaaataccacaaaaaattggcccagatggttccaccggtgaatttgatcaaatacttaaataataaataataagagtatgttacactttcaaaaaatagaaaagatgaaaaaattttccaactcattctgcaaataatgtactaacataaaagccagacaataccacaaataaacaaaaaactcatatagatagacaatccttaacgaaattttagcaaacagaatttgacaacatataaaaatgactttacaccatgaccaaaataggattttttttttctttttttaagacggggtcttgctctgtagcccaggctggagtgcagtggcatgatctcggctcactgcaacctccacctcccgggttcaagcgattctcctgcctcagtctctggagtagctgggattacaggcgcctgccaccgtacctggctaattttggtctttttagcagagactggatttcaccatcttggccaggctggtctcgaactcctgacctcatgatccacctgcctcggcctctcaaagtgctgggattacaggcatgagctaccgtgcccggccaaaagtaggatttttaccaatactctaaggtttgtacaccattcaaaaataaattaatgtaacacacaatagtaataaaggctgaaataaaggaacatcgtatcaatagatgtacaagttctaaatcatgtcatcatacaaatgttggaagtattttttcctgaaatccaaataccgcatgctctaatttataagtgggagctaaataatgagaacacatagacacagagagaggaaaaacgcacactggggactttcagagggtggacggtgggaggagggagaggatcaggaaaaacaactaatgggtagtaggcttaatacctgggtgatgaaataatctgtacaataaaccctcatgacacaagtttacctatgtaacacacctgcacctttacctctgaacttaaaaaaagaaggaagcaaaagaaagtttttccacctaataaaggacatgcatgaaatactaacagtcaacattgttcttaatggtgatacactgaaaactttctctccaacattagaaacaaagcaagagtgtccactctcatcacctctattaaatattatgctggaggttctagccagtgcaatcaggaagtaaaatcaatgccccaaaataaattacatttttattagggcaagaaaaatcctataacaatactttccattagaaaatatactaaaagcacactccataaaagaaaaataaaggtatattggacttcatcatttttttaaattgcaattcagaagacattattaaaaacatgaaaagcaaggcaaagataaggagaaaatgttgataatcacatatctgataataagaaatgtacccagaatatatataaactacattactcaatagtaagacaaccaaattaaaaatagacatgcgatttgaatatatatatatatatatatatatatatatttcactaaagcagctatgctatgcacataagtaataagcacatagaagcatggtcaacaccattcaacactaattattaaggaaatgaatattaaaaccacaaaaactattacaaatgcatcaaacttgttataattcaaaaacgaaaggcaggcaatgctaagtgttgttgagaatgtggagaaattagaactacccatatatactgctgctgggaaagtaaaattccacagctatttttaaaccaattggcaacttttaaaaaattaaaaatgaactttctataccacacagcaattatcctcctagagatttattcatgagtagtaaaatgtatgtccacataaaatgtgtgtacacatatccatagccacattattcataatagcttaactacaggaaatcatccagatgttgtttaactggtgactggataaacaaaatatggtatatccttccaacagaaaaacatttagctataaaacataaaatattataaaactctcagtaatattggaatcgaagttttttccagctaataaaggacagttataaaaaatcaacagttaacactatatttaatggtgaaagattcaatgcaacatgggtaaacataaaaataatatgctcactagaagaagtcaggtgaaaaggactacatattgtgtggttccatgtagtggaatgtttaaaaaaataaattatggcagaaaggaggtcagtgtatagacactgacagtgacagagctgggtgtcagagtggagggataaaccacaacgaggcaggtgtaaactttttggagcaataccaatgttcaaaaacttgaatgtggccacgcacggtggctcacgcctgtaatcccagcactttgggaggctgaggcgggcggatcacgaggtcaggagatcgagaccatcctggctaacacggggaaaccccctctctaccaaaaatacaaaaaaaattagccaggcgtggtggcgggtgcctgcagtcccagctgctggggaggctgaggcaggagaatggcgtgaactcgggaggcggagcttgcagtgagctgagatggcgccaccgtactccaacctgggcaacagagcgagactccatctcaccaacaaacgaacaaacaaaaacttaaatgtgttaatggtagaacaattctataaatttagtaaaataaatgtttacttttaatggatggattttatcgtatgcaaattttatctcaataaagttcttacaaaattcctgctctttcaaaaacgctatcaacaaaatgaaaaggtatgacagcctaacgcagtctgagaaaaatatccacaatgaatagaaaggacaaaggacctgtagaggacatatatgagaaatatctacaaatcagtaataaaagtacaaacaatacaatctgaaaaatttatggaagacttaaacagcacatacaccaaggtacaagaaattaaagaagttcaacatcattagccattagaaaatgcaaattaaaactattaggagataatacttcacttccacttgaatataaagcttagaaaaaaatggcaaaaaaataaaaaaatgagagatggataatattaaacatgagtgaggatgcacagtaaaaggattgatttcatattgtgggtagaagaataaattgttactgtcattttacaaatcaaccagagtactagcaaggccaaatgtatgtaaaacctacattccatcaattatactcctgattatatactcaacataaatggaactatgtacattatcttatatttattggacatgtatcccatcaaatctatacacagtttctccatttattttctctaattttcttagtcttacaaaaggttcaaatgataaatgagtggtggggaataaatacctatttatcatttgagcacatgaactttctatgcaacacagcaatctaaaaataaatttagatttagagacaaaataaaatgcagaaatattgtatacctttttcccttagattagtcttatctcctcactctttttacatacactgaatctacagaatgcttcctaggtttatgtactactttctcaattatttcaggtttctaaaaaataacttgtgtgataatgttgcaaaagagaatagtaaaataatgtaattgccaatgtatgaatatacatgcatgcacatgtacatattatatatatatatttatatgtgtgtatatataatttagaggaagtcatactgagtagaataacaattaaatgaaatgtgtatcgcatctcagtagaggcatttacaaatcttattagatttcttattttatggcaaagtcttaaaatacattagcattacatcaaaatagtcttgaaatgacctaacataccttagtcttatttcatacgtttagtcttgaaaagaacaatcctgaaccccgttagctctctaacatactagaccgggttaaaaataacatgatgtattattttcatttaattcaccaacccaactctgaaaggcacaaatgaaagaacaagtcagagagccccaactgtcctttataattaccttgggatcaccagctagaggaagagcagcaagggaggcgaatatctttctacacgtttctctaaggaatagcgacaggctatgtcgagggaagaagccattagttctttccatgtattttcaaagaacttactcaaagatgaatgagattaactgaaactaaattcagtagaattgaggggtaaaatattcagatagcatatatctgcataaacaaatagtggacattgcagcggaaagcagtagaaaatcacaactctctttctcacagtaggttttgtgtgtgaagtaggctccaactggggcatagggaaatttcaatgctaaattaagtttcaacttttgattaatatcttagatttggagattctaatttctgatttgagatgactttgtgacttaaagtagaattttctgttaccaaaaagttaacatgaaaatcatgaacgttgggaatttttatttagggtcagagaaagaccttctcttaagcaaaattttaaagaaatagtgagagataaatataaagtgtgttttgattacgtcatgagtcatattaatcaatgtactagtctcacacatgttgtatcttaagcaatttgccttaaattcaggaagtctaatgagccagagctgaactaacagcaagtatatgcattgacaaacaccagattttccaggcaacataagctgtgagtttaacttttaaaaccatttgtaatgatatggagtaatcttgcaatggcaattcagcatcatgaatgaagattttcagcctttcattagagttgtttcttgggagttctagctctgccacccagtagttgtgttatgtggaacatcctatacattccataggccagcaaaatgaatggctggtctgggtgattcttaatatcgacaggatgccattacgtagaattatcaaaggatattggtagctaaatggattgtacattcctgtttctgtccacttacttatagtgtaacttttagcaatttgtttactttctctaaatctctttgtcgcatgctaaaatgactgtcctgcattcctatagagtatgtgtgggttcaaaaaaaaatcatactggatacttttgaaaactttaaaattatttggaaatgtggggtttgatagtaattttaaaagatattctaatacaatgtaatatgagcatcaacccaaaactttcctattttcaatggtgaggagggaattctaagggttatcagatatacctgctcccgccttcttagtctattcttatcttgaaccatatgctattttttcccttaactatgacagacacaggtattcaccaaaatgtagaggtaacaattccaggttgtcaaaaatttatttcattttaaacaagaggggtttaagaagcaaacaacatttgttattatcagctttgctgccaaaaaggaaaaggattgctctagatatgactgtggtgagaaatcctcacattaaacaagctgtcagtttatgccaaagggccttgaattcttatttttaggtaacacttattatttgattgtccaaatttattcaaataattcaggtgaatgtctacaaactaaaacaaagttattaaatatggtgcaaataaatgacttggcaaatgacaaaaatatgtcattgcagatttagatattgacagtaaaactccatttttttcatatataatttcctttgggaaattgattattttataaattcagaatacctataatggatttattaccacacataggtttacatacctctgagtgtttctatacagtagaaatttcagtcaatttggaaacctacacattaggtctgcaaaattttgacacaactgaaactcttttaaatcttgtgtctgtgacttggaattctttcagtcattagttataatatctcccattgtatttatccctctatagcttctatataaaaagatagaagcaaatttttatgtcatagatcatctttctcagaatgttttggttattatcatgcccagcttattaaagaatttcagtgggtgatgataataatatgtagttactgattttttcaattattctggtgtgtgtgttggcactatactattactagactaatagtttgttcagcactctcaacattttattatacaatactaaattatttttggttttctagtttttagctcctctgccctggcttttcttatggcttacttgcttggttctcattgaaggacttgaatcacacactagagaggagagagtcagcagagttacagcttctctcccgccctttcactcaagctggccctctatgctgagagcaccactgtgattgcttcttctctgtttccctctactggttaaatttctagatatagtttgaattgacaccagatgaagcaaagtacataatgactccctgcctcacagaactttcctcttaaagaacaagatatatagttgacattcccaattttctaaaaggttattgtattagggtagtagggctgccataaaaataccacagacaacatggtttaaacaatagaaatttattctgtcactagtctggaggctaaacatcagagactaagttgttggcagggttaatttctttagagccttctttccttggcttgtggatggctgccttctccctgtgtcttctcaggatctgcctttcacaggtatctgtcttcttctttttcatataaggacagctgttacagtggattaggacccaccctattgatttgaatttaacttaattactattttgaacaccctttccaagtatggtcacattctgaggtactgggggttaagatttcaacatataaatggagtgaggatacaattcagcagctaacacttaaaaacgctctccaaacgtctttcactggaatttttgtaaaaaacttggttattttcaaacgtattttaaatgttagacattggcaagagacaactagctagaatgtttaggaaaatcgttttctgtatttttcacactaaatctatttattcattcagattctcaggaattactttgaactttttatatcttcaagcaaataatggctgcaaaagaagaattaattttcgagttgagtgtttcttttttttttctagtgaggatttgaacttcttccaatgttagagagcacatgcaataatagcagtgcacagaaatgctctccacaccatgttatttaggaagggagagtttagaggttaagaggttgcactccaaactcagaaagactaccccagaatttcaccttcactgctttccaattttgtgacattaagaaagtcgattgatctctgtgaacaagtttgatctgttttattataaggaaaaaaagaaatgatatatttgtgtgtgtacacacacacacacacacacacacacatatataaataaaacaaagcctctacaatgactaatatacatgtcttaagatttttagcaattttcacaattgcgattgaaatcatctcagctaagcaaattaaaaaaaaacttttctcagttgttaagcttggattcacatttatcggaattttggcagcaaagagatccagctcaagtgatggaaaatggtggctgcaacataagaaacatattttcacacattgtcaatgaggctttagtagagctgggattcaagtttaaatttccctagaatttttctgttgttcagttaaggctaacctcaataaatggtgaatctattataagctgggataagtaatttaaaggttacagaagtgaatgtgcaaacatgagtcttgtccttaaaatctttcaatcgagtgagggtgggtgataattatggaaggcaaaatgcaatttttggacaaatgagatatggaagctttaggaagttcacaggagaagaaaattaaaacaaaacagaacatttaagccacttgagtggctaaatgctcaatgatagaggtattatgaagacataaaccttaaaattgtgttcaatggtgtaagagggcaaaggaaaggtaaagagttttgcttggattaattaggatgatagatatgtcaattacatcactttttaaaaatatagtctattcactatattcttcaataaaaaaaattgagagaaatagtctgagtcacaattagaaggcttttggtgtttagagaatagtcacaactaactggtaattcacacattattactgcaatccatccaaggatatttctttatacatgaaggtatgattcttacgtttaatgctatgaatcatatcagatagttcaataacttaaaatggtatttagtgttctggcgaagtgtgatgtcattaaaacatcccagatgataagcaaatggaacattctttcttggcaaaaccaatggtattggtcaaggtcaataaatcacatctgttgggtttttgcaaacataagagtggcacaatatcagctgatatcctggtgaccatgatataggtcttagaataatgattatcatagattgtagtttggctggaggtggggtatatttgcagctgagcagcccatatgacatagaactgtcatttgggcttggggtctctaaactcttactgaatgagttaaatagccactggaattttcatctcatttcttatacctcatttacttgcaacttttctttattatttgtttttcattaactgctttgcaaattaacactgctgaaagcccattgtccaggacaggatgttgagttccagagattcttcttggagttgagataaagtggactattacttcaggaacaggtgtatcactttagcagtgactggtacacaacagctcaataggtaagaacctagtattgttctctgattaatatttttctcttctgtccatgcagtcctgctacttttcttcctttatctattttaacaacattccattggattcatttgatgatttggataaagacaccccatgaactacaaaatccgcggtggcagaaacatgtttaattttatttttgtttatttttaattttttattttatgtatttttttcagagatgagctctcactatgttgcccacctggcctcaaatccatggactcaagtgattatcctgcctcagactcccaagtagctgggactacaggtgtgtaccaccaagtccggcttattttctaatattctatctttagttcctagtattgtacctagcacctaataaaaacatttgctagaataattttctttctattaaaaatattaattgatcatctacaactgaatgcaggaaataatgatccaaatgaaagaagaaaaatagtaaggataatggtttcagaaaacagttaaaaaaagaataaaagaagggacagaaagaaataaattgaaaaagacaaatgaatagaagataaaagtagaaaacaatatcaggaataaacaaaggaaaagctcctggcttgtccctctctaagtgattgacacagccagcacttcctctttaaaaaccaaaacaatagagaagagttatttcaaattctgaaatttaatgaaaaaatattttattgatttagtaaatatgtattgagaagtattcttttaagagttagccatatcctgtaaggaatagccgtaccattattatctgtacagagatgatagagcgaaaatactgaatgtgctttaagctgttaggatatgtcacagacgagatttaattttgtctctaaagaggtacagaaaacaacacttttgaagattcaaataaaaatgtccagatgaggaactttattttttgtaacagcatgatcatttaaaagcaccagtctgagtcttcatagtctaataaactatagagcaaataaaatatacccaatctacaacaggcataacattgtaaatattctgtgccttgaaacatttatgatgattaagaatatggtttagcatttagctgaataatgttttaaagcatcaaaataaaaattctttcattccaaacaacatattttggacattttaaaatatattacaacattaactccatcatttatacgttagaaacaagcccaaattctcctggtaatacaaggaataaaaaattacagaggcaccttagactttgttttctaggaggagatttggcacaaatatggatagaaattgctgagctgttctataaatttgatttggttttagaagagattaattcattacctagtgtcctcaaagaaaagcaaataaataaacttgtagtcagtattcagcaaatattttgatcatttatgtctaaagcttttcagtgtccaagaaaatttgtgtaaagcaggatgtcaatcaggatctcctggaaccatggtgatttagacaatgctggtttaaacctctaatttcataccctgtggaaggagatatttatctggtcctagataaatgtaacatttaatattaaagaaaagacaatatggaaataaccacaatactggaaagaattgaactaatgacaggagaaaggctaagtattttgtaaaaatatgtgataaagaaggaatacttaacatctatgagaatcaggacataggtcatcaaaaggcataaggagataatgccattaaacgtggaagagagagtgtgagtaaggcagtgtggcaagaaagcacggggcagttctgcttctgacactaacagacatattggtactggctctaccataaaaaaatgaaagtacctgtgattggtccctcctgcaaccaatcagcaatcagactggtcttacgccaagacttcgtgtaacagactctgtaacttcacttcagcctctgattggtcaccttctgcaatcaatcagactgattgcaggccactacttcagttacatagggtgtaaaccaagtaaccaatgggaaacctctggagggtatttaaaccctggaaagttctgtaaccagcactcttgagctgcttgctcaagcatgctcccagtctgtggagtgtactttcatttcagtaaatctgtgctttccttgcttcattcttatcttgaaacaaacaaacaaacaaacaaaaaagcatagaaaatagctgaggtaatgggattcccaatttattaacttccttctttcataataataaaaataatgtatttaatagccactttctttccttaaaagggccaaagtgacaatgtgcagatgttccaaattgccattattttattcaaactgataacaacggagctgtcctcttgctctagcaaaagagaatcattgccaaacccgatgtagagggttggataataaggacatggtcaacaataaagataactgttgcaaagtaaaactgcttaaattgtcatcaaatacctccatcctcttcagtagggaaaggatccctactaacttttagtcgaccatggtgaaaagaataaatgtttcccaagtgcattttcttttctataatatttgatcattccatgatgttacccaaaaatacattagacatacgttatcactaaagggagatttagtatactgctcagtctgacaacaacctggcaagtttcatctatttgaatcctacatattgttcttcacattgtaaaatacaggaagaacagacatgttctgttcttctaacttacaaatgataaaaggttgtcagttagcaagcagctcctcatctcaaggaaagtgagaaaatagttaaaatagccggctctcagtaactgggagactttagcatgaagtcaaagtttggactagatcacatctaagaatctttttcaaagattttctgcacagtgcttcctaaacatcttccaataccattttttttcattcttataatttataagaaaagcaagctggatcccggaaacagtactatcacctgctgatgataccactgcatgtgtccttcagctcagttaaacctccatttactcaacagcaaaatgaatataataacatacagtgtgggtccatttgtgggagtcaagacaaatggtgttttacaaggcatattacaaatattgggaattttttgtgtaggcatgtgccatgtccatgaaattttcaagctagaaaggatttggaaatctaatgttatttcacaaatgagaacactatagcttagaaaggttgagtgacttgtcccaggtcacatatgtagttaggggcagaataagcaataaaattcagactaaatcttagccttttgttataatatcacaactaacccaaatacttagagacaaccaaatccttgtgtcttttatcttctactgggatagacagtagtaaaacttataccaatcattcattgaaatgggcgagttcagatttacatccaaaatctaattttttttttttttttttttttttgagatggagtctcactctgtcacgcaggcgggagtgcagtggcgccatctcggctgactgccagctccgcctcccgggttcacgccattctcctgccttagcctcccgagtagctgggactacatgcgcccgccaccacgcccggctaattttttgtattttttagtagagacggggtttcaccgtgttagccaagatggtctcgatatcctgacctcgtgatctgcctgcctcggcctcccaaagtgctgggattacaggcgtgagccactgcacccagcctgatttgttatttttaatctttcccaaatagtattttctttttttacaattttatttttatttcaatagttttgggggaacaggtggtgtttggttgcatgggagagttctttagcggtgatttctgagattttggtgcacccattacctgagcagtgtacactgcacccagtgtgtagtcttttatcccttgcccccttccctcccttctccctgagttccaaaagtccattatatcattctgatgcctttgcatccccatagcttagctcctgcttataagtgagaacatacaatatttggttttcgattcctgagttacttcacttagaatatatcgtcttaaactccacccatgttgctgcaaatgccattaatttgttcttttttatggctgagtagtattccattgtgtatatatatatatatatatatatatatatatatatatgcacacaatgtgtatatatatgtatatatatacacatatatatacaccatggtgtatatatatatacacacactatggtgtatatatatatatatatatatatatatatacacacacacactatggtgtatatatatatatatacatatatacacacacaatggtgtatatatacatatatacacacacaatggtatatatatatatatatatatacacacacactacattctctttatctactcattggttgatggacatttaggctggttccatatttttgcgactgtgaattgtgctgctataaacatgcatgtgcatgtgtctttttcatgtaatgacttatttttcttcaggtagataaccagtagtaggattgctgaatcaaattgtagttctatttttagttatttaaggcatctcatactgtttttcatagtgttgtactagtttacattcccaccagcagtgtaaaagtgttcccttttcaccacatccatgccgacatctattattattattatttaattatgaccattcttgcaggagtaaggtggtatcttattgtggttttgatttgcatttccctgatcattagttacattgagcattctattttctagggaagggaggtaagtcagcatttatccacccctactggttaatataatttagcaccttctcacttgtattcctgtctgtgtcatatttaatgagtcaaaggctgcatttagggtacacacagggctgaagcttataaaataagagattgctatcagcctcataaaaacaagccaaaaaaagtatatttgttatatcttgttatacctttaattccaggaaccttagacttggtggttgttgaattaaaaaaaatgttgcaatgacaaaaataatacactgacaagaataaaaacaatgataggagatattttctgacacctatatattttgtaatgtttttagtttctatattgatttaacaccaagggaagattatacttaccattcttcccagtttacaaatacattttctacttctgaaggaggattctcagtttggagtgtaaatgtcaccattgtttaaatgccacctagcttgtttatgcatttggcatttggccacctaaatgcgtggcaaccaattactgcatttctcatgggaaaggacacaatcaggagatggaaggaagactcgcctttttgtaaaatatgacattttgtaaagctaatcaatttacacatgtttttctaggagtctgtcccatttttcatgttgggctattgttattattattattattattattaattttagccaacaattggtacatgaacttgtaaccagtgttgagatttggcatctaagactgaacataatttgtcatgagtgaaactttccacccctgtcttccattattctcttttccaaaccagatgggtaggcacagtgggcaaactgttctttcctgtgcagttattttcacttattaaaatagaataaacaagtaaactgacaattcaacaaaataatatatgtaaaaaacagacatttgggtggtagaaagaagtggtgatcaaggtagacttctgtgaggagatgtcatttaggctgagacaagaacaatggggaagggggccgggcacggtggcttgcacctgtaatcccagcactttgtgagggcgaggtgggcggatcacctgaggtcaggggttcaggaccagcctggcctacacggtgaaaccctgtctctactaaaaatacaaaaattagccgggcttggtggcatgcgcctgtaatcccagctacttgggaggctgaggcaggagaatcagttgaaaccgggaggcagaggttacagtgagctgagatcgcaccattgcacactccaacctgggtgacagagtgagactccgtctaaaaaaaaaaaaaaaaaaagaacaatggggaagggaaacaatgttaatgttctccatgtgagaaggaggagtgtttcaggaagtggaagcagcaagtataaagaagctgagaaaggaatggttatcacatgttacagaagaagggagaacagtgtggatgggacgcagtaaagaatgagggagaagggtatgacacaacagtagaaaaatattcaggagacaaatagtgtgagttgtatattaaggcaaggacataaatcctaccttgaaaaaacttgaaatctggtagtggatttaattttaagtatagcaaaacacaaaaattatattataggaattagctagagattgaatcattacaattaccctatttaagacattatttaattcttggagttcaacaatttttttatggcttattttgagccaggtcatgtaataggcacagtactctacataaaaggtagcagcatggtttcttctttgaagcacttacaacctagttggtatattacattgtaaatatcatggcggagaggatcccagggacatatgggtagacacaccagaccaggtgtaatgggatagtttccagaaggaagccttcaattgactcttgaatatggaaaagaagtgaagggaattaagatctgggtgaatatatagctagattaatggtatatggaattataaagtggcacaacgcaactgcgcaattcagcaatgctgaatagagtgaaaagcattgatttcacttctgctttggatgttcttccacccatcttcccaaccctgagttccacatgtgcgtgtgtctccaccgattcttccaggctcaactcaaacattacctcatccctccatgaagtattccagatgttcacagaaagaaatttcgttctttataggtaagacccaagtctaatttgtctctatttctactatgatgcccaggggattgcacatagtaggtggtcaaaaaacattattgaataaataaaataaattaacctatcaacacaatctcaaagttcattaccaatttcagcttctatctcaaaatagtcttaactaggttgctctcagtctcaaaaatggttcccaaactaattaggctaccatactttctacttgaaacgtatcattttcattgacccctttcagttcctccaatagtggccctactcttttttctttctggtggttactttctggtatctagaatcttagacatatactagatcttagaaaccatctatttcagtgatctcaaacctggtttcacatttaaatcatttttgtgctccttaaaattatctgactgaaccccatcctcaggaaattctcatttaattggtctgaagtaggtcttagacactcctgaggtgattctaatgtgaagccatgacttagaaccactgaaattcatcatattacgtattttgaaagccacttaatacaagtgaagaaagtataatccaaaaagataaagtgacttgtctaagagtcacaaaaataatctaattgtggcaaagctatatctggagcctaatcctttctttcttctcaaattatcaagtacaagaatccttagtcatgttttctgaatgctcctcctggtacacacacacacacacacacacacacacacacacacacacattctttctctgagaatatacacaggttggtctgcaagcaatgcttagttttcattaagtctttcctaattgcctaggtttgaggaacagcatttgttttcatgacagaatcgaactctgtttcagagttcagagacatactcacttatccggaattgacagcaaaaggaaggaattccagaggtaagcacgatgaaaaatctttacaaagataaccttaaactggatttgtttttctttcttgagactagttgtgagaatttaatgagataaggcacacaaagtattaatacttagtaaagctcttaggtcatattctgtctctatcagtcatgacttctattatcattatcatagtagattagtgctgaattggcagcaatgcagatacttaatgaacagagtagggaaggaagtcacatacatacattgtgcatctttctgacatcattatatatggacagtttaatttaattcaaatattagccttgtgaattaggtattattgtcccaactttacatatgagaaaactgaaactcagagagacttagtaatttactaagtattatccagctggtaagtgatggagctaggagttgagccctcatctaactgctctcaaagcatatgtgattttttatccacaccagattttctcaatttttgttatgacattttgcagaaggagttagattaaatgcatgggtaactgaccataaatgggaaattaggactattattcttgcaatcctgacattttgaggttaataataaaataagtaaatgtttttatctttcaaataatgaacattggtgatattccagtttaaatgtaccacaaacatatgatagaaacctactgtggaaaccaggttgatcccatgctctccatatactatgtcccttactctctttgcttttggtcatactgttcataccacttgtgattccttctttcttcttatgcctctccaaatatccctcattctttcaggaccaacaaagtcccaccttgcctgttctgatctacttaaacctcccctttctcggcattcatattgcaagcatggttgggaccataaagattagtgtctttctttgtgagacagcctttgttcaaaagtatcagacatgagtcaaactagcttacacaagtaagaggaaagaactagcaaaacgaaaaggcatatttggtaacccatgggcacataatatatctggactttatgagggattcaaaccaaaatgagaaaacttttctttttctctcaccctctctctctctacatctgttccttgtcttctctctttacacgtgtttttctgtgccacattatggctgaactctctaaaggttacatgtccttttaggtcaagtgcacagtaaagactcctataattcgaattttgtgggaaagagactcttattattctagctttgctcattcagactgagatataatcacagcttcagtggagttgggggtgatcaaatttacttcaccatttaataaattgctctggatcattctctccttctaaatatataataaatagtattaaagttgcagaaaaatgtaaagatccctatggaaaagatagtgacttttatctcttttgtgctcttcacaatgcagatacttaacatctcatggatgattaatttatcaactgatggggtaagataaaaaacactattgagacatcttgtgtttcagtaagtgggagggtaggataatagatgtttagcaccctacaaccttgccagaatgaagacactgccaagcctacatagaaggagcaagagagatgcattggaataaccaggcttaaacagaacaaaatgggacacagtgggcaggaactgggttaatatgatctcactgcatgaggaaaccgtcacttaaagttaccctaagacactttggatgaacataaaaacatgatctttatgttttatctccagctcaggatgaacagactggagaaagagcatggattagcttcagcatctctaggaaatcaaatctttggaggactggactatgtagggtgatgctatggcctaagacactcttttcagcccactgtctatttttccagcaggcctttctttctgcaatagagcaaaaaaaattccttagctatgatcaatgtctattttggacaaaggctctgagaatggcaatcacatcttactacaaatgaaagcctttgtgtggatctccctaggaagttaggaattttatactcatctctataaaaactactacttttatgtaagtgtgtatttctcatagtgactagtacatgcctgagcatatagggatctttacacaaagtacactcattgaagtacaaatgaactctgtaggctcagctaggttcaggtgaccagtcactgtctagtgaataagggggtaaaactggaagactatggatgagaaaatcaaacatttatgtgatgtgaatactttcttcctttatcaaaagactgccaacattcagcaggcaagaatacaagaactcttaaagtgatggggccttccttttggccaagaactaagactatctaagaaaccaaaccacctgtccaaatttgggtacattagcctacgtcttctgtgccttagggcttaataataatttttacctgtcctactgacaagaaagacagatttttaaaaatataggaaatagactaactatgatatctgattcaaatctaaccatgtctaaaacaagccacataaaattcatatataaatcaaatgtatatatccttaatcttgatatgcgatagatccatctcacttgtagttggcagaattcatagatggacccacattcctactccattggatagtcctcttcccctctacaggcagaacctgtgaatatgatgagatagttactcctttgattaggttatgttatatttgacaagtggtgatgggatagtcacttctattattattttacatgatgtaagacttccttatagcagactggagtggaattaagaagtcagagagatgcactcctgctgcctggatgaaagcaaataggtttgtgtaaactgccatggagccatgagggaaggaatggaggtcacctctaggagctgagagctgccctggctgacaactagcaagaagatgagactgcagtaaaatagctgcaaaaaaatgaattttgcaaagaaaaaatttctgagattggaaaaggatcctgagcctcgggtgataactgaatccccggacaatgctttgatttcagcctggtgatattctgagtggagtactcagctaacatgaacctggactcctgatccatggaaattgtaaggtaataagtgggtgttgtttaaaccattacacttgtggtaatttttacacagtaatagaaaactatcagactgttcaagtagtcagtacactcatttactaattgactaaacatttagtgggaaactacttcatactaaatagcataatatgaaatggagagcaagagtcaaatgtgaccatccactacccctatgaaaatggcaaaatgtttcttagaaatgcatgtacctttaaatagagaaattatttcctgaacttctcagaatatggtcttgtttttattaggcataaataaatagatacacataacaaaagagactaactagaatttacacccagacttcaaggttttcacagaattgaaactgattccttcatgttgcaactgtttgctttcccacccatttttctcttttcctgtccaagccagaaacaaaagacaaaagtcccagtttatgagaaaaatatttgtagggcaaaggattttccaaatttctgagatgcctggacttgcaaaagtatcctttcttctcccgaaggtttttagcccaaccaggcagaggttgagatacgtggctgcaaaaaccatctgtggagtccttgcttcagccaaactaagctaggagagacagtgaatgacatatggctatagaataccaagggttgatgaaattctttatagcttctctgactataactcttgcataaaacagcccctcccagctaccatctttgccacaacacctacgcgcacagagcctattttcgttgtttcacacctctttcattccagatggcaaaactgcaagtattttttcttatattagaacttttaaagtccaatttaatttgtatagcctgaaatacaatttgtccctttggaagtttgtttttctttaactcttttagcttctgtatttgggtaacaaaactagagacttggggcagcaagagtgattagaagcatttgatatttctacgaagtgaccaatggcccaaattgagaaatgaaagagaaagagaaatacaaataaaagagggagagggaaaaagagagattaagagaggcagagaaagggagacagaaagagaggctcaagggatggggctacttctatcattgaacagctaatgaatatgcaggagattctacgctaaacattttgactgatcagtgataaatctgacaaactgtctatcctctaagccttcaccatataacaaaggaaaggtacgtaaatctaattaatcacaatttccagcaggccatgaaaagcattctaacacaggtgaagggggccaaaaaatgagagagggattctgcctggcccttgtgggaagactgcctggtagcttaggaataaggaattggaatggattttgaaatggatggagaccaaagaacttcttcaaggcaaatcatccctctaagctcacctcaggggcatgtctagtaaagacttcaagttttgtggttttagccttgtcatataccaaataaaatatgctaaatgtttattttcactaattattacttactgatacttaattgtagttgtagttctgtcttagtccatgtgtacagctgtaacaaaatgcctccaaaagggtaatgtgtaagtgagagaaatttgtttctcacggttctggagcctgggaagtccaatatcaaggcactggcagatttggtgttgatgagggcctggtctctgtgttcagttttgcttgtttctgtgtccttgcatgaaagaaggcagaagggcaaaaagggcctagcaagctttcttcagtgctaatcccattcatgagggcagagacctcgtagcctaatcaccttctaaaggcctcacctcttaatactgttgaattgagattaagtttcaacatgaattttgaatgagacacaaacactgaaaccatagaagatataataggctcttcttacattactataaaaaaatacatgaggctgtgtaatttataaataaagaaggtttaattggctcatggtgctgcagattttacaggaagcatggtggtggtaaggctttagaaggtaacaatcagggcagaagttgacgggggagcagatatgtcacatggtcagaacaggagcaagagagagtctggtgggaaggtgtcacatacttttatatgaccagatctcatcagaactcactatcgcaaaaacagcaccataccatgactcaagtcccagcctacatctttctcacatgatcacaaggtcccacaataggccatctgcctgctgaggagcaatgagatccagtctgagttccaaaactgaagaacttgagtctgatatttgagggcaggaagcatccagcatgggagaaagatgtaggctgcgaggctaggccagtctctctttccacatttttctgcctgtttatattatagcttcactggcagctgattagatgatgcccacccagattaagggtgggtctgcctttcccagctcactgactcaaatgttagtctcctttggcaacattatcacagacacacccaggatcaaaactttgtgtccttcaatccaataaagttgacactcagtattaaccatcatgctatctatctgttgttaggatatttaacagatatctatatttctatagatggatacatatgaagaaattcaccatgagggattggcttacatgactgtggaggttgaaaagtcccatgatttgccatctacaagctggaagtccaggaaagctagtggtgtagttctagtttgagtctaaaggcccaatacctgggagtatcaatgtcttaggaaaggagaaaatgaatgttccagctcaagcagaaagaataaattcactcttcatccaccttttcattccattcagaccctcagttgattggatgatgcctgtacacattggtgagacatctattattagtcttatttgttatccttactgttagaccctgactttcctaactttattgcctttcccccaccaggtgaattccagtgttctgtctttagacagtctactgattcaaatgctaatatcttccagaaacaaccatatggatacatccagaaataatgtttcaccagctatgtaagcattccttagcccagtaaagtcgacacataaaattaaccctcagagttggcatgatattttatccttattcttaaaccattttatgagtaagcaatatgattgtaaaatgatgaggctatttttttccctgtagatacaaatgttatagttaatagtataaataagtcttttcccttgtagaagaaattatttaatctctcctcattgttatgacatatacattataatagattccctgccatacaaatattagggttaatataggtaaagtacctatattaatactgatattaaagaactgtcaatatattgtagctatagttattaaatatcaacacaatgtgaagcatacttgagttgaaggacagttgtatatattttaaggtagatgtctcaaaatgaaacaactaagagatatttttatttttcataaatgattctttttccactcttcaaatgcttaattcacaacatggagttatccttcctgttagactcaaactttcttaaattcaagcttaaaatatctgactttcctaactttattgccttcccccaccatgtgaattccagtgttctctctaaagaatagatcctgctctctccattgagtaaatgtagcttataaaattaattacaagattgcaagctgctggctgggcatggtggctcatgcctctaatctcagtactttgagagtccaatgtgggaggatcacttgagctcaggagtttgagaccagcatgggcaacatggcaaaacctcatctctacaaaaaaatacaaaaattagcaaggtatggtggtgtacacttgtagtcccagctactaggaaggctgagatgggaggatggtttcacctgggacagggagattacagcgagcagagatctcaccactgcactccagcctgggaggcagaatgagagcatatctcaagaacaaaacaaaaccaaccaaccaaccaaaacattgcaggctgctatggtttggagaattgttccccagagattctattgaaatttgatcttaatgttggaaatgggagcctaatgggaggtgtttgcgtcataggtatgggccccacatggatagattaatgcctgcccttagggaagatcagtgagttcttgctctattggttccccacaaagctggttttttagaaaacctggaacctcccctctccttctcttgctcccctcttgtcatgcgattcctgcacgtgctggctcccctttactttctgccatgagtggaagcagcctgaggctttcaccagattcccaatctttcagccagtggaatcatgagccaaataaaccttttttctatataagttacccctcctcaggtattcctttatagcaattcacatagactaggacacagttcttgcctcaaaaataaagctcagacatggcatatagactttatctttttcaataatattaggtctcctgcacccatcaaagtattcgatggattgtaaactgcactcctctaagtggaggagacatgagccctttatatgtactggtcacttgttgaggtattgagttgacagtgtgctggcagccctcgcagccctcgctcgctctcggtgcctccttggccttggcgcccactctggccgcacttgagcgcttcaacccgccgctgcactgtgggagcccctttctgggctggccaaggccggagccggctccctcagcttgcggggaggtgtggagggagaggcgcgtgcgggaactggggctgcgcacaggcttgcgggccagcgcgagttctgggtgggcatgggctcggcgggcccacactcagagtgaccagccggccccgccagctccgggcagtgaggggcttagcaactgggccagcagctgctgcactcgatttctcaccaggccttagctgcctccctgctggcagggctccggacctgcagcccaccatgtctgagcctcctccctccccagctgtggggtcctgcgcagcctgagcctccctgacaagcacagcccgctgctccagggcgcccggtcccatcaaccgcccaagggctgaggagtgtgggtgcacctcaggggactgacgggcagctccatctgcagcctactgcaagatccactgggtgaagccagctgggctcctgagtctagtggggacttggagaacctttatgtctagctgagggattgtaaatacaccaatcggcactctgtatctagctcaaggtttgtaaacacaccaatcagcaccctgtgtccagctcagggtttgtgaatgcaccaatcggcactctgtatctagttaatctggtggggacttggagaacctttatgtctagctgagggactgtaaatacaccaatcgacactctgtatctagctcaaggtctgtaaacacaccaatcagcactctgtgtctagctcagggtttgtgaatgcaccagtcggtactctgtatctagttaatctggtggggacttggagaacatttatgtctagctaagggattgtgaatgcaccaattggcactctgtatctagctcaaggtttgtaaatgcaccaatcagcactctgtgtctagctcagggtttgtaaatacaccaattgacactctgtatctagctaatctagtggggacgtggagaacttttgtgtctagctcagggattgtaaacgcaccagtcagcaccttgtcaaaatggaccaatcagctctctgtataacagaccaatcagctctctgtaaaatggacgaatcagcaggatgtgggtggggccagataagagaataaaagcaggctgcctgagccagcagtggcaacccgctggggtcccccttccacagtgtggaagcgttgttcttttgctctttgcaataaatgttgcctactgctcactctttgggtccacactgccttaatgagctgtaacactcaccgcgaagttctgcagcttcactcctgaagccattaagaccacgaacccaccgggaggaacgaacaactccagacatgccgccttaagagctgtaccactcaccccgaaggtctgcagctgcactcctgagccagcgagaccacgaacccaccagaaggaggaaactccaaacacatccgaacatcagaaggaacaaactccggacatgccgcctttaagaacagtaacactcaccgcaagtgtccagggcttcattcttgaagtcagtgagaccaagaacccaccaattccggacacagtatcattcttaaggactgtatgagtggtgacatacagaagacacagaggctactttgataaatggaaagggtaattttagggttttaagcagtagcaaataaatacatccacttcagcctactttaaaggctgagaccatggtaaaaagcaaaatacagcttgaaatcttgtccagaagggtctctgctggtttctcaatgtaacatctaataaaaaatatgttttaatatctattatattcaacccaggcaaccccagctgtcaatcaggctgacattcttttgcttacagtatttagataaattaaactgccagtcttcatttttcctgatggctataccaacatgtcccatttttatctcagatcttatttgaatttaaaatcatactagtgccttcagagtccttactttcagattgctatcttctgcgatgaaacccaggatactagggcccaagccttcaattcaaatgaagtctgaccgctacatcagagggggacgttgttgctgagtcaggagggaagaggcttgagagctgtgtcctaagatgacagcaaatggctaaaaggtgaggagaaatcttcccatctgtgaagctgtaagtacaacaactcagccagccagggtttgattacccccaaacctgaaccactgaggatgtccctgaaggtggcattgggttagatttcttaccattttagaaacctgagctacatcatgtgggggctttggaggttcaggacctcagacagtagtcgcgttaatgagattcactaactaaagcaagagcaatgaagaaacactggtcactggcctccatttgcatcctcaacttaaattcagtctaactctaggctaaatcacccagtaggcaagtttgacactaaggtctgcctatgcctgtttccaggtaacactacttttgctgtttatttacactacctcttagcattctcacgttactttgttactgccatcactccaaacccccaggctatatctaattttcaccctacttagcaatgttatttaagccatgaccactcatttgcacatgtatatcagcaaaatttacatttcttcgctgctcttaggaagtatgaaaactaccagtcactcagcaatccatgggaatcaatttaatcagctaacagagcagcaaagcagcagctttccatatttattctgaacgagcagcattagcaaccctaggaaacttgtcagagttgcaaatttccaggcaacacgtcagatttattgaatcaaaaggtaaagtagggggcacatagtcctgtaacctgtgtttaacaagtcttctgagtgattcagacatacaggaaggtgtttgaaccactgagcaagaatagctcaatttgaataaagtggccagatctgcaatttactgaacatctatttctttttaaatagaacactttttaacccaaaataaagctccttggaacatggctatcttttatttatgtttccatgtcccaaatgttaccagtatgtgttgaatacaatggtaagttataaaaaatgctgaatgtaaatgaaccaacagaatttcaaatcacagagttaaactaaatagaacctacgctcttaggaggcaggttggccttgtggttaaaagtaaaggctttccaatcaaatggatcttggatcaagtgccaactcaaccaattcctgggcatacatttcttaggcagcttattatttatctctagatgtcaattttcttatctgtaaaatgtagatagcagatcctatgcaaaatagttgttgattgggtttggtgatgtctttttagagtgaaaagataaaccacagactgggagaaaagcattaggcataactgataagggactattatctaaaatatacaaatagcactaaagactcaacaatggagaatgaactatacaatttaaaaaaataagccaaagaccttaatagacatttcatcaaagaagacatacagctggcaaataagcgtataaaaaatgttccacattatgccatcagaaaaatgcaaattaaagcaatgagataccactacctacctactagaatggccaaaatccagaacactgacaatatcaagtgttggtgaggatgtggggcaataggaactcccactcattgctggtgggaaaacaaagtacagccactttggaaaacagtttagtggcctcctaccaagctaaacatactcttactatatgatccagcaaacttgctctttggtgtcttctcaaacttatgtccatacaaaaacctgcacacagatgtttacgactttatccataattgccaaaccatggaagcaaccaagatacccttcggtagatgaatggtaaataagctgtgatacatccagacaagggaagattattcaccaataaaaggaaatgagtaatcgagccatgaaaagacatggaggaaccttaaataaattttgctaaatgtaagaagtgtaaaaatgcaatttgaaaactctccatagttttgacattctggaaacgtcaaaactatggagacagtaaaaatatcagtggtagccaagtgttgtggggagggagagacgaataggtggagtacagagagaatatttaaggcagtggaattctactctgtacattataagtttggatgcatgttattagacatttgtccagaaccataaaatgtatactaccaaaagttaaccctagtgtaaactatggtcttacggtgagaatattttgccaatataggctcatcagttacaacaactgtgccactctgacgggggatattgattgatacatggggagtctgtggatgtgtggggggcaacaaatatatgggagatctctgtgcttttttctcaatttttttgtaaacctaaaattgctgtaaataataaagtctattttaaaaaagaggaaaattcaattagatgatattaatgaggtgctttgaacaattgtgggcatagtataaatctgctaatagttactattattggtgtttaccatttaaaaatatggttctaaggtttgttttaatgagttaaaatatcccataaggaatatttatttgtattccagaaagctgctagaaaagtaaaattcttaacatttaattctcaatgctcattctatttctgttaattaacagtcacttgttcaaagctgattagaatgagagaacataggccacatctaactagaactccagtgggtttactttattatctgtgtcaaaaacccacctacaagtaatcctagaaatgcattttctttctttctcagagtttgttagattatatcactgaacacatcattgaccaggaagcttatgagtcttaagttattgttgtcaaggccatctcattacatgtacatacaaagatccataaattcaatagacaactttagttttcagatttgttaatatattgttgtctctcagtgtcagtgggaagttggttccagtaccccgaggataagaaaaccgttggatgctaacttcccttatataaaatggtgatatttgcatataatctacatgcattctactgtagaatttaaatcatctctagagtacttataatatctaataaaatgtaaataccatataaatagtgtttacatttttatatttgttattttttattgttatattcttattttgggagagtttcttttgtatattcttgatctgcagttggttgaatctgcagatgcaaaaccctcagacatggaggaccaactgtaatagtctcagatcccttcactggggaaaacagtttactaaaacgtctgttactacagcaggcttgcaattttgcaaacaaacatcggtctgttctgcacaggcacacagagtgtgtgaagccaggagggaaacactggatcccattggtgtaaattgtcacaaaaccgaagtgttgtctcttggtgagttctgtgtggaggtatacacagctgctccattacagtgagcaatcaaccactgagaaggttcactgcgtttactgtgtgagagaaggaagcctggcctcaactcagtattgtcactatgggtgacttgggagatttccatttgtatcaccccaagctttattagctacatccccagacatttcaagtaaatacacaacaacaacaattctgaatagtcaaatgcagtttaaaaacaactattgtagccccgttcacaagtctagcagatgctgtctctagtaaaaaatatgtgaattatcaaaatagctagaattagaccatgaacaaaaggcaagcgatttttctatttgtcctgcttcaagaaaatgataaaaagactaaataattgattttgatgttaaatgaatgctagttacaggctattttacaatagtccaattttggcccaccagtgataatgttttaaatgtctgtatttctaaattgtttatcttctgttactttataccttattttgcatatgatctgatttcagaaagaaggctgttttccctttattttgaaattggaagtgggggtaaagagattattcagtaaaccagattatattcagagtgtagtccttctcatattccagctaatcatcaaaggcattaaactcaaatgcacattgtaagagcgaaagccagactaaagtggtatattttcatttcaattccacttgttatttttatagtattactataatagaaactgtttaattttgccattatagaaagaagttcactcgagtaagtgtggcttgaaatcaagaatatcaaacattatttgttttctaagtacccagatgtaggtggcgttccattcaggaagctcagtgtattaatcaaagcatagacatgtaaaactggggagaaagaagctctggaaagagcactgagcttgaccctaagctctgtcactgaagaggtacatgaccctgaacaagtcatatcactcccacaataacgtttcatgagtggcaccttgctgtaaactattcaatgttgccatgcctttgcacaagctcttccctttgcaagaatatcattccttcctcctccctaatttctagttagtatgttctttctctttcctcaagtttttacccaagcaatgcctcattagattttcttttgctctttttacatagagctggctgtaaatgttttaaatataaaaatatacatcaatatattgaagcacaaattttaatattgtgcgtctaaaatatttcggtgataatagggttcctgaatcactctctattgtgattcttttttgtctacatgtttcctggccctgtcagatatatatgtcttaaaaacaaagtgtaccttgctcaactatgtttttatactatccagtattcactagtatacatttagtaaataatggatgaatcgtttctcaataaagtaacataatgtaactgtgctctccacctcacagaatgttgaatttgtgaaattatgacaattaaaatgtcttccaactttaccaaagtatgcatatgtcaaaaatttttataatctcccaaagagacaaagagaatcataattgctcatcaacagaatacaaatttcggtgttgtgaaaccactaatgaccaacctcaagctgttctttgggaaaggataaccaacactggatattgagtcagaaaaggaaaatggatggccaggctatgtgtgtttgtttctttgttttgttttgtttataataagatacagagcatatagagatgtaagaaattgcaatggagacatgctttgaaacagaatcagaatgttaagaatgcttaaaaacattcttccacaagcctacattgtatttggcaagtctgcttctgaaatccagggccttttcctccttgagagcatcttggttgatttccgcagggtgcatgatccttcaatactattcaggattatacgaggcatcagaaataccagagaactggacgtggctcatggaaagagctcagggagaaaggcctttatggccagaacagcactgagtcacccactattgctgctggtgggtggttattcaggttactacatctttaattctgaatttattgcagaatttatttatggatattcggataacatggaagcaagcacttactttctttggtagacttgaggaggaatacaatgtatcccaactagagtggctggaacattttccccttgctgttaaaactcctgctggggtgaggatagggaaagagaaatacaggatacctaccaactgagtatattcatagtcaactttctctcccgctagtctaaatataataaactccatgaaacacctctcatctagcatgaagcctaacaccctaacacataactggtaattaacaaatgtttgtttaataaaaatgattaagtggatatattctttttttttttctttttcttttttgagacagggatctgctctgtcgtccaggctggactgtagtgatgcagtctcagatctctgcaacctctgtcccccagggtcaagggatccttccacctcagcctcctgggtagctgggactacaggcacgtgccacgaaacctggctaatttttgtatttttcatagagatggggtttcaccatgttgcccaggctggtctcgaactcctggactcaagtgctctattctcctcggcctccccatgcgctgagattacagacgttagccaccgtgcctggtgtaagtggatattcttagtagtgacatactcagagatattggtgcctcaaatctactcaatgaagagaatgctacaaatatgaagaatcagggagtttaaaagcttagttatgcaacagtagctcaggtattcatctccccacagaaagagaattcaggggatgggtttctaccttgaagcataaaagtggggcagatatggatatgtctgtacctcgattccagttttactcagcatcctctaagagccccagtaggaaaagaaccctagagataaagaaatgagaacccaagtcaggccctgccattgtcagctatgtaacctggacataccactttggttttctagatcccccattttctgaaaaaatggtgaggaatctggcaggtcactctgtgcttctaatgaaatttcttccagataaacctgacagcaaaggtgagtgaaggtctgagcccaggctcagactaacaagtcaacaaaaacaatcaatgcatttctatgatatttaaattttccttatttttatttttattattattattttttgagatggagtctcgctctgttgccaggctggagtgcagtggtgcaatcttggctcactgcaacctctgcctcccaggttcaagcgagtctcctgcctcagccttctgagtagctgggattataggcacatgccaccatgcctggctaatttttgtatttttactagagacagggtttcaccatgttggtaaggctggtcttgaactcctgacctcgtgatccacccacctcggcctcccaaaatgctgggattacaggcatgatccaccatgcctggcctcaattttcttttttgagattcaagcacatccctcactggacttcaaaatctgcctgtgtttgttcaaatataaaacaagtttttgtgtatataaccttctaatggaagaaaacactttctggaagctaagacagttgtagcctttgatttctagtagtgcttagtgtcccacctcatgccgtcatgggtaccgcatctcagctgcaaaagcaaagagatacatggtatctcttttatatccaaagtctatttttgaaaataattttgaagattactctccctcttttcctcaagcttaccacaattttctcttctgctatatgatattttgtatgatttcttctgctgtatgataatcaaaatttgcctttgattagtaaacttaggaaacagtaaactttaagggtaactgttagtaaatccttgaattaattaaccatcctttattgattgcctggattcactgcctctgagctatcctacttctcagtaagtcaaaccaagttaaatataaaatgtcaccttcattaaaaacgtggcataatgtcataatattttaccagcgggcccacttgcttcttgatcataaattaccgaaattcctacagttagaatatttatttccttgctcttatttttggtgttactgttgtcattgttttactactcagttaaatagtaagtagaactttattcaggggtaaactattttgttttgtgttcaaagaaaatgcctggtttgcctgggttgctgagggttaatatgtaataaggggctgggagcagtggctcatgcctgtaatcccagcactttgggaggccaaggcgggtggatcacttgaggtcgggagtttgagaccaacctggccaacatggtgaaaccccgtcgctactaaaaatacaaaaattagccaggtgtggtggctcatgtctgtaatcccagctactcaggaggctgaggcaggagaattgcttgcaccccgggaggtggaggttgcagtgagccgagattgcgtcactgcactccagcctgggtgacagagtgggactctgttcccctgccacccccccaaatgtaataaggagttccaagattatttcacaagaagaacacattcttcctctaagtttcctgcaaaaaaaaaaaataaaaaagtaccagcttttcttccacatgtcctaaactgagtaaagatctgcttcactgctacagaccaaaaagaaagtccctactggcagtagtttttgggaggtaaatgtcaccagaaggttatcaaggcctttaaatcagaatgccatctttgacccttgggataaaaaggcaaaactttagccttacaaggtgaaatattagcaattatttgcatccaggctacatgcccaactttgaaagactcgcccaagaatatgttcctaagtcattacagatgacaattcatattgtgaaaagaattttccagcattcagaacaacaactcatcagcaagtcgtcttcagggaaacaattaaaactgatgatagaatttaatctgaattgagaaaaaggcatcattacccttgcacctgacaatttctttaagtaacaatccattattactaatccactttgaaacagttatctaaaggtaatttgtatcaatataagccaaacacacaggttattgctgacctagtacttgcgattacataaataaagcttttcttgctgtacagaaacatttcttcgtatcaacatattatatgattcaaaaatatcttcagtctgagccaaatgaagtcacgtagaaaagagttaaatcacttattgaaggccctctaactgctgagaacactgctcaaatatgatcataaatgacatttgatgatctcatccttttcaagatcaatattttaattacatacagttctggttcagaattgaggaatttatataaaaagttatcaaaaaggaagggctatggctatttgtttggtataataaagcataattcatactttaataacttgttaaacttattctgatatgacaccatatcagaagttatatgtgtgtgtgtgtgtgtgtgtgtgtgtgtgtaaagctcaacatcactaatcatcagggaaatggaaaccaaaaacacaagataccaccttacatctgtcaagttgactatcatagaaaagataaaataaaaagacaacaagtgctgacaggaatgtggaaaaattggaacccttgcacaccattggtctatgccttagtcagttttgtgttcttctgacagaataccaatgactgcgtaatttatacagagcaggcatttatttggcttaatgttctggagactggaaaactccaagagcgtggcactggcatctagccagggtcttggtgctgcatcatttcatgggagaaagtagaagggacttctactgtgacagcaaaagagcacaggggaggctgaactcatttttataagaaacctactctcgcagtaactaatccactcccacaaggtgaacattaattaatcacctcttattaagtccatctcctagtattgttgctttggagatttggtttctggcacatgaaatctggggacacattccaattataccggtgggaatgcaaaaggatacagccactacagaatacaatatgatggtttattaaaaattaaaagaactgtcatatgaatcagcaatcctgttactagatatttatccaaaataattgaaatcagaatctcaaacagatattagcactcctatattcattgcacactattcacaatagccaagttatggaaacaacctaaatatctattgatatgtgaatggataaggaaactatgatatccacaaacagtggaataatatttagcattaataaaggatgttatgcagtgtgacaatgtgatcgaaccttgagggcattatggtaaggaaaattacaaatgtcacagaaagacaaatgtcgcatgattccacttacataaggtatctaaaatagttgaatttatagaatcaaaaagtggaatggtatttataagaggctggagagagggagatatgaggagttacttatcaattgacataaagcttcagtcaagcaaaatgaataagctctagagatctgctgtgtaacactgcacctatcatcaacaatgtattagaagcttacaaatttattgaggatatatctcctgttaactgtctttaacacagtaaaatacaattaaaaacaaacttgctgtgccaagatgccttaagaaagagataaatattcggcttttattggtactagtggcaatggtaattgaagaaaggaaaagaaaagcaagaaaatgtacacaaattattcactcattcttgaaggtgagatcaggaggcaaagcctcaagtcttctgtagtagacatttaataaaggctgcaaaataattgctttggtaagtgtattgtttttattttttaaatattatatataagtatatatcatatatattatataaaatataattataggtagatacagtatgtggacaacttcaaaatcagaaaaaatgaacaccccatgtgaccaacattcaaatcaagtaacacatcaacattttagaaattgctactctcttaaagataaccactattcttccttgaaacagcatagattagttgtgcctgttggttttttactgaatataaacagaatgttatagtatgtaccattatgctggcttcctttaatcaacatcgtgtttgtcggattcatctctttttacatacattcctagattgctcattttcagtactgtattgtttatcactgagtgaatataccatattttatttatccattcaaatttttatagagttttgagtagtttgctcaagttatctttaaatgatttggcaccaaatagttataattctcatgttataaatttatgttattcaaaatacaaaataatatatgttatatactaaaatatgtctagaaaatacctgtagcaggtttactacacacctcttgtgaaccttggatcatttttatatacctttgttctattctttattttaaaacttttctaggaacatattttggtaaattatctggggcaaaataactcataaaatgggttaatctaatcatgttttattggaatctactaattatttaaaaatatactaagccaagcttttaacataggcatagaacaattttttttctctgaactgcgtcccaaaggtgaaaaaaggaggttagtaaacaataatgactatttgctgacctatgtgtgtgaaacttactaattagtttgacttcacctcaggggataacagagaagatcactaatcctcagatcccctggcagaatatattacaatcacaaaatcctatagggttgggagatgtgctctcatattgacatattcacatattaatggtgcaatcttcataatgtaacatatacagcacaatttttaaaaattaggtaatagcatgtttacttatttgcaggattgtttccaaaattctcatatttgtcaagattccagtatacagttccctgtcttttatcattcttcatatgtaccttctatccatcttttcatcattcccagatgatttattaagtttaccgaaggcgctagttggctggggtgtatctaaatccaaacaattaaaaatagacaaaaacatacgtgatctctttcacaccctctgtagtacacatttccatgctcagcttctttatctttccgcttactagtaagatctccacaggaatagggaagttcatggaatactgacagtttctaagctctgtgtctctctgcttctctggctgagggtttttcctagtaacacggggcctgatcatcaatgttcagagcatatctgaagtaaaggacacataacacactcagagacaaccctcaaattccagtttctaaccattccagcaagatggaaccctggttaggtggtaagtcactcatcaatctgcataatgtcttggctttttctcccactcctcctttatccactcccttattgtgttctgctctctgaaattgtctcctaaataaatcattttatccaaatatttttctcagatagagctttgggagaaactgaacccagacatttcttaggaatttaaacccatctaaagccgtattaatagacatcaactgaattctaaaacttcaaagagctgttatgttaatacgtctatttatagaggagggtgatttaaacaggaatctttactgaagcatttatcagaaccttaagtgaattaaaatgatccctgaggaggcagagattattaaaaagcactttccaaatttagttgatcaaaggactcctttagttgtgtattcatttaccaagctgctgtttattgttagtgcatattttagtaaatgatgaaaacttcaaaactcagatatttaaactatccatgctactaatggaaaggagaaatgtcaaggtagtagagatgcttgcaaagagaaaggtgaaaatcttctgtaaagacatggggttcctaccgtgctgttctgcaatcagctcctacaaaccagccttgttcctcacttatagagaacctttcttaatacattacagcccttagtattctcaattatgaaggatgttggactcaaaatccaatacactttaccattctgcaactttattatccattgacgtatttttctgttgagattgaatctagcaagaaggcttatctgagtttatcactagcctgtttatcaagtaaggcactttctgctgcaaagaaccaaccaaatgattgtaaaccataaaggaatttaccaactcacataactacaaaggcaaagcttaaatggtttcagaagtgacttaaagcagggctcggaaaatatcaccaggaccacttcattccacctctctgctcagctttgttctcttacactgttggttttgctctcaggcaggtatgatccttgtcccaggatgtgaacagctgctctgaatcatgtatttttagcttcatcttcagtttggaagagagagattatctttctctcagaatgacacaaacgcccagggtaaacctcttattggttagattaggttgacttcctacacctgaagcaatcattgcatgtggtggggaggggaaaagtactctaagtggttggaaatcattacaaccaagtaatgttacaacaacaaatctgtacattaggatcacctgcataggttttaaaactacttatgatggggcctaccttacactaagtaagccagtacatctgtgagtggaaatcaagcattagcatattttaaagctcttgagtgatttcagcctctattaattaagaaccactactttagatttgggctgcaataattcaagtttatacaattcacctggggaacctgtcaaaagggagactttgactcagtaggcctgtgcagggcttaggatgcagcgtttctaataggtttccaggtgatcctcctcatgtgcttagtgatccttactttgagaaataaggcatatcctattcagtgtctatccttacagctgttgagtaaggtcaatcataactgagacatatagctatgagtaaagaaggtgcgatccaccaaaacaaatgttagctattttttccaaagaagaattaaaatgataaaaaatacaggcttactattctgagatgaacaaatattaacctctttatgatccttatatctttattttatcctcggtgtgggcatacagtatgggcttctaaggtcagatggtacaggatgcaaccagcttaagggtggggagttcaaatccagaagacagctagacagtcatattctctcaagaagttacggatccttccttgtcatcagatgatgacgtgtggtctttccctctgagtattttcttgagaactttccctttcctttgatttcccgggttgtaaatatcagcttcaggatgaactcgcaagattactatgttctcttaaaaattcaatggctgttacactcaactgatctctttctttttttgtgctccccccaataccccaatacacctcaaggttcacaaattttaaatgtagttattaactcctgaactattgtcttggtctcatttgtaggcagtaagacttaacaaagtagcatgaaacatcaagcataaacaaccagaggctaaaataacaccctgtgccctgactatattgtctaaaaggtgtacctaagatccatgtgtacctaagatctgtgtacctaagatccagactgtgtgcctaagattcatgcttagttcacttggtatttctggacttctgaaattgacatcagttctaaagactctaccaaaggttctatagtagtgactcatgttattccttaaacacaattttgatgagccaacatattttctcatgtactaaatctcagctcagtcctcaatgttaaatattttacatctaaaccacagctctgcctggcttctctggattgtcttacccccagctactctgatcacatcataattatctggtgctctgtcctctcattactatattctactaagatcttaggaaagaaatgcatcattagtaattagagaggaaactgaaactcagagagttcagtcattcttttcaagtcatacaagtggaaatatggtaagctgtgatttatatccaggcctttttaacatacaaaacctaatgtgttaacatttccgatcaattttcctttcctttttttttttttttttttttgagacggagtcttgctctgtcacccaggttggagtacagtggcgtgacctcggctcactgcaagttccgcctcctgggttcatgccattctcctgtctcagcctcccgagtagctgggactacaggtgctcatcaccaagcctggataacttttttgtgtttttagaagagacgaggtttcaccgtgttagccaggtcttgatctcccgaccttgttatccgcccacctcggcctcccaaagtgctgggattacaggcgtgagccaccgcgcctggcccaattttcctttctataaggatagtcattgccttaaagtttgaattcctggaaaggagtacttgtgtctcattcactctggaatcccctgtcccaggcacaatgtctggccaaaattgctgctaattaaacatttgttagatcaaagacccggacagtgaggtaggttaatgtctactgaactctctgagcctgttttctatctagttattaattatacatttctttcttaagaccttagtggaatgtagtaatgaggacagagaaccaaagaattatgatacgatcagagtagctgaggggaggggattccagagaaaccaggcatacctgtgatttagacaaaaatattttggttttggaaggagattttagacccctctaacttatattcaaattgacaatttatttactgtttctatccatcttcacaaaggaaatagaagtacagatggtcccaaacttaatacggttcaatgattcaaagatttttcgactttatgatgggtttattgggacataaacctattgtaagtcaaggaggttatggtttctattgaatttgtatcactttggcaccattgtaaagtcaaaaaattttaaattgaaccattgtaaatcaggaactgtatgctgtgctgccagcactaaaagcattttcaacttaccgtgaatgtatctggatgtagccctaccataagttgaggagcttctgtacttttatttgtgtgggcaggatggacatacatgaccacttcctccctgtttctttcgagggcaagaagctgataaaaagatatataaccagaacaattattactgccttccctgttctcctctgactgactttatcgtgatgtcagtatcctacatattcactgaatgtgagaattttacttacttacctccagacagaaacatttacttcctttaaaaacccatggaatctgttatataagagttactcaaacatagtttgagtcataatattggaagatgatgcaatgggaaatgtaaagtattccaattcctttatattattatttaaaaatgagattaaaaacgagaagatacttctccatagacataaaacaatagattacttttgttggtttgaccacattgagataaaaaatgattttccttctctacagtctattatccagattgcgaacttcagctttggcgaatgtctcgagcagttaacgttctgacacaatgacatttcaatcagatatgaaagtggtgttgggaccctttgggaataattttgctgcagttcacaccctgacttgctagtaactagctgttcattggttaatgcccagggtcaaaagtaagaatgcataacaggatgggctctgggaaatgcattctcctcatgaaccaaagttaatgtggcctatgaaaggaggttcaggtagccattaggagttgtggtcatacggactgagttttgccacttgcaagaataaatattatataatgatatggaacttaacagctgagacactgatacatacctttcagtgttttttttttttttttttttttttttttttttttttttgagacggagtctcgctctgtcacccaggctggagtacagtggtgcgatctctgctcactgcaagctccgcctcccgggtttatgccattctcctgcctcagcctcctgcatagctgggactacaggcacccgccaccaagcccggctaattttttttgtatttttttagtagaaacggggtttcaccaaatatagatctatgcaataaatatatttttaaaataagtaaactaataactgtcaaagcatagtagttataacattggatcaaaaattctggattccatcatcctaaacatatatttgtcgagaataatttcttgcttagcatttcatggaaaacgttaaaagtcatttatattattgtctatgcatgttgggggataaatatcattagtgttttccaatgacttcatatctctgaatcctgaatcagactagtgaggaagaacaaatattcacttagcctacatttgatgataagaattttatttgagaactggataattattgatcttacggactttgccagcttcaatactaagcaacaaaaaaaaaatgtaggttcttatggatacttaatactgtctaggtactgtgctccattcttcacatatattatttcacataattctcatgctaccctaggaacaggtgtaactatcttaattttatggatgtgggaattgaggcatagagaggttaagttatgcaaggacctactctgtgacataacctagacttgattccttgattttctaacacacggcgctgcactcttctgttggtcccacgtgtctgagatttgctgactttcagcacacaaataaatcaatgacacattaataggcattaatagggaggttaagcagctgtcatgtcacagtagtagtgacactgaaattatgagagcacatccatatgaatgacacagtcatatttaaagtgccaatcttccttgagcaaaacttctgtgagaaaaattaagtttacagatacttatgcaatcaaaggtttatatatttatatatgtttaacataaaaaaaacctttgagatcttttaattgggccccttccttttacagaggaggaaaatgatgtgcagggaggagaagtgctttgctcaaagtcacaaagcaaggaagactaggcctcaagatgacctgattacaatcctagttcctttgcagctcttccacgattacttagtcacagaatctagagacagtgagaggaataaaagcatttttgagtagcattttctgattttgattacattagttagggaaaaaatatcagggctataaagagagtcagtagcaaagcaactaaagcctgaagtttgaacaatgttggagaagcagaggacaaatatcattagcgtgggccatcaataaacttcttactggttttccttttcccttagtcatgagtcacattagtaaataggggaatatgtcgtgagtcttgtctagggactgacaacatcgaaagcaaataaaaaccttgaaatgattgccaattgttttggcaaatatctcacattcatgaagctggcatgtagagctttctagtatagaaattttagcatattcaactattccattaagtactgcaaaggaacattgaccttcctacagtactttctaatagtaatagctggattttttaaaatgagaaaactctattatatcccctctggaaaaggagtcaaaagggtgatactatctctgtttagcagatgtggggattttatggtcagagtgtggaggcgtccgtgaagtctcaggtgcctttcacgactatagcctcaagtcccaatgcatcccgaaggaaaccaactcttttcatagggccacagatgatcatatcagggctcaagctcaccacatgtgatcaaagcagagagagaccatgggtctctcaggtgactaggaatcaatccttgatcaatagggatactccatatctgagtagcaatgtgacataatcaaaacttcttagtggaaagtatacataatatgtatgctcaaatatttcacagcagtaaattaaaggggatacaccatttctcaatgaaatagttgtaataaaaaaattttaaggcaacacacccaccacggacaacaaaatttgagtagtaaatgaagatgaatctcatgatcctccatcttcttttattattttttcttcaactgcactttgggctcaaatacagttgcataagtctgtcttatattctaaaaaccacactaaaaacatcatggatctagtttataacctttaacttttcaatttccaaatttacttgagtcatttttacaatttctatgtctcatctcccaatcctgccgatgttcattgcagtcagtttcaccatcatgactcacactaactatttcatttctcttcacttggaagtatctccaataatcactaatgccaaaattcactgtgcattataaaatctgtatactacttctattttgtagatttgataccattgaccatttaatccttagacttctattttttgacatttgtaatcatctagatcttttactccttgtatagtatttcctattttccttcctcaccttctaccttccattttttttgctcattcttcatatatatatatgtttttatatatatgtttatgtatattttatatatatgaagaatgatcatatatatttcatattctcattgttcttactttacttttctaaacagccctggccaatctttaatataactatggcttagaatatgtatactataatgactcacaagcttatctcaacacccatgacattcctctaatgaattacaaatgtacttatttggacacttcacagtacatatagtaagaagatgactagctgttctttgttttggatgagtcattggatcattaaatttgaatgactaatatggtttggctgtgtcctcatccaaatcttatcttgaactataatcaccaggtgttatgggagggagccagtgggaggtaactgaatcatggggatggtttccaccatgctgttcttgtgaaagtgagtgagttctcacgagatctgatggtttacaaacatcaggcattttccctgctggcacttattctttctcctgctgtcttgtgaagaggtgacttcagtgatgattgtaaatttcctgaggcttccccagccatggagaactgtgaatcaattaaacctcttttccttataaattatccagtcttgggtatttccttatagcaatgtgagaacggactaataatgtaaatttgtaccaaggtggtggggcatttctgtaagatacctgagaatgtggaagcaactttggaactgggtaatgggcagaggttggaacagtttgaatgactcagaagaagacaggaagatgtgggaaagtttgggacttccttgtagagacttgttaaatggctttaaccaaaatgctgatagtgacatggaaaatgaagtccaggctgagttggtctcagatggagatgaaaaacttgttggaaaatggagcgaaggttgaaactggcagctttttgcccctaccctagagatctgtggaactttgagcttgaagagatgatttatttaaggtatctagtggtagaaatttctaagtagcaaaacactcaagaggtgacagatcataaaagtttgaaaaatttccagcttgatgatggggtagaaaagaaaaacccattttctggggagaaattcaagccagctgcaggaatttgcataagtaaggaggagccgaatgctaattgccaagacaatggggaaatgtttccaggacaagtcagagaccttcttggcagcccctctcatcatagacctggagacctaagagggaaaaatggtttcctgggctgggtccagggacccctgctgtgtgcaggcttaggaactggtgccctgcatcccagccactccagccaaggctaaaaggggccgaggtacagctcaggctgttgcttcagagggtgcaagcctcacaccttggcagcttccatagggtgtttagtctgtgggtgagcagaagacaataattgaggtttgggaatctccacctagatttcagaagatgtatagaaatgcctggatatctagtcagaagtctgctgcaggggcagagccctcaaggagaacctctgttagggcagtgcagaagggaaaatgtggggtaggagcccccacacagagtccccactggggcactgcctagtggagctgtgagaataaggccaccttcctcccgaccccagaatgctagatcaactgacagcttgcaccgtgagcctggaaaagccacagacactcaacatcagctgtgaaagcagctaggagggatgttgtatcctgcaaagccacaggggcagagctgctcaaggctgtgggagtgctcctcttgcatcaacatgagctggatgtgagacatggagtcaacaaaaaaaaattttggaactttaaggtacaatgactgccttattggatttcggacttgcatggggcctgtaacccctttgttttggccagtttctcccacttgattgtatttacccaatgcctgtacccccattgtatctaggaagtaactaacttgcttttgattttacaggctcataggcagagggggcttgccttgtctcaggtgggactttggactgtggacttttgggttaatgctgaaatgagttaagactttgggggactgctgggaaggcatgattgtgttttgaaatgtgaagacatgatatttgggaggggttaggggcagaatgatatggtttggctgtgtcctcactgaaatatcttgaattgtaacccccataatccacatgtgttgtgggagggacccagtgaaaggtaactgaatcatgggggtggttcccccatgctgttctcatgatagtgagtgaattctcatgagatctgtcttctatcattctctgttctcatcacgtctcacttggcctatttaagtagcctctggactaggttcctgattgcagcttctctacccttccaatcactactccagattttgaacaagtggtctttcaaaaatacaaatttaattactttgttgcttaatatatattggtgctttccattttttacaaagcaaagtcataagcattttatatatatatatgtgtgtgtgtgtatgtgtgtgtgtgtatatgtatatatgtatacacagacacacacacacatacacacacacacatgtgtttaaacacccacaccaagatatagattacttacttccaggactccataatcccctctagggccctagcccagccaggattcctcccattccaaattcaagaaattggccaaaacgaaggggctacagaccccatgaaagtctgaaatccagcacagcagtcaaatcttaaagctctgaaatgatctccttacactctatgtctcatatccaggtcatgctgatgcaagaggtgggctcccatagtcttgggcagctccacccatgtggcttggcaaggtagagcctccctcttagcttgggccttcacaggctggtgttgagtgtctgtggcttttccaggtgggtggtgcaagctttcggtggatttaccattctggggtctggaggacagtggccctcttctcacagctccactaggcagtgcccctgtagggactctgtgtgggttcttcaaccccacatttccctgtcacactgccctggaagcagttctccatgaggcccctgaccctgctgaaaactttcacctgggcatacaagcatttccatacctcttctgaaatctagatggaagttcccaaacctcaattcttgacttctgtgcacctgcaggctcaacaccatgtggaatctgccaaggtttggggcttgcagtctctgaaaccatgggccaagctgtaccttggtcccttttagcaacaggtggagcagctggaacagagggcaccaagtccctaggctgcacacagcgtggagacactgggcctggcccaggaaaccattttttcctcctaagcttctgggtctgtgatggtaggggctcctgtgaagacctatgacatgccctggagacatttccccattgtcttggggattaacattcagctccttattacttaagcaaaattctgcagccagcgtgaatttctcctcaaaaaatgggtttttcttttccactgcatcatcaggctgcaaattttctgaacttttattctctgattcccttttaaaacagaatgcttttaacagtactcaagtcaccttttgaatgctttgctacttagaaatttcttctgccagataccctaaatcatctctctcaagttcaaagttccacagatctctagggcaggggaaaaatgccaccagtctctttgctaaaacgtaacaagagtcacctttgctccacttcccaacaagcttctcaactccatctgagaccaccttagcctggactttattgtccatattgctatcaggcttttggtcaaagccgtttaacaagtgtctaggaagttcgaaactttcccaccttttcctgtcttcttctgagccttccaaactgttccaacctctgcctgccacctagtttcaaagtcgcttccatattttctggtatcttttcagtaatgtcccattctactggtcccaatttactgtattagtcagttttcatgctgctgataaagacatacccgagtctgggaagaaaaagaagtttaattggacttacagtcctacaggcttggaaggcctcagagtcatggtgggaggcaaaaggcacttccttcatggtggtggcaagagaaaatgaggaagatgcaaaagcaggaacccctgatacaactatcagatctcatgagacttattcactaccactagaacagtatgggggaaccggccccatgattcaaattatctcccaccaagtccctcccacaacacgtggaaataatgggagtacaattcgaaataagatttgggtggggacacagaagcaaagcacatcacaggcatgagcctccatgcctagccctaaggtctttattaagaaaactttttcttctgatctatattcaaattaattaaatcattatgtatttattcactagtttatatctttgactctttttaatttgtgtggttttttgttttgttttgctttgtttgagacagggtgttgctctgtcacccaggctgtagtgcaataatgtgatcatgactcactgcagcctcagcctcctgggatcaagaggagctgagcctcctcagcctcctgaggagctgagactacaggtgctcactgccatgcttggctactgttttattttttttatttttattttttttttgtacagtgaaggcatcactacattgcccaggcttatgtccaactccttggctcaagcaatctgtctgcctctgcctcccaacgtgcttggattacagccatgagccaccgtacccagccctttttcattcttaagatgaggcttgactttttaattatagccattctgactggtatgagatggtatctcattggggttttgatttgcatttctctaatgatcagtgatattgagctttttttcatatgcttcttggtcacatatacatcttctttagaaaagtgttcataacttttgcccactttataatgaggttgttcatttttttcttgtaaatttgtttaagtttcttatagatgctagatattagacctttgtcagatgcatatttcgcaaatattttatcctattctttaggatgtctgtttaccctgttgatagtttctttggctgtgcagaagattgttagtttaattagatctctttcgtcaatttttgctttcgttgcaattgcttttggtgtctttgtcatgttgcccattcttatgtccagagtagtattgcctaggttgtcttccatggtttttattgttttgggttttacatttaagtctttaatccatcttgagttgatttttgtatatggtataaggaagggatccagtttcaatcttctgcatatggacagccagttatccccacacaatttattgaataagaagagtttttctccattgctctttttttttttttttttttggctttctcaaatatcagatggtcataggtgtgcagccttttttctgggctcttttgttccattggtctatgtgtctgtttttgtactagtaccatgctgttttggtaattagagccttgttccattgtttgaagttgggtaacgtgatgcctccagctttgttctttttgcttaagattgccttggctattcaggctcttttttggttccacacgaattttaaaatagtttttctacttatgtgaagaatgtccttggtagtttgatagaaatagaagtgaatctataattgctttgggcagtatggccactttatataacagattttgcaaggtattgagaaaaggaagcttatacactgttggtgtgagtgtaaccaccattgtggaaagcagtgtggcaattcctcaaagagctaaaaacataactaccattagagtcagcaatccctttactgggtatacatccagagaaatataaatcattctcccataaagacccatggacatgaatgttcattgcagtactatttacaatagtaaagacatagaatgaaccaaaatgctcatcactgagagactggataaagaaaatgtggtacatattcaccatggaatactatgcagccataaaaaagaacaatattatgtctcttgtgggaacatggattgagccgaaggccactatccttaggaaactaatacaggaacagaaagacaaataccacatgttcttacttataattgggtgctaagtgatgagaactcatagacacaaagaaggaagaaacagacgctaagacttccttgggggtgaaggattggaggacggagaagatcagaaaaactaactattgggtactaggattagtgcctgggtggcaaagtaatcagtacaacaaaaccctgtgacacaagtttagctatgtaacaaacctgcacatgtacctctgaacctaaaacaaaataaaaaaaaagatcaaaatttaaagctactgatggttaacaatgtgcctagtcagattcaagagacagtagtctctttgtcacaacttagtgaaaatacaaattaccattcccatctgttgaaaccatagccaaaattggttgtttttttcacttaaaatctcttttctcaaatcacatcaaaacatgcgtggcttgaagtggttaaggaggaaaggtgttagagggctttgcagagtgtacatgaacagagaacggatccaggtcttgggcgataaggagagaggttaattactttaaccgcgaagtatatagtccaaaagaatttgcatgattgcttccttgtcaataaaaataaaccaattgcaagcaaaaacttctatttatctcagggccattaactaatatactgtatatattttatgtgtgtggttttagaacaagaatatgtgtgagagtagaagacagaaagaataattagcacataaaatttgtcctctgaatatttttagagaatgaggtcccaaaaatgcttgagaagggcaggtatatagaatggaaagagtgttgagatttggaatccaagctggatttgagtatggacttattctcactctgagcaaaccattactcttatttttttaatacatcaactaaatttaataataatacacactatacagggttgtcctgaggtttaaatgagattgcatttgtgaatgtgctccataaactacgggttccatttacagtgggacccataaataataaattacatttataatttcattatattgaattatgaagccattgtggtactttctatgaaaggtttatgatattctaagaatagttttttatatatatattacagtgaaaagccacggcactattgtggtagaaacatagttatatccttaaatagcaatgcaagtgttttacatatattagtttagggagatcttctgtaatattcttaaggctgatatgtattataatcataatcataattaccatcatagcacgtggtagtagcagtagtagtagtaaatggatattagaaaaatcatcttaatcttttagtttctaaacagatattaatttaggaacaactttactttttgattcatgaaattgatatacagacactgcagagatcatataggcaagtttatcctaagatgttaacagtgttattgcatgttgccacaatttttttttctttgttcagagaatcagaaagagaaattgacttaggacccactctctaaacaccacacttacgattttcattcatgagacttagatatttctttatagttacaggttttccttagtactcccacccttcctttgttctggttcctaatcaatattatgacagaaaaacagagaatcttgctattaatatcgctgatttcagcagaaattacagaatccagtttagagaataactgagctaaagagaaaaaatattttgtgacgtttttgtctttttaattattgtgtggctaaaaatagggaatttctgccaacatatccactgtgactttgtccatctgagttttaaataaatcaggtgattggtctcttattattgctcctgggaacttgttctgtcatgtaacagaagtgacttttaggatttttatttttattttattttattttatttatttattttttatttttttttattttttatttttttatttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccaggatggtctcgatctcctgacctcgtgatccgcccgcctcggcctcccaaagtgctgggattacaggcgtgagccaccgcgcccggccaggatttttatttttgatataatatccccaggctcaattcttgagaaaatttcctctgcacaatttcactttcatgaagaaatcaatgggaataaattaaaaaaaaaaaaaaaacagaaaagaattcacttggaagatggattacagtcaggggatcctggggtgtaggggatgcaatactgatagagcacatgccaggaaagaaaagagcagggcagagccaggtgagaccaaaagacaggactagctgaagagaataatagcctttccatttggacctgaaccatcaatgaaatcaatggaaatccccctacctccttcttcctggcaacctctgagctgaaatgagcctccagatgctgttttagttacatctatggagttaattctcatgttgttaacttcaaaatatttacttcactaaaatcacccatttttcttcaggttaacaggcttagcatgttaaatatcagctgtggggcaactgggggagtgggtaaaacaactctcctccgggttataataaaaggattgttttcccatagacacccactcatccccacctcctgtgcttatatctctgtgactatctgatttgaacattggcttcttacagtagtggatctttgaaagtaatgacagaagggcagacctacagaacacaaaaaaatctcttatggaactagcttcttttctatgtctctcatttaggtagtcaagaacagagtttcctgatgaatgttataaagataaaagtgtcagataaatttcttagggtacctttgggaaagggatccaagaaggagagagattcatagtattattttaccccttccagccaaaattaggcatgctttaattcaaatataaccctttctatattttataaacatataactctgcaatttccagacccttcataaaatttgaataccctgggtcacattgcttttgggacaaaactcaaagttgtcagtgtgacacacaggaggccgcatgaagtggcccttgtttatcactccagccttacctctggccagtctttccttctttctggacacatcagccaatgtgacttgcttaaactgtgttcttcctatgccctgctccatcttgttttttactaacttttgggagcattacttaattgtcacattctcagaaaaacttctgttgactaatttcaccctcagactgtgtcatttattttcagataagttctaatataatccagcactattcctctaaaataggtactatatagacatatattcacactagtcaatatataaaaatgttcctcactgaagtgtagctccatgaggacagatactttaactcttttgttcataatcatcctcctagcacctgttcaatacctgttgcattatggatatcttgcatccttttcttgaataaataactgtcatgttatagcttataatttaaaaagtgcttatgtctagcaaggtgtgacacctgcgggaaaagctgaatagaaacgttaacaactactcgttttaatatgagtaaacaaagctttttggaaatataaactagcttgctacctgcttaactcatcaaagtgatgaatttctcaaagacaaacacacacacaccctccaccatacagctaaaccatccctacacagtgatttcactcctcctcatcattgtttccattcatgctgtgttttccctatttcatatatatatgaaatatgtatatgaaatatatatatgaaatataatatatatgaaatatatttcatatatattagtttaaattgtaaacctactgagaaaggatcatagattttttaaaaagcagtcagctcactattaaataatgcttacaatactacttaagaataacaactacaacatacgtcttgggaaatttaagaggctctcacagtgcttttatcttggtagtgggtagataactgtactatataaatccaacttgacaggtgtagtataagaatgaaaagattctctgatattttgtagacaggaaaaaatcatgtatcattcagaagctgtttcttcctaatatatgaataaaggaataaaggtaaatataaattccaatggttcatgggcagataaaaaatgctagttttagggaggaaaacaactgcttcagaaacatttattagggtaaaagcaaattaaaatgccaagaagtgagaaggaattaataatgataagattattgaaaagaagaccaaagggcttagaatgtatctatgtaggagcatagctatgatcattgtgataaagttgagttggagaagaatttttaggggagatgtttgaaccctcaggaggattcaaactgtaactatttccattttcctaagtttaaatttgaagttcaacagtaggtgatacacatataccctaagctgaaatgccaagagtaataggaaaggaggaagggaccaagaagtgggatccaaggagaatgtgtgaatttaatccagtttattaagacctccttcattcttccaataaacaatcacctgttttcacctggattcctctttactcactgcttgtttctttttctttaaacagctttattgaggtataatcgatatacaaaatactacacatatttaatgtgtatcatttgatgagtttagacaaaagagaacacctgttataccattaccacaatcaaggtaatggacataaccgacatttcccaaaatttccttgtgttgtttgttttatttgtagtaagaacacttaacataagatttatcctctcccctggagtataggcagtctagtgatttgcttctaacctactgagtatgaaaaagattatggcatgccactttcatgattagcctatataagattatataacttgttttgcggtatcagaatctgtctattgcctactaggccatacactttgaggaagaaagaatccatgttgctgaagtccacatttcaagggaataaaggcagcctccaatcaagaaccagctaagaactgaggcccctagtccaaccaccctcatagtacttaattctgccaacaacgacatgagcttggaagcccctattcaagttttcatatgagacctcagttttaggtaacctcctcactgcaggctggtgaatgactcatgcacaggattcagctaagccatgtccagacacctgagacacaaaaaatgtaaggtaatatatgtgtgatctcttttaagctgctaaaaaaaatccagaacactctgttaagacatggatccaaggtaaacactcagtcaagaagtggctgtcagatttttactaacaattttgaaaatattaaagtggcatcttgtgaacatttccgatggaaataaagatccaactgggtctcagcaatatggaagtcttggtcttatagaagccagatatatatcatgtttatagaggcatatctgaaaagaattgtatttgtggtttttcgcataaagaatagacaaatttaactatgcaaatataaaatgattccagatgtctaaatcttatatatgaaagtaagagatgaatatcttaatttgtttcagcatagtaaccagtttactatctatatatatatgtagatagatagatatagatagatagattttataacatcatgttatatacctaaaatatacacaataaaatttatttagaaattattatatgcagacagacctgggaaacttcaaaatgcaattggcttaagggctacaaataagagattattcacaaatttcttccagatgtctcacttctcaaagtttatcccaaaaaagtttatcccaaaaaagtctgctttgtcctctcaaacctgatatattctttgcctcaactggattccaatccatgggctgccttgcattgccaccatttttactttcaatgattccagcttctttcaggcccacatacacatggcagaaaataacatgattaagttacaagctgccaaaaagagtttgttataagacagacatcgattatcctttaattgtgtccatgtgaattgctggctaccccggagagctttaatttaaaaaaaaaaatggattttggttatcaaagtgcaaagaaaataaaatgtaatcatatataattttttcttttttcttttttccaattgtgattattaaattagaaaagtatgacaccactgagaagagtattatgaatgtttaatgtttccaggtcacttcactgttcatgaagagactgccccggacttagagaccacaggtgaggttgagcatatagaacagataagcaaaaaaattgtgacattttttgcactgatgcctagatgctcagtttttgtgacttagtcatttgtatggctctgtaagacttgatacccatgaggctgtgcagattcagcccactgacttcaggtaggtgttattgtacagattttagtgcaagtaagagacgctttttctcagaggaaagaaaagggctgtaggcaagcaggcaaagtgaggcattggactcggaaacaagagaggtgtgctctggttactgacacatatgggcaaagcacacacattgttagttttcatttccttccataaaatggtgctaagggaacattaaacaaatgtgctagcattaaacacaagtgaagtgtttattccttctcctttctctaattttgagtctaatcactcaatactttaacccttatgctttttatgaagtctgtgatagagtcttttcttgaactgagtcaatggcaaactggaatcagaatgagacaatctcaagtattattaatcaatatacgaaggaataagcatatgctggatgggggtaggtatgtactgcattgcacattccaaaaagaaggaaagaaaagaaaagaaaagaaagaaagaaagaaagaaagaaagaaagaaagaaagaaagaaagaaagaaagagaaagaaagaagaaagaaagcgaaagaaagaaatttggcattcttttccctcgtggacttgctatagtcctagggcgctttggcaacttggtgaactagattcctctctctgactttccccagtgcagcaccaagtttcttcttagcatcttcaaatggacattagaaactttttcttccattctatttttttacccttgctctgaggatatacacatatttttgtgtgttgtagcacagtgaattcggatgcttcaggttgcagctcaggtcttactgtttattccaagacacggaactctagttagattaactcattctttgattcagtattcaattcactcttagatttatagtaaataaaattatcactgttttattgcatttaaactcaactttaagcagtcttcttttcagcaggctcaggagaaaaaaatattttgatacttcttcaaattccacgtcctaccatccccttactcacaaaaggtcttagtaggaactaatgcatcctaagcttcagggcccacacttgcaagagtccctttccaagtcacactgatttctcactccaaaaaaaaaagtatttattttcattttacctagtttatctagttttttattcaaggaaatatatgtagatttccttgaagaggctgcccccaccaaattgttaagattctggccctacaaatccttgtcctacttttagatggtacagtgaccctactcccataaattcttttctccacccccaggtttcctaactctcctaagtatccttggaaaggtaaagtggcagacatcaaaaaaagataaaattaaacaacaaagttgtaaacttggcagagtcaaaacagactatgagtataggatagagtggtagcatgaaggatagaacgctgggggaagtaggtcaggattaatattttagcactatcatgaagcctgtcatagtcattagaccctaatcatatggtggaagttgagtagtagacaaattagatgtatagcgaaaaaaggcagataaagaagattgaggatatttttaatgaacagtgaagcaaaacacacagattaaattaagagcctttccttttatatttaccccaaaactaaaattataaatttttattttgctatccaaaaaagcaattcataaagaatagctgacataataagaaaaaaaccccacaaaactgttaatgttaagtgatgtgatgaggcaagaagggagagtctcctgatgccccatgagatggtatgactattcagaatataaatagaactattaaaaaatacttttggttgtttaggaacatgaacgaattcaaagaaagtatctgttgtaaactagaattgacttctagatatttcactgcccgtgaaccaaatccagcacatctattgccttaacaagaattcatcaggatgccccctccctatggataaattatgcaattgcaaatatctggataaagggcaggcagcctgacaattttcagaacctctctttgcattctcatgtgttttcaattttctttataaaagttctagaatattttgaggggttgtgcttgctcacttcccgtgaatttggaaaatctatgataaaagaaactaggcattctattttctttagcaccgttaagaattctgttcagttcaattcaatacaaatttgttgagcatgaattatcttagatccttctacattgttatattgagtttttatgtatctcttgtaatgttgtttaaatttttcatatatttattctctgacttctcagccagatgattcttttaatgatagctattataaggtagttgtgaatgttagatacttctagagatacagagatgtggagttaaatacaacgttttgagtgtgtgtgtgtgtgtgtgtgtgtgtgtgtgtgtgtgtgtgtggtgcttactctatatccataccaaatgatgcaacggagaatctgaatacatatatgactcaaaccatggcttcatagaaattaccatcattagtcctataaaatcagctctaatgtatttaaatgtctttataccaggtaataaaaaacagaatggaaaaataatactagaagatagatgtctttcatttttttctgatttatttgctacagtttgaatgattacaataaaagtattagatattatattgtaccataaagacaacataaagccagctcaccaagccatgaaactaatatttaaagcagcctatataaataactggaaaaggggtgtcactcctagccaaagatttggaagggaaaatgaggctatacttcaaacccagggccgtgaaaattaaaacagatgtagtttccatttaaagcagcaacttctttcactttattatttggctcaccaaccaaatcataaactaggaatggactatgtactcaacatttgctaacaaaaaaggcaaagccatcgtttttagaaaccattagactcatttatgtagtggaatacttaggaaaactatcatctatagtgacatggaaaagagaatatatacctagtcatttttggatctggaaaagaaaaatctaagcaagatttcaaaagtgccaactggtttctctataaaacaagatatgtatatggggagatgagataaaaagcctaacaaacaaaatatagaaaataaaaccaaaaacctgttcagttttcaagaaatacttataggaaatagaaagaagataagaattcctgggcttgaaaatatttttttttctatttttttatcacagtttactgcaacctccgcctcccagattcaagcaattctcctgcttcagcctcccgagtagctgggactacaggctcacaccaccacaccacaaaattttgtatttttttttttttttaagacagagtctcgctctgtcacccaggccgtagtgcagtcacgtgatctcggcttgctgcaacctccacctcttgagttcaatcgattctcctgcctcagtctcctgagtagctgggattacaggtgtgtgccaccacacttggctaatttttgtatttttttttttagtagagacagagtttcaccatgttggtcaggcaggtctcaaactcctgaccttgtgatccacacctcctcagcctcccaaagtgctggggttacaggcatgagccaccgtgcctggcccaaaatttttgtatttttagtagagatggcttttcgccatgttggccaggctggtctcgagctcctggtctcaagtgatccactttggcctccaaaagtggtaggattacaggcgtgagccaccgcacctggtggtaaataatttttcttattactagcttctaggtgtcaaagaagtctcaaataaaaaaattagaaaaaaaattaaaattctacaataaattttctctttagtggaagaatatgtaaatacttatttgtaatggggaatgaaaaaataatgcctattaacactatccttattgaccattctactaactagccaaggcagctcaaaaagataagaaaaaatataaaagcctctagaatgtaaagtggaaaataaagctatttttcatagatgacttacctaccaagaacagaaatataaatcaatgtgaacttcacaagtttttagatataagatcaatatacaaaaatattatatatgtatgttaccctaaaataaatggaagttgcaactaaaacacactactaacaatgatataaaaatgagctagggtctaagaatgcatttaaagaaagatgtacaaaacaattgaactggaaagtacaacattttattgacattcactaataaagtcctaaatgaaagcttagaccaggttcataggcttgaacagtttaataatgaaagtcagctcaaaataatctatgagataaatatagcacattatccaaaacaggtgtttatctttttaagaaaattggacaagctgattttttaattactgaaattgtacagagccaatacaagttaagacaaatttgaataagaaaaagaaagctggaaagctaaacttaccagacattagaagtattatacaaaatcctaatgtttaaaatactgtgcttttgacatcagaaagaaatcagatatatcgaccaatgaggcaaaatgaacagaagtcagaattagatccatacatatatagccaccttttatgacaccctaatgggcaagtgaaaaaaatatttttaaagcaaatgtggtacatacatgtcatgggatactatgcagccataaaaaagaataaatcttgtccttcactgcaacatggatgcagctggaggccattatcataagcaaattaacataggaacagaaaaccaaatatcccatgttctcacttataagtgggagcttatcactgggtacacgtggacacaaagatgggatcaatagacactggggactactagagagggcagggggaaggctttaaaaactacttatcaggtactatgctcaatacctgggtgacaggttcatttgcacaccaaacctcagcaacaggcagtttacccatgtaacaaacctgcatatgtaccctctgaaactaaaataaaagttgaaaaaaagtatttaaaaaagtgctggttaatttcaaaacctattggaaaaacatatttgaacttaatccactcattcatatatatcagattgattgcttgcctaaatagtggcttaaaataagtagctttttttttagaagaaggctttcatcacatcgagctaagtaaacatttctttaaaaggccacaaaacctttaaaccaaaagaaaataatataaattatattatgttaacatttaaaatttcgtttattaaaggataccggtatagggtgaaatgctgactcatagttaaaaatataatgttttcaaatacctatgtctgactacttctaaatctataaatatctacaaatgaatagaattatatttaaaaataggcaacccagtagaaaaatgaaaaaaatttcaacactaagtgagccagcctttccactctgagggtgacccacagtgatgcatgcatatgtatacaatgcatacaaaatacctgtattagaatgttcataacactattatttttaatgtctattgataagaaattacccaaattcctttcaggagtgaagtgaataagtttattttggtacacttgtctagtaaagtactatacaacagtacaaatggatgatttaaaacaacatacaacaatagaaatgcaatattgagagttgaagtacaaaagcagacaatctatgcttttagataagataacagtcatgtttggtgggataaagactgttattaagaaaaaatatgggcttctgagggaactgaaatttagcttttttatctcagtgctggctataagtgaaagttcagtttctaaaaacatttgtgttgtaaatttatgaatgtatcctcttccatatgtatattataacttcaaaaaactttcccaaatctccctgggcttcatcaaactgattttacctctgtacagtccctctacatccctccttgccccagcttgaagctcgtcagctttccctctgcctttcatatcatcagctctctataggagatgtgacctctttttaatttttatttctagcactagccttctgtaggttcattcctaaatctctcatgctgcttcttctcatcttagcaaatattgaaagaaaatacatgatccctatatcatcttgtttcattacatataatggtgctttcaccaactcggtgttttcccacaaggaaatatggatttacatgcaggaaaagctagaccctacccagattttcaggatgtttataaagaaatatttaacagcaagagttgtagataaggacaaaaatctagtacaccaccatgaattctttgagctcatggctcttttaactgctggtagagatagaatcctatgacctttgtttctaccctgcaacctggacaaaacatcccatggtcattggggaccaaaaccttcaggaaatgtaccttgaagaaagttgtttgtgtttacaatggccagcaggcaaaaggaggcagcggggagaacttttcccaatgcttctcactcaccatgttcctttgggttaatgtgttctcaggggatgtgaatcccacattctttcatatgcatccatttcttcaaactctttaagatacatctaactggtattgcttctgacagttcagtttatctcagccgaacaatttattaataacacaatgtgtaacccctaaatgccccggatgacactgccctgactggctcttatttcaaagcatgctttggtgggaacggtatgccatatattatgcctctcttgccattttaattttcttttattgcatcttgtcaggagcttaataactatacattgaataaaataagacatcacacacatatattaattacaacaatgttaagaaatattgtgtctctgctatcagaggtggcaattttaaattaatggaattttaaaacatcatttgccaactttgcttttttcaggatacatgttataaatataaatatgttataaatatatatttttttattctctaagagggtagctattattttggaggaggggaactggtgaccttctgccacggaattatgatgaatgctaggatgtgagaactgttcaaagggttctatcatcaagtttcacttgcatgtctaatctagtccttggcagatacctttttagattgctgcagagaaagtgaggcactctggctttttcgatttatctttgtcatttgtcccacgatgcattgttttcctgcaaatgatctctctattccttccctgctgagctacatactctgggaccttggccatgagatctctcttttcttaaacttgaaatttcatatatgcaaaatgggattaatgatagctataaaaccaagagtgtccctttaattaaataaatgatacatgtagatgctcaaaatgttatcaattattctaaattgtaaactgatttattgcaggggtgttgtcactgaattaagataggccccctgtactataaaactctctgatccctgtttcaatcagaacattgtacatcagcttattttaagggcagtatggcaaagctttgataaaactgaagttgtttctccacttcattgttgaatccaaatgcccccagagtgtttccttgaccctgagggtttagaacacactgattcaatcaccaccaattgaaggagttatgaaaactctcccaatattttctcatattcccatggggtttgtattttcagcaagtgctcccattcagggagtctgaattgtcaaaaccattgtcataataatatttagacgttttccctcccctttctaaatactttgtaatatcaattgggatttcatatttggccaattaattacttagaaatgtattgttgaattactaaatatttgggatttccccagatatattattgctattaattctcaattttgttatgatcattcatagtaacttggcgtgtttccatccatttaaatatattgaatatattgattcttgttttcttgcctaagaaatggtctattaggatcaaagtatcttttgcacttagaaaaatatatactttatagttgcaagtactattctctaaatgaatattagatcgagttaattaacagtgcttttcagatcttctgcatttgtatttaattttttgatgaatttctacaaattgtgagaggggattaaaatttccaactatggggaaaacctttttcattctctttttctctcttgctctcattttcttttattcttgtttcattatacatttcgcagctgtctattaagcacctgtacatagtggctgtatctttcagatgaataattttctgtatcattgtgaaacatccctgtatatctctggtgacgatttttgtcttgaagtccctatatgtggtgttaataaagctatcgcagccatcttttgctaattgttttcatggtttattgttttcatttacttattttcaagctacttatgctttatatgttcctcttttaaatactaaggattgactgtgtgcctttgtccactgatagtctctgatttttaattggaatgttgtagaatattaatatttaattactgatatggttatatgtaggcctaccatcctattaatcattttctgattgttcctccgttttttgttactttcttttttgccgtgttgtatgtttctctgaatattttagtacaccattttaatacatccattgaatttctttctccattttttcatattttatttacaatatgaattataaattatatacttaaatttgaacaatttatttagacttaatgttaactgacttcacctaagttagagataattcataacatttgcttaaatagtggtcataatataataaataaattgaaggggaaaatacttttttgcatttacctagatattatcgtttgagatactgttgcttcatttaaagattcaagttttctttggatatcatttttttccatcctgtagaaattattatacagcgaatctgctggtagcagtatctgttagtacccccttctcttaaatatatgtgttttacttttatttgaaggatatttttgccatatatagaattcttgatttacagtgttttatttcattttctcttttcaggcttttctacatgttgaggcacattagtttttatctctataattcgtttttggaaaatatcatcatttgaattattacttcactatatacaacatgttgcttttttctgtatgggtccctgaggctttgtttattttattattttatcttttttatctgttcttcaactcggataatttgcatttatatttatttacaatcactgcttatgcttttctgtgctattttcatcctgctatggatgccatctagtcattttttaaaattttttgttctaaaacatacattttcatctgaatatttttctctaatgagatttcctattgtttcatttagttttgtctgtcttcctttaccttatggaatatagtttagaatagctgtcctaaagtctttgactcataattccatcatttgtgtcatctcagggaatactttttttgtcttttatcttgaaaccatgtcacatttcccttgctctttgtttgttgagtacataatgtatataaagttacattataacaatgttattatataacatatataatatatataacatatataatataatattatattatatataatatatatattttgttaataacaatataatataatgttattatattataacattatagacattatgacttttttctgtggttttaaaatttctgtgtaatactttgctaaataataatgtattaccagatcatcaatgcaagttcagacaagttctgtctcatctctgcgagtgttgttgaaatctcaattcacttccagagtgtttgctattttggtttgagtctgtgctatgtaggcatagttcagatatttgcttgatatatatgagaattgtttaaatctcaattcagttctcatgcttttgccatgttttctggcttgagtctgctctgcgcatgcctgttttagtaagctcacactcctgcaagtgcaaccatacttagtaagccttttctcagctgatttgcatgaatgcagaactgcctcacgaatgcagaaatcagaggttaggctgagagatatgttggttcatacacagaattgggagttcacttctctgtctctctcttctgagattttcttatcaaactcctggctgctttccagcagctggggcttaagcttggggaaaagtccacagagaaaagaaaaaccaaaatgaataagcaaaaacaaaacagtaaaggagattgtgcctcatgtaagtcagatctccaccatccacttgcttttgtttagtttgcagagaccgctcactgtggtctgaatgctgtgtccccccacatatatatgttgaaatcctaacccctaaagtgatgttatcagaaggtggggacatttgggaagttattaggtcatgacggcagcatcttccaagagggaattcgtgcctttacataacaggccccaaagaggacaaggaggaatgggccccaaccagatactaaatctgctggcaccttcatttcgaactttcctgcctccagaactgtaagaaataaatttctgctccttataagcgacccagtctatggtcttttgttgcagtagctccaacagactaagacaccttattggttttaagttttattttccagagactttagctgtaaccagcaggaggaaaggacttgcttgagtctttcacttctgtaatgaagtcagaacctttaactaatattgtaactaagattacaattttagaatatttatgttatccacaaaattattcttagttttcccaccgttgcttggtctttctaaatgcttcatctctgtttaactgctccaatcacttcacgttctcaaaagggataattagttcatggcccatgaatattcttttattgtggcttggttttatgctcacctcacgcctcttacacatggcgtgttatccactagggccagtgtacacagtgatctcaattgatctgcatatgtatgcaatatgcttatctgtaagtctcagcacacaggtagggagctagagtaatgtatgccttggtcaacagaaccattaatacactttaatagtctgtgcattccaggagtatgctttttattgcagagcatggtaaagaccaggaggaaaaggaaagaagggaaagagaactaataacctactgagtgcctgctacgtattacaccaaggcaggaactttaaacgtgccattttacttaatcctcaaaaagaccccagttaatacactgttagactcatttataagcagaaaaaatttggatctcacttgagtgaaaaactattcctaggtaatataatcagaatataaaagatataaaattccatttaaaagtataagattcccaacctcagcaggatgaggtggatcacgcctgtaatcccagcactttgggaggctgtggcgggcagatcacaaggtcaggatttcgagaccagcctgaccaacatggtaaaagcctgtctctaataaaaatacaaaaattaactgggtgtgttggcacgcgcctgtaatcctagctactcaggaggctgaagcaggagaatcacttgaacctgggaggcagaggttgcagtgagccgagatcatgccactgcagtccagcctgggtgacagagcaggactccgtctcaaaaaaaaaaaaaacaaaaaaaaaaacccacaaatatccttcaacaaaacatatatgaacaaattgtggtatattccaaacctcacagtctttatcttaaaatagtagtccatccagagtataataaatggtatttccaaaaaaaagtaaaggtgttgatttcatctcacgctatgtcacttgtgtgtaagttatataataatgtggcagaatattatcctcctaacgagtgaatattccaacttcagattaggtattgtgatgctggttgaacttactatctgtagaaaactcagttaaatttcttaaccttaaatagagtttttgtgaagactaatttagaaaatgcatttagcatagtgtcaggtgcattactaacattaaataagtgtattttattttgtattattattgaataaaggtatgaattgatcagtgattcattattatggattgttcaggtaaatctcctggataatttttttttacatttatccaggtcccaaccatagcacttggcaggcagtacacctgggattcagactcctgtatttcagaggaaaacatatttctttcaggtgattctaattattaaacttgcttaaattccacttcaattaagagaaccaaaaagtaccttctatcttggaaagtctatgatttaaatgattagtgtgggatgtttggggaagctttcatgaagatgttaagttgctctttgctttgtaatatagacataaaatttctatgtgtagtattaaatataaaactcatattaatattacttttttatttgtatagaaaatttaaaggcacccatagatcatgattataagaaaaaaacccaaaacctttgaaaatagtcaaggactataattcaaagcaaagttttcatgtatgagcattttgagtgtttgcttttttttttttcttatttcaaacatcacattccttttccacctgctccacctagataatgtctgcaagttcaggaagacagtacttaactacaggggacaaagaggtcacccacttagaaaacccacttcccatatttacctctgaggcaatatattagatttttcataggaaaactttaaaaattaaaaattaatgagtaaaaaatgctcattaataaatcccaactgcctatttcttagaaggcttaaaattagcacagtttgaattttctattgtctccaaattctattccactaagcgtctgtaaaaaaaaactggggtaggcaaggtgactcatgcctgtaatgctagtgggaggtcgaggtgggtggatcacttgaggtcaggagttcaagaccagcctggccaatatggtgaaaccctgtatctactaaaaatatgaaaactagccgggcgtggtagcaggtgcctgtagtcccagcgacttgggaggctgagccaggagaatcgcttgaacccaggaggcggaggttacagtgagccgagattgtgccactgcactccagcctgggcaacacagtgagattcagtctcaaaaaaaaaaaaattgtaggaaatttttctgtgtgtgtgtgtgtgtgtgtgtgtgtgtgtgtgtgtgtgtgtgttttaatccacctcaaaaaatgctgggcaaaagcaaactaaagtctacctgtttgtcagaaaatataacaaagataagaaaccaaacacctgaactgtttgtggaaattcctcctgtaaagagtttgacatggccaggtgcagtgccccacacctcagctgtaattccagcactttgggatgctgaggcaggcggatcacttgaagtcaggtgttcaagaccagcctggccaacatggtgaaaccccgtctctactaaaaatacaaaaattagctgggcatggtggtgcgtgcctgtaatcccaggtacttgggaagctaagaaggaaaatcacttgaacctgggaggcagaagttgctgtgagctgagatcgagccactgcactccagcctgggcaacagagtgagactctgtctaaaaaaaaagagtttgatacatgtgggcatataaactttgattttccattttgtaaatatttattttgaagaaattattatatttatatttactgcaaaaaatatatgtatgtattataaatacttaaaaaaaaggcacacaatctatcaccaattcagaaagcagagagtaaaaggaagtatatttaaaacatgtgaaacaaaatagctatcctcagactacaaacagggatactattcatttgttactatgtaaatttccaaaacatgtatactaccagaagcattgctaagtcaaatgcttaacaatttatcctactaaatcctttatacacatacttcaatttttttagacaaacgtacaaatgcacattgcactcttgcttatattttatcaaaacccctaaatcttttaaaaagtattgtcaattatgatagatttttactatggaattctaaataaacatacaatttattcgtgggaaaaaatattgcatttaaggaaaagtcttccaacatattatgtagtgaaaaagcctttataattatgcaagcaaagtgaagttgccttaaaaattgtttttagttgttaaatcaataattggctattaaaaatgggcaagatatttgaatagacatgtctccaaagacatacaaaaggccattaagcccatgaaaacatgctcaacatcatgaatccttaaaaaaatgcaaatcaaaactataatgaaatagcatctttcacatccattagaatagccactatccaaacaaaacaaaacacaaaacccataaaataacaaatgttgacaaagatgtaaaaaattacctgcgcattgttgatgggaattgaaaatgccactgccactgtggaaaacatgttggcatgtcctcaaaaacttaaaaatagaatttacatatgatccaacaattcaatttgggggtatatatcccccagcattgaaaacagggtctcaaacaaatatttgttcacccctgttcataccagcattattcaatacctaaaacttggaagcaacccaagcgtctatcagtatattaatggataagtaaaatgtggtatagatatacaatgacatgttattcagccttaaaaaaagaaggcaggagtttctggccggggttggtggctcacacctaatatcccagcactttgggaggccgaggcgggcagatcacctgaggttaggagttcaagaccagcctggccaacgtggtgaaaccccctctctactaaaaatacaaaaattaaccaggcatggtggcacatgactgtaatcccagctccttgagaggctgaggtaggagaattgcttgaagccggaaagcagaggttgcagtgagctgagatcgtgccattgcactccagcctgtgtgacaagagtgaaactccatctcaattaaaaaaaaagaaaaagaaaaaaaaaggcagttctgatatatcccacaacattgatgagccttgagggcattatgctatgtataataagccatttacttaaagacaaatgcttagaatagtcaaaaattatagagacagaaagtaggtctgggagaatggggagttaacatctgatgaatgtagagtttcagttttacaagacaaaaagcatattatggagatgggtgggggtgagagcggcacaacattgtgaatgtatttaataacactgaactgtacacttaaaatgcctaagatggtatattattgtatgtgcattttactacaataataagatttaaaaaataaagtttatctgaaactgtaagatgacttttcccttgattgtgatgagtgagttccagactctgactaatttttttcctgtggtctactttactttagaccatttcataatgactctcacacatttagtttatgataaagatagatatttaggtagatagataaagaaataaacaaggatttagatgtatttatatgtttaatgcttttctgattcattaaggagactctcttggtcctacatttttgcaagaggaaactatctcttattcaacctagaggaatgactttagtttcacttggaatttggagaaatctcttaagatgcacacgaaactcagagaactcaactgccataactaggctttccaaaacagttaacaggaaagatgcttaaagccttttctcactcagtatatcaaaaccaacacagctggctgacatttctctttaactatatacaacagtatctaaaggaggactttgggagaaattacaggctttggaaacagcagaaaataggtggttctgtttttttgtttttttttttgttttttttttgacagagtctcgctctgttgcccaggctggagtgtagtggcgtgatcttggctcactgcaacctctgcctcccaggttcaagtgattctcctgcctcagcctccttagtagctggaactacaagcacgtgccaccacacccagctcatttttgtatttttagtaaagatggggtttcaccatgttggctaggatggtcttgatctcttgacctcgtgatccatctgcctcggcctcccaaagttctcagactacaggcgtgacccaccgcacctggccgtggttctgttttacaacccctatcacaaataaaaatgtgatatttgaatcacatttttaacaaaacaaagtcgatttttcaaatatgttttttacagtataaaattatactgacacaaaaacaaatgcagcagcttttaaactaataatacaatcccatggataatttcccctaaatagctcagatgtgtgaatgaatgaatcatacatctttgcagaaagcaattttcttcaatgagttctacctgctggaatcttaatacactgcagattgggtaaaggctttcagttaaaataaaatggtaagactttctctagagcaaaacctaaatcctgacggagagataactatgaatatatttaaggctgcctacttctgagaagcttttcgtcccagacatatttcttatgctcacaacagtttactctgtgaaggaatcaagtgatataagtggattttaacaattcttaacaagttccatttccctttgcattagtgttctagggttactgtaacaaagtaccacaaacttggtggcttaaacaataaaaatgtattatcacatagttctggaaactaggagaatcctagatcaagatgttgatagaacttccttctcaggacagcgaggacaaatctgttgcatgcctcttccccagcttccactgggttgctggccatttcttggcttgtaggagcatcagcctccatcttcaggtgacattctccaagtgtgggtgtctacattcaaatttccccttttataagtataccagtcatattagactaaaggctcaccctactccagtatgatcccattttacctaagtacatctataataaccctattcacaaataacgtcacattctgaggttctgggggctaggacatcaatataagaattttaaggggacaaaattcaacccataacactcttaatgtggtttgcattccttgatggggtgtcgtcttacaaatatcttacaagtatttccttaaaagtttctctcccccgcctttcaatattcactggtgtatcatgatcattgggaaactaaggcactttaaccacacatcagatccaggaaaaaaaccatacaacccagctgtgaacagaagctgaacattttgatgttaaaaattaaaaaaaaaaaacttaaaaaataaagttacagttttttaacatctagaacatttacttatttatttacttttatattattatttagtcattctgtttaaacatttgtttttatttatttgttttattatgaagctcttttcccctatgctggaacaagatttcatcaggcaaacctattcagctacatttgcttggtatatttataagtctaaggaacaaaccaaagccttttataaggaacttgaaactcaagacagaattaatcatggtaagttagacatctggtccatagagaaccacaaaccaatgcaaaagccagatagtttcaacattcctttcttttcataattgttgcacagttatatccgttcttatgacgcttttatcatgagtcctgtgcttgtccctcaaatgaaacaagaaggtgcttgcaggtagaaaggatttttactgggcttagtgtcagctccattccatggcactttgctgaccatgctaacaattggtgcttgatgccctacagaatggctttgttcaatactgacttaagacagttaaaagagttgcagatgatattacttctggtgagcagtggagtcacagattaggagaataagaatataaagtagacataggttgtaatagtggaacctgaagttacagtgagaagtcagacaatctggagattggcttcttttctgatactttactgcatagatagcttaattaacaaagtgaaggtgatgcttgttctcactatgccactgagaagttggaaggatgcaagagatgagcaatgtcaacaagtttagtgtcacagaaatgttcaatcagaccctagattaaccatgctggtttctataagatatgaaacagaaagggctaaagagcaaatttaagtaggtaaaaaattaagtttactaccatttctattcttctctatatttgtaaggatattaagtgtaagctttgaaaaagcaaacatccttccacaaacaagttggtcctaatatatgccagatagttctgcatgttttgataatagtaataataatactaatactgctacttctaatcattattattattataatcctgagagctaattaccatttacttaaagcttactttgtgccaggtgctgcacttaaaaatgtattgtatgttttatcttaattaatccttgctgagctaaaatgagcttcattattttccttttttaaatgatgaatctgagactcatataaattatggaactatgctagaccacatagctaatgagaaagagagcaaagaccatgaaggcatgtgacctgagattagcacctgtatctgttacacatagctgcatttctattctggtagctttatgttttatgtgaccaagggtaatctacacattaaattgtttggttctttacagcatgtggctttatgggcataagttcaaaggttctgctggagattctgatgttatgttaaattagagcagttacattctccagttggttctctggaggttgtatggcttgttgtgatggggctaggaaaactgtcacctaggtccaatttgccttgaataaccatgggttttttttttttttttggtaataaacctattatgcccataaattacaggtcatgctaaaacacctacgttgtagagacattatggagattaaatcagatactaatgtaatgaacttactacttagcaaaaacttatagaacttaccaggtacttagcaggaaccactcacatgctaagtacctagtaaactataattagcaaagacaaccacatgtgcatttacatcatcatttacatttatataaaaagatattaaaaaatgtaaagtccttgaggaaagtcatcatgttttatgtgtccgtgttgaatccattgagtgttcaactctccttaaaagcgaagtcatcgcacagtgacaaggcaagtgcagtcagttattatgaagctaaggggatatccagcccctttacctctggagtacctggactgaaagtacccttggcccacaaaagaataaggagtctacagcatcagacatgtgccttctgatgcaggcctgaagtcttgatctgtgtttctaagtcttgaataaaactgtcctccctctaccagactgcgtcattacttctctccaatctttggacagaattgatatgtatattcaggaggtacaaatactacagaggctgagactccagagtctagttcttttggttgccctgtgagtgttatacaagagaagaatgcaaaaccatggcctattctaaatatgtaatatgttttattgtagataatctttgaataatcctaaatgagaactgggattgccttttgcttaaactcaaggcaaacagctttgtaaactcaagcaattatctcaagatagacagtcagaaaggcctggtttggaattacatcatttgagctaaaccactatactctataactcaccccattcctaccgtcatcaactttcattttaaataagaatacctataatttaaagactatatttctaattctcaaagttcagattcataggacactgacgagagtacttccagagatgttgccattctggcatctcatatttcaccatgaacttagtttaagaggggtggctggctagaaatgagtcccagtcccccattgcacagagctgttttctgaaactttgcctctttaccctgttaggtaaaagcaatatgtgtgactccccagcaagtcatcaatcacttgttggggctggatgtgtgttgcattagttggtgttcaacagtttgtttttttatgtcaggcaacaaaagggttcctcctgtcatcctgagattagaatgctctctgtacatcaacatggtaggtatggacaattagattcacaggagtgttggaagattagaagagtcctcaccacctggtccagacagaggagccaggatattcagcattcctttagattttaaatgaaagccaaagtaagaggcatagctcctgattttcatttatacagtcaataacacagaagaaatgaatctaccctagacattcttaaccatgaagccatataattttttccttcttgtgatttttcatgtacagtgagctcatgctatgttttgatatctaaggactgaaatgacctaagaaggagcaataaatttagacataatccttatagatttggattctaataaattatttactcatttatggggatagaaaaatcattaatagcagacatgctgtgaaaatttagacctgagttcctgtggggcccacatattcctggtagcttcacagccctgatactgatctcacctcagtgattcatcaaacagtgcttctatttttagcaggtaaaaacaaaacaaaactcatctctacaatgttcagttagcatacttggttctcagaaatactgatgtttccaaaatggagatatctcagtgaaaacatccttttgatacccaggtacctatgttctctaatgatgtcctaaatcagctgaaactatccacaatttacaggtgggatgcttatcaaaaattctggccatactacaatagaattgggctggctacatctggtaagatgaagagttgaagtaacctggagtaatccagtagacatggcaggtctgtctccaaacaaaagtcccaaatccagaggtttccagaggaccaaaagcaacagatgagaatgtaactgaaaatggagaatggagattaaactcgagaggaataaagcaggacttttttggtcttctaggtaggatggtacaaccctgaagaggagcacatcaggaatagaagcactgaccagtcaaaagggacgcttatggcaaactcaggcccatgttcacaggctgttgatccagccccaagattactgcttgtttctagagtgagacaggggttcagaagccagtgggtgaaccctatgcaacatcaggacaagacagaaacactaatctccaagaagaactgtattagtttgtttccacactgctgataaagacatacctgagactggacaatttacaaaggaaagaggtttaatagagaactcacagttccacgtggctggggaagactcacaatcctggtggaaggcaaggaggagcaagtcacacctcatgtggatcgcaacaggcaaagagcaagtgcttgtgcagggaaactccagttttttgtttttgtttttgtttttgtttttttgagatggtgtctcactctgtcacccaggctggagtacagtggcactatctcagctcactgcagcctccacctcctgggttccagcaattctcctgcctcagcctcccgggtacttgggattacaggcatgcacgaccacacccagctaatttttgtatttttagtagagacagggtttcatgatgttggccaggctggtctcgaactcctgacctcaggtgatctgcctgcctcagcctcccaaagtgctaggattacaggcatgagccaccgtgcccagccagaaactcctatttttaaaaccatcagatctcatgagactcattcactatcacgagaacagcacaggaaagacccacccgcataattcaatcacctcccatcgggttcctcctacaacatgtgggaattaggggagttacaatacaatatgagatttggatggggacacagccaaaccatatcattctgccccgggctcctcccaaatctcatgtcctcacatttcaaaacataatcattccttctcaacagtaccctgaagtcttaactcatttcagcactaactcaaaagtcctcagtccaacatttcatctcagacgaggcaaatcctttctgcctgtgagcctataaaatcaaaaccaagttagttacttcctagatacaatgggggtatgggcattggataaatatagccattccaaatgggagaaattggccaaaaagaaggggctacagaacccatgcaagtctgaaatccagaagggcaatctaatcttaaagctctaaaatgatctccttagattccatgtctcatatccaggtcatcctgatgcaaaaggtgggttcccatagtattgggcagctccacccatgtggctttgcaaggtacagcctccctcccggctgccttcacgggccgtcgttgagtgtctatggcttttccaggtgcacggtgcaagctttcaggggatttaccattctggggtctggaggatggtggccctcttctcacaggtccactaggcagtgccccattaggaactctgtgtggtggctcctaccccacatttcccttctgcactgccctagcagaggttctccatgaagatcccgcccctacagcaaacttctgcctgggcttcccggcatttccatacatcttctgaaatctagatggaggttcccaaatctcagttaatgacttctgtgcactcacaggctcaacaccatgtggaagtggccaaggcttgaggcttgactcctctgaagccacagcctgagctctacgttgacccctttcagccatggctggagctgctgggacatggcacagactaggctgcacacagcacagggacactggacccagcccacataaccactttttcctcctagacctccaggcctgtgatgggaggggctgccgtgaagacctctgacatgccctggtgacattttccccattgtcttggtgattaacattaggctccttgctacttatgcaaatttctgcagcctgcttgaatctcacctcagaaaatgggatcttttttttcttttgcattgtcaggctgcgaattttccaaaactttatgctctatttcccttttgaaactgaatgcctttaacagcacccaagtcacctcttgagtgctttgctgcttggaatttttttccaccagatagcctaaatcatctctctcaagttcaaagttccacaaatctctagggtaggggcaaaatgctgccagtctctttgctaaaacataacaagagcgacctttgctccagttcccaacaagttcgtcatctccacctgagaccacctcagcctggatttcaatgtccatatcattatcaacattttggtcaaagccattcaacaagtctctagggagttccaaactttcccacattttcctgtcttcttctgagccctccaaactgttccagcctctgcctgttacccagtttcaaagtcactctacattttcaggtatcttttcagcagcaccccactctactggtatcaatttactgtattagtttgttttcacgctgctgataaagacatacataagaatgtatgcaatttacataggaaagaagtttaatggagaactcacagttccaagtggctggggaagcctcaaaatcacagtggaaggcagcagggagaaagtcatatctcatgtggatggcagcaagcaaagacagagcttgggcagagaaacttatgtttttaaaaccatcagatctcgtgagactcattcactatcacaagaatggcacaggaaagacccacccccataattcaatcacctcctattgggttcctcctatggcatatgggaattgtgggagttacaattcaagatgagatttgggtggggacacagccaaactatatcaagaacctcatgaagagagtttgaagttagatacgcaggtattcagcatttctattactagatggaagtttcttagactccaatggattggagatccagagcaaccagacattcagtggtcaaaaaatgataaatgcctgaagtgtattgtgagatgccagatcctttataatgacacggagcctacctggagacaaactgcaaagagcagcaaaaagcaagttactaagtgctccttattttcattatgcctttcaggggaagttaaagatttttatttttaactttttggccctagagaaaattgtatttcttgcattcactgctcgtacttatgctttgcagcatagactacatttatagacaaaaaagaagggatattcttctccttgtggatggtgcacatttctaaataaagcaggtgtttctaattaacgaattttgcttgaagaaagcagctatttccacccctcaccctcctcagagacaaaaacatgtccttattctgttttacctaaaaaagaaaattattcactcagagataaaaagtcatctaatttcataattgtcctctatcctacaaaccaaaatgaaaatttaaatgagaatggaaaggggtatcttgtgagccatctccagaaagttatcatggctgtacaatgttattcaagactgaagctctgttctgtgagaacacaggatctagggcactatctgccaaagcccataacaatgcctttgctgttctaaccacccgtgcctcagctgacttaaaataaaaggattagcctaaatcatcttgaaaattacatcttccttaaacatctgtggacctatgaagcatatattaacacattccagcatgttattgttggagaatttctgtatgtgcaggcaatgttagtgatttaaagctccctttgatattctaggtatctaaatgcataatagctatttaatgaatgagcagaagtattgctaccaaaataaaattgtatgtcttctatatactgtttaatgatgatgaatgcctttttaagtgtgaaataaattgtataaaaatataacataattatatatatatatattttatacatatgtatgtgtgtatctgtctatctgttcatccatccacccaccataattccctatttagttgtctggagaatgtattttttccattaacattatataggctataaaatattatctcatggcattcaccattttgggggcaaaatgatgttcaatgatctttccccatctgcctagcttaattttcttcatcaagctgtgtctatctttggtaaatcattccacctctccacaccttaatttcccctttggtaaaagaaaaggcttggactactgcaatgtttccccaagacacttttgcaagatacatagtaaaaaatagtgttctgtagtcaaatgtttggaaaatgctgcattctgtgttccatcttagaaatgcagttgcacattaatacgttaaatgttctgagatatgacagggaagaaagttgcttacctttaattctcccagtttatttcagacatttgactatgaaatcctttctttcttgaattatagcaatttataaagtgcatcaaatgacatgatctctggattgacattaaggacacttgaaagtatataatttctaaggagtattggattcttggtttgaattaaaactatgatgttgttgcaatatgacacagtctaatcatgcaacaggatttataaaccctcattatgaaatatccattccctacccaaaccttccttattttcataggaaaaaacaggtttaataattagtattcagcctcttttcttattttaggataaaaaaacaggtttaatatatagtatacagcctcttttcctccacccacctttagaagtgcctgtgtgtgtatgtgtttgggtgtgggtgggtgagttcgtggtgggtatgtgtatttgtgtttgtatgaaacttgactacattttaggtttagatagcagagaacatgaggttggaagctaacttccccaggcttgggtctggttatcatgatctagaaaaattaacgtatttctgcgtttgtttccttgtctggaaaatggattcaatagtaacttctagaccttacttataaggatgttgaaaacaaaatctgcaaaacttgactcaagtggcttctctcatcgtagagaaatgaaaacagtatggggagctggattgacagctgtaaaggatatagccttttgagtaaaatacaagaagatagtctttgctcccaagcttgctcaaagagctatgcctcaaagcacctaagaaacaccatgtttgtccaattcaaggaaatgaacccaccatggtcagaatgaatttcaattccaattctcaatttgaagttactgtggtgttcagatgatatagacaaatagacagacgagaagaactcagctctaaatttaaataaataaaatcctaatttatgaaatacaagacctagagagtctatctgaatttcaaaagagataattttaagacagaaatagatgatgtaattgcatcagccttgttattttcaaaaatcatccaaacagtaactagactaaaatctatgtcgataaaatatagacaccaatggatgacactccacaatggtagactcttaaagatacagagtgacatttgaagacatttaccacttttgaaagctgaaattaaataatctcagagttgaagaaggtcctttcatgtgacctagcctcctctgtcccttaatatcctctgcatgataccacacaaatattgtcaagaatgaccataaatgtctcttatacctttgttctctcttgagggtaaaattcttctccagtctgttgcattttgttcttatataaaggattttgtggaaaacatggtgtttttgaaataaaaaaaaaatgactaatttatatgacgcctatcagtgatctgatttcacagacagagcttacatttaaaaaaacatgtgcacgctccataggacaaaaaccactctttgtgcagaacatcagactattgtaagaattgcttgaaaagatgaggtttgaatgggagcatttgtcaagtcaatggatttcattgcatcttgaaaagaaaaattaagaactcagtgaaaggatttatattctgtgcttgcagagttagttttgcctcacacacattatttcccccatccacagacacatcgtggaaggcagggtttttttatacttttgtttcatgttctatctcgatttcagacagttttatccactactaaatgcttacactatagtgtaactgctactatgtgtcttccagataagctataattctattgagaacaagaactacagtcatgtggcacataatgatgttttggtcatcaatgcgctacatatacaatggtggtcctatatgattataatattttattcttactataccttttctatgtttattttaaattattattatgattattttttgagacagggtattgttctgtcccccaggctgtagtgcagtggcacgattatggcagcctcagcctcctgggctctcccacctcagccatcctagcagatgggactacaggtgtgtgccaccatgcctggctaatttttttgtagggatagagttttgccatgttgcccaggctggtgtggactcctagattcaagtaatccatctgctttggccttccaaagtgttgggattacaggcatgagccactgcacctgaacttttatacatttagatatgtttagatacacaaatacctactattgtattacaattgctgacagtattcagtacagtaacatgctgtgtgggtttgtagcctaggagcaatgggttataccatatagcttaggcgtgtagtaggctatgccatctagatatgtgttagtacactgtatgttgttcacacaatgatgaaatcacttaacaatatatttctcagaccgtattcccatcattaagcaacacacggctatatattgtagtcttcttttgttgatctcttagctcttagataagggcataccacaagaaggaagttctgcatttattggagatatatatatatatatatccaatatttatctatttatatatatatctgtatttatatatgtctgtatttattggatatatatatatacacacacacacaattatagatatataaatataaattggcatatggataagtggatggaatataaatctagttttaaattttttacaaatgttttcagaagcagccaccataataaatttcaaattatcattcctgtgtcttatgtttattacttttacatagatccataaaaatatatagtattatttttatactttcaaaatacgtgtttcttttttcttctgtagcttgcttttactcaagagattctaatacatttcttcttactgctcagtagtattttaatgtataaatataacatacttttatatgatagaagttggagttttgttctctattttttactattaacaacatgctgctatacatatatttatacatgtctcaaattacacaggaaagtgagtttctctagagaatatccctaggagtgagattgctgtgccatagggtgtacatatgctcaatatgctagagattgccagacgctccttcataatggttattcaaattacgttcctatggattctcattgtataaaactgcagttttccaacacgaattcttagccttttgagtaaaatacaagaagatagtctttgctcctgagcttgctcaaggagctacatctcaaagcacccaagaaacttcatgtttgtccaattgaaggaaatgaacccaccacggtcagaatgaatttcaattccaattctcaacttgaagatactgtggtgttcagttgccacagtcaaacattttctttctccttttcctcaactgtctctagcccattccttatatatacaggttctggcataattgaaagttatcattaatgacaaaaaatggttacatttatccaaatgtgatcagtgttagcaggactgatcgtgtccctattcacctgctcccactcttcctgtgttctaagagccttagtatccttttacattatgctgtgcattaacagcattacagggtggacaacatggctgctgaggtgctaaggttgttataaccagaggtttcaatttactgcctctatgtgcaatttattaaaagctataacgtcttagaataaagcttaataaaacaaatcaaaccctgtgtttccaagacatattttaaagagaagcttttattaggcggtcttttaattaaccatttgctgtcaaaaataaaccataccatgcagaaatgtggtttctactggtatgtctttctctttcaacagttacttatcacctcagccttcctctgaaaatagtaacctctcaaaagagatgagtatcacataaggttttgcatttttctgttgcctgtcaatttgcttatttttaaatgtatttataactgcattttttaacaaatgaaaattctaggtatgactcttttatgttgtttattttcctttaaagtaaatattcttgtggaaataaaacaggaatataacaaagtgaataaatcattgatttttcatgaagtgaatgcaatttatgaccagagaatagatcaataaatgcaatacttacccacacctttgaagactctctcatttcctttatcacgcacctttcaacctccaatacctaactgcataatacctaactgcttgcttgggttttaaatacatgaaatgcatcaagtaaacctttttcatatgagatcagtaaaacccagaaagaagaaatgactcattcagggttgaacaatgagtataggaattagcaccagtaccgcattctcacatgcaccttcaaacagcagggcagaaataacaatcaacattaagcatgtactgggaatatggcagagtaggcagcaccagaaatctgttttcctatctaggcaatgtcagaatctgtctgatataacagttttgtaaatctggagtctatttaaggcttgcaacttatagaagaagagttgaataatacatttctgctaattttggttaatttgaaggttttgtttttctttttctttttctttttttttttttttttttcttttttgagacaaggtcttgctttgccaactagactggagtgcagtagtgagatcttgaatcactgcaacctctgcctcccaggctcaagcaatcctcttacctcagcctctcaagtagctgggactacagacacaggccaccatgtccagctaatttttttttttgtattttttgtagagacagggttttgctatgttatccacgctgatcttgaactcttagactcaagcaaactgcctgccttggcctcccaatatgctgggatttcaggtgttccggtcttatttgagtttttaccatagtagtagttaacttaccccaccccttagccccatggcatgcagccacatattccaggaagaacctgcacatagctgctgggagcccaagtgggcaaaacaaaggaccattttttttgctaatatgagggatttgggttctcatcactgatcactgcttctgatcacaagagttgcacataaaggtggtaaccattggtgcctctccttttattgtttcaagcacctcacaccctggctgaggtgtctcctaggagacttaaagaactggtgctggtgccacccccatctctctttttccttttcctctttatggagccatacattgaagaccaaggcactcaaaggcattctcatatatgggtaaaattagaaagtcaccacacatgcccaggggaaagcacggactaagaaaagacgtgaaaagaccataggattatacctcactctaatacttggtacagatatgatccaaaaataaaagaaagaaagaaagaaaaactgaaaacaacaaattctggggaaggagaagacctcatttccagagctaccacagtattagatggaaatgtccattttccaacaaaagattataagatataaaaagaaaaagaaaaatatggctaataaaaagtaaaaaacaaaaacaacagaaactcagcctacaaatgaaatgcttggcagagctaccagacaaagactagaacaactgtctttacagtgctccaagaactaatgtatgacatgaataaagtcaagaaaaatgatgtataaacaaaacagaaaataaaacagttagagaaccaaaaaacaattccagagctgaaaaatacaacaactagaataaaaaatttatctagatggattcaaaggcatatttcatcaggcaaaagtaagaatcagagaatttgaagataagacaaccaaaattatcaagcctgaggaacagaaaagaaactgaaaaaagtgaacagaatttaaaagacctgtgggacaccatccaacaggtgaatatgcacactgtgtgagttccaaaagaataggaaaaaatgaagggagaatatttgaagaaatagcggcagaaattttgccaaatttaataaaagacatgaatataaatattctcaaaagctcaattaactttatgtaggattaactcagagacccccatggagagacacaatcaaattgtcaaaatccaaagacaaagagattcttgaaagcagagagagagaagcaactcatcccatacaagggaccctcaataaagttatatgtagatttatcatcagaaatttttgaggggagaaggtagtgggttgatacattcaaagtgctaaaagacaacaactgtcaaccaagaattttatatctggcaaaattgtccttcaaaagagagggggaaatgaagactttcctagataaacaaaagctgagtgagattgttaccattccacctgtcctgcaaaaaatgctcagggagacctgcacgttgaaatggaaaaaacaaaacaaaacaaaacaaacaaacaaacaaaatcattataaagtaactcattaaaagaaataaatacctgagtaaaataaatacataggcaattataaaagctagcattattgcagtaatagtgtacaattccattttttgcatgatttagtagactaatacatcaaaagttgtaagtctaaaagctagtattactgtatctttggttcgtaacttcacattttgttgtctatataatttaagagaataacacattaaaagtttttaatgtatttgaatacacactctatgaagatgtatttttattaacacctgaaagaggtatggttagggctattaaaggtgcagatttttagtatattattcaagttaaataggtataaattcacatttgtaatacatgtaataactctaggatgtgaaatgtaatccctcattgtaactacaaagaaaatacctacaaaatataaataaatggaaactaaatgtttcactgaaagaaaatcaactaaacacataaaagacagtaatacagaaaatgaggaataaaaagctctaagacatagataaaacaaatagcaaagagcagaataagtcttttatcagttgttgctttaaatataaatgaattacactcttcaatcaaaattcagagattggtagaatgcataaacacagatgacccaataatatgttgtctataagagacttaatttataaccaaaaatccaaattggttgaaagtgaatgtgtggaaaagaatatttcatcccaatagtaatactacaatatttcatgaaatagatatttcatggctatactactatcatataaaataaaatctagggcaaaaacatttataagagacaaggacattttatataagtaaaatatctaatatagcaagaatatataagaataaaaatatgtgtgcatcttatattagactatcaaaatatattaagcaaaaattgacaaaattgaagggagaaatagtgagttctacaataatacttgaagacttataaacctctttttaaatataaaatagaacaactagacagaagataaggatatagagaacttaaacaacacaacaaattaactagatcctaaagacatatacgtaataattctacccaacaaaaataaaatacacactctagggtacacatgagtcattttccaagatagaccatatgttggtcctcaaattaagtttcaacagattaaaaaaatagatatcagacaaagtatatttttcaatcacaaacagataaaactagaagccagaaataaaatataaactagaaaatttacaaatttgtggaatttaaccacacactcgaataatcagagacttaagacacaaattacaagagaaattaaaaaacacttagagacaaataaaaacaggaacgcaacacatcaaaacttatggaaaatagagaaattgctgctaagggagaattttatacttataagcatttacagtagaaaaaagatatcaaatcaataaccacttaaataaatagaaaaaatgcatactaaacctaaaaatagcataaataaagaaataataaatactagggcagagataaaagaaatacagagtagaaatgttttagaggaaatcagtgaaagcaaaagttggtttttgaaaatattaagattgagaaacctttagctctctggactaaggaagaaaggaaagactgagattgcttaaataagaaatgaaagtgtaggggtggctggcaagatggctgaataggaacagcttcagtcggcaactcccagtgagatcaatgcagaaggcaggtgatttctgcatttccaactgaggtacccgacttatctctttgggactggtaaggcagtggctgtagcccacggagggcaagcagaagcagggttgatcatcgcctcacctgggaagcgcaaggggtcagggaactccctcctctagccaagggaagctgtgagggactgtgccatgacagacactgcactccaaccccaggtactatgcttttcccatggtctttgcaacctgcagaccaggagattcctcaagtgcctacaccaccaggcacctgggtttgaagcacaaaactgggaggctgtttgggcagattccaagctagctgtagcagtttttttttttttcataccccagtggcacctggcatgccagtgagacagaatcattcactcccctggaaatggggcgctgaagccagggaaccaagtggtatagcttagcggatctcaaccccatggatcccagaaagctaagatccactggtttgaaatactctttgccagcacagcagtctgaggtccacctgggatgcttgagcttgatgcgggaaggggtgtttgccattactgaggcttaagtaagcagtttccccctcacagtgtaaacaaagctgctcggaaggtcggacttggcagagcccactgcagctctgcaaagctgccgtagctagactgcctctccagattcctcctctctgggcagggcatctctgaaagaaaggcagcagccccagtctggatagataaaactcccatctccctgggacagagcacctgggggaaggggcggctgtgggtgcagcttcggcagacttaaatactcttgcctgctggctctgaaaggagcagcagatctcccaacacagcgctcgagctctgctaagggacagactgcctcctcaagtgggtccctgaccccagtgcctcctgatggggagacatctcccaacaggggtaaacagacacctcatgcaggagagctggggttggcatttggtgggtgtccctctgggacaaagcttccagaggagggaacagacagcaatctttgaggggtctaattgttagaataaaaactaacaaacagaaaggaatagcatcaacgtcaaccaaaaggacatccacacaaaaaccccatctgaaggtcaccaacatcaaagaccaaaggtagataaatccacgaatatgaggacaaaccagcacaaaaaggctgaaaattccaaaaaccagaatgcctcttcgcctccaaaggatcacaacttgccagcaagggaacaaaactgaacaaacagagaatgagtttaacaaattgacagaagtaggtttcagaaggtggataataagaaactcttctgagctaaaggataatgttctaacccaatgcaaggaagctaagaaccttgaaaaaagttagagaaattgctagaataaccactttagagaagaacataaatgacctgatggagctgaagaagatagcatgagtattttgtgaagcatacacaagtatcagtagccaaactgacgaagcggaagaaaggatatcagagattgaagatcagcttaatgaaataaagcatgaagacaagattacagaaaaaagaaagaaaaggaatgaacaaagcctccaagaaatatgggactatgtgaaatgactaaacctacatttgattattgtgcctgaaagtaatggggagaatggaaccaagtttgaaaacactctttgggatattatctgggagagcttccccaacctagcaagacaggccaacattcaaattcaggaaatacagagaacatcacaaagacactcctcaagaacagcaaccctaagacacataatcctcaaattcaccaaggctgaaatgaaagaaaaaatgttaagggcagccagagagaaaggttgggttacatataaagggaagcccatcagactaacagtggatctcttggcagaaacattacaagccagaagagagtgggggtcaatattcaacactcttaaagaaaagaattttcaaaccagaatttcatatccagctaaactaagcttcataagctaaggagaaataaaatcctttacagacaagcaaatgctaagagatttttgtcaccaccaggcatgtcttataagagctcctgaagaaagcactaaatatcaatatcagccggtgcaaaaacatatcaaattgcaaagaccatcaacactatgaagaaactgcatcaactcatgggcaaaataacaagctaacgtcataatgacaggatcaaattcacacataacaatattaaccttaaatgtaaatgggctaaatgccctaattaaaatatacagactggtgaatttgataaagagtcaagacccatcggtgtgctgtattcaggagacccatctcacgtgcaaagacacacatcggctcaaaataaagggatggaggaatatttaccaagcaaacgaaaagcaaaaaaagcaggagttgcaattctagtctctgataaaacagactttaaaccaacaaagatcaaaaaagacaaagaagggcattacataattgtaaaaggatcaatgcaacaagaagagctaacaatcctaaatatatatgcacccaatacaggagcagtcagattcatatagcaagttgttagagacctacaaagagacttaggctcccatacaataatagtgggagactttaacacccccctgttaatatcagatagatcaacgagacagaaaattaagaaggatattgaggacttgaactcagctctggaccaagcagacctaatagacatctacagaactctccaccgcaaatcttctcagcaccacattgcacttattctaaaattgaccacataattggaaataaagcactcctcagcaaatgcaaaagaaaggaaatcataacagtctctcagaccacagtgcaatcaaattagaactcaggattaagaaactcaatatctgctgttctgcagccaccgctgtaaaatctccttaagctgataagcaacttcagcaaagtctcaggatacaaaatcaatgtacaaaaatcacagcattcttatacaccaattacagacaaacagagaaccaaatcatgagtgaactcccattcacaattgcttcaaagagaataaaatacctaggaatccaacttacaagggacgtgaaggacctctttaaggagaactacaaaccactgctcaatgaaataaaagaggacacaaacaaatggaagaacattccatgctcatgggtaggaagagtcaatatcgtgaaaagggccatactgcccaggtaatttatagattcaatgccatccccatcaagctaccgatgactttcttcacagaattggaaaaaactactttaaagttcatatggaaccaaaaaagagcccgcatcaccaagtcaatcctaagccaaaagaacaaagctggaggcatcacgctacctgacttcaaactatactacaaggctacactaaccaaaacagcatggtactggtaccaaaacagagatatagaccaatggaacagaacagagccctcagaaataatgctgcatatctacaactatctgatctttgacaaacctgacaaaaacaagcaatggggaaaggattccctatttaataaatggtgctgggaaaactggctagccatgtgtagaaagccaaaaatggatcccttccttacaccttgtataaaaattcattcaagatggattaaagacttacatgttagacctaaaaccataaaaagcctagaagaaaacctagacaataccattcaggacataggcatgggcaaggacttcatgtctaaaacaccaaaagcaatggcaacaaaagccaaaattgacaaatgggatctaattaaactcaagagcttctgcatagcaaatgaaactaccatcagagtgaataggcaacctacagaatggaagaaaatttttgcaacctactcatctgacaaagggctaatattcagaatctacaatgaactcaaacaaatttacaagaaaaaaaacaaacaaccccatcaaaaagtgggcgaaagatatgaacagacgcttctcaaaagaagacatttatgcagccaaaaaacacatgaaaaagtgctcatcatcactggccatcagagaaatgcaaatcaaaaccacagtgagacaccatctcacaccagttagaatggcaatcattaaaaagtcaggaaacaacaggtgctggagaggatgtggagaaataggaacacttttacactgttggtgggactgtaaactagttcaaccattgtggaagtcggtgtggcgattcctcagggatctagaactagaaataccatttgacccagccatcccattactgggtatatacccaaaggattataaatcatgctgtaaagacacatgcacacgtatgtttacagtggcactattcacaatagcaaagacttggaaccaacctaaatgtccaacaacgatagactggattaagaaaatgtggcacatatacaccatggaatactattcagccataaaaaatgatgcgttcatgtcctttatagggacatggatgaacctggaaaccatcattctcagcaaactatcacaaggacaaaaaaacaaacaccacatgttctcactcataggtgggaattgaacaatgggaacacatggacacaggaaggggaatatcacactctggggactgtggtggggtggggggaggggggagggatagcattgggagatatacctaatgctagatgacgagttagtgggtgcagcgcaccagcatggcacatgtatacatatgtaacaaacctgcacgttgtgcacatgtaccctaaaacttaaagtataataataataaaataaaaaaagaaactcactcaaaactgcacaacgacatggaatgtgaacaaactgctcctgaatgactactgggtaaataaagagattaaggcagaaataaataagttctttgaaacatatgagaacaaagatacaatggactagaatctctgggacacagctaaagtagtgtttagagggaaatttatagcactaaatgcccacaggagaaagcaggaaagatctaaaatcgacaccctaacatcacaattaaaagaactagagaagcaagagcaaacaatttcaaaagctagcagaagacaagaaataactaagatcagaacagaactgaaggagatagagacacgaaaaactgttcaaaaaaaatcaatgaatctgggagctggttttatgaaaagattaataaaatagacatatgactagccagactaataaagaagaaaagagagaagaatcaaatagacacaataaaaaatgataaaggggatatcaccactgatcacacagaaataaaaactaccatcagagaatactataaacacctctacacaaataaactagaaaatctacaaaaatggataaattcctggacacctacaccctcccaagactaaaccaggaataaatcaaatccctgaatagaccaataacaagtctgaaattgaggcagtaattgatagcctactaaccaaaaaaaaaaaaaaaaaaaaaatcccagaaccagatggattcacagccaaattctaccagaggtacaaagaggagctggtacgattctttctgaaactattccaaacaatagaaaaagaaggactcctctctaactcattttatgaggccagcatcatcctgataccaacacctggcagagacacacacaaaaaagaaaattttagtccaatattcctgtgaacatcgattcaaaaattctcaataaaatactggcaaaccgaatccagcaccacatcaaaagccttatccactacaattaagttggcttcatccctgggaaacaagtctggttcaacatacacaaatcaataaatgtattccatcccataaacagaaccaatgacaaaaccacatgattacctcaacagatgcagaaaaggccttcgataaaagtcaacaccgcttcatgctaaaaactgtcaataaactaggtgttcacggaatatatgtcaaaataataagagctatttatgacaaacccacagccaatgtcataaagatgatcaaaagctggaagcattgcctttgaaaattggcacaggacaagtacgccctctcacaccactactattcaacatactattggaagttctggccaagggaatctggcaagaaagagaaataaagggtattcaaataggaagagagaaagtcaaattttctctgtttgcagacaacatgattgtatatttagaaaaccccgtcgtctcagtccaaaatttccttaagctgataaacaacttcagcaaagtctcaggatacaaaatcaatgtgtaaaaatcacaagcattcctatacaccaataatagacaaacagagagccaaatcatgcatgaactctcattcacactcgctacaaagagaataaaatacctaggaatacaacttataagggatgtaaaggacctctggaaagagaactacaaaccactgctcaaggaaataagaaaggacccaaacaaatggaaaaacattccatgatcatggatacaaataatcaatattgtgaaaatggcatattgcccaaagtaatttatagattcaatgttatccctatcaagctatcattgactttcttcacagaattagaaaaaactatttaaaatttcatatggaaccaaaaaagagcctgcatagccaagacaatcttaagcaaaaagaacaaagctggagggatcatgctacctgacttcaaactatactacaaggctacagtaaccaaaagagcacggtactgataccaaaacagatatacagaccaaaggaacagaacagaggcttcagaagtaatgccacacatctccaaccatctgatctttgacaaacctgacaaaaacaagcaatgggcaaagaattctctatttaataaatggtgttgggaaaactggctagccatatgcagaaaactgaaactgggtccctttcttacaccttatacaaaaattaactcaagatgtattaaagacttaaatgtaagacttaaaaccataaaaagcctagaagaaaacgtaggcaataacattcaggacataggcatagacagacttcatgactaaaacaccagaagcaatgtcaacaaaagccaaaatagaaaaatgagatctaattcaactaaagagcttctgcgcagcaaaagaaacaatcatcagagtgaacaggcaacctacagaaggggtgaaaatttttgcagtctatccatctgacaaagggccaatgtccagaatctacaagaaactaacaaatttctaagaaaaaaaaacaaacaaccccatcaaaaagtgggcaaaggatatgaacagataattctcaaaagaagacatttatgtggccatcaaacatatgaaaaaaaactcatcattactggtcattagacaaatgcaaatcaaaaccacaaggagataccatctcactccagttagaatggcgatcattaaaaagtcaggaaacaacagatgctggagaggatatggagagttaggaacccttttgcactgttgatgggagtgtaaattattttattactagttttttgagatggagtcttgctctgtcacccaggctggagtacagtggcatgatctcaactcattgcaacctccgtctcccaggttcaagcaattcccctgcctcagcctcccaagtagctggggttacaggcacgtgccaccacaccaggctaattttcatatttttagtacagacaaggtttcaacatgttggccaggctgatctcgaacccctgacctcaggtgatctgcccacctcggcctcccaaagtgctgggattacaggcatgagccactgtgcctggccgggagtgtaaatttgttcaaccattgtggaagacagtgtggtgattcctcaaggatctagaaccaaaaataccatttgacccagtaatcccattgctccatatatacccaaaggattatacatcattgtactatgaagacacatacagatgtatgtttattgcagcactattcacaatagcaaagacttgaaaccaacacaagtggccatcaatgatagactggataaagaacatgtggcacatataccccatggaatactatgcagccatataaaaggatgagttcatgtcctttgcaggcacatggatgaagctggaaaccatcattctcagcaaactaacacaggaacagaaaaccaaacactgcatgttctcactctaagtgggaggtgagcaatgagaacacattgacacagagaggggaacatcacacactggggcctgtcaggggtgggaggttaagggaggtatagcattaggagaaatacctaatgtagatgatgggttgatgggtgcagcaaaccaccatggcacatatatacctatgtaacgaacctgcatgttctgcacatgtatccaagaatttaaagtataatttaaaaagaaaatatatataatcaaattcattttcatagaatgtagggctccagttatacataaccattttgtccacttctgaaatgattagcaaaaaaaatcgcatgtatactcctcttaaaaaaaaagaaatggaagtgtgaatattactaaaaattctacagaaataaaaaggattaaaagagagtacaatgaataattttataccaacatactggatagcctagatgaaactgaccaactcctcaaaacacaaatcctacctaacctaaaacacaaagaaatttaaaaaaccctcagtagccctaaagatagcaaaaatatagaattagtaataaaaaatcattcagcaaaaaaagccctggacctgatagtttcatgggtgaattctgccaaatatttaaataagaattaacaccaatccttctcaagactttccaaaactctgaagaggagggatacttttttttttcttcagacagggtttcactcccactccccaggctggagtgcattagtgtgctcttggctcactacaacctgcacctcctgggatcaagtgatcctcctgcctcagcctcccaagtatctgagactgtaagtgcaagccaccatgctgggctaatttttgtatttttagtagagacaggtttttgacatgttgtccaggctggtctcaaactcctgacctcaactgacctgcctgcctcagccacccaaagtgctgggattacaggcatgaaccactgggcactttctaactgattctatgagagcagcattaccctgataccatagccatacaaagacactccaagaatagacctcacaccaatatccctgatgaatattgttgcaatattcaaaaacaaaattcagcagcatatcaaaaggattacataccatgaccaagtcaaatttattcatagaatgtactgaaggttcagcatatgtaagccaatcaatgtgggggtgggggttggaggaaaggtgggggtggttaacgggtacaaaacaatagttagaaagaatgaataagacctagtattaggtagcacaacagggtaactatagtcaataacaatttaattgtaaatttcaagtaatgaaaaaaatataactggattgtttataacacaaaaatgcttgaggggatggatacccattttacatgatgtaattagtacacattacatgcttgtattgaagcatttcatgtaccccacaaatatatacacctgttatatacccacaaaaattaaaattaaagttttaaacaataaaaagtaagtctatcaatgtaacataccatattaacagaataaaagtaaacaacctcacatggacatctcaattggtgcataaaaagcatttgacaaatttcagtaaaactcatggattgatgatagaaaatactcaacaaactagtaaaaaagggaaactacctcaatataataaaagctaaatatgaaaaacccacagtgaacatcacgttcaatggagaaagactggaagcttttcctataagttcagggacaaggcaagaatgcctcttttgccacttatattcaacatagtactggaagtcccagccagaggaattaggttagaaaaacaaagaaaagacattcaaaattgaaaaaaaaaaaagtaagtttatctctgtttacagataatataatcttaaatgtataaaatgagtattttgcaaaaacctattagaactaataaatgaattcagcaaaagtatgtatagtaggaacaaaaacaacacacaaaaattacttgcagttatatacattaaccatgaacaatccaaaaaaatgaaggcaacaattccatttataataccattaaaatacttaaaggtaaacctaacacagatgaggaagacgatgaaaatgcaaagcacactaaagaaattaaagaagacataaataaatgtcaagaaatcttacgctcatgaattgagagactaatgttgttaagatggcaatactattcaaagtgatctagagatttaatctaattcctatcaaaatccaaataacattttttgcagaaagagaaaataactttttgaagttcatatgagagctcaaggaactctgactagctaaaacaatttgataaaggagaacaaagcttgagggctcatacttcctgatttcaaaagttactctaaagctatagtactatagtaaccaaaacatttagtgattcgagaaaaaaaaaaaacacttgcatgtatggtcacatgattttcaacaagagtgtcaagatcatttcataggaatacagcagtcttttcaacaaatagtgctgggaaagctgattatttcaattcaagagattgaagttggactcttactgtcttagtcagtttgagctgctccaacaaaatgccacaaactgggtggcttatagacaacataaatttacttctcattttactggaggctggaagtctgagatcaaattgctagcatggtcggcttctggtgagggccctctttcaggttgcaggctgcaaagttattatatccacacatgataacaagagaaattgttagatccttgcttgtgtgcttcttaataaagacactaattcatgaggcctccactggcatggcctaattacttctaaaaggcctctcttctaaatattctcacattgggtttagggtttcaacatgtaaattttgaggggacaaaaacttgtggttctttgtaattacctaacaccatatacaaatattaactcaaaatacattcatgaactaaatataagaccttaaactataaaaatctttaaaaaacataggccaaaatcttcattacattagatttggcaatgtggtttattgtatatgacaccaaacatacaggcaataatgacaacaaaaaaagtagacaaattggccttcatgaaatgcttttttaaatgtgcatcaaaatatactagctaaagagtaaacaaacaatcctctgaatgggagaaactatttactaattacatatctgataaaagattaatatccagaatacagagaaaactctaaaacacaaccacaaaaacaacaactgagtgcaaaaatgggcaaaaagctcgaatagacatttctctaaaagagattcacatatggccaaaaagcaaatgaaaagatgttcagcattactaatcattaggaaatgctaatcagaactacaataagatatcactttaaactcattaggatggctactataaacacaataaaataaaaagttttgacaagtatttggagaaatgggaatccttgtgcagtattggttggaatgtaaaatagtacagcttctgtgggaaacagtgtggaatttcctcaaaaaattaaaactagaattaccatatgatctaataattccacttctgggtatataccccaaataattgaatatagggtctaaaaaagatatttgagatgtttctacatttatgttcataacgcccttattcaccatagctaaaatgtggaggcaaccgaagtatcaattgatagatgacaagcaaaattgtacacacacacaaacgtgcacatgtgagcacacatgtatgcacacacacacacacgtcccagcacttgagcaatggacttcagccttatttcatagcaatcaatgttgagtattgcctaatttgtgccagggagatcaggtccaaaattatacactagagtttctcagcccacatcactttctctacaattcctaagtaattatttgagagaaaattacagtacacattaaataaagtaatttatttcatagacaaatctcagactaagcattattgagatagcaatttttaaaaaggtaattgtggaattaggaatacattttttataaatcagtaattattttacttagaacatataaaatgacttttaaaggaggaccttttttaaaaaaaggttataaagagttttactggatcaaatgaaagtttcaagttttattagcaaagaataaaaaggctaattagaattggttttataggtctatatgctcattttcaataggggcttataatgaattttgaggggacatctgatttggctggattctcattaacacatttatgcaacactgagttaagactggactaagagaaaactggtgcttattctttctacttctttcacatgataccaactctcagtttgtcatcaagagtttgcatctcctcagtttcaccagctgatttctgaagagtttaaccacctttacaattctatagttatgagattttgaaggtctgtctgttgaaagctacaactgtcttaatattagtaacagcaatagatatttgttgagctctttaaaattgctatcattagtgctaagtgttttatatagtttgtcacattcgattattttcccccagctttattgaggtataattgataagtaagaatgtatttaagatgtatagcatggtgttttgatatatgcatacactgtaaaattattaccacgatcaagctaattaacacatctaccacctcaaagagttacattgtatatatgtgtgtgggaggataagaatacttaagatttcctaaagtatgcaatacattattactaactatagtctcttgatgccatatttcagataggaaggaactaaggcttagaaggattttttttttttttttagtcatctagctagtgtcagtgtctcaaaatagatctgagtgtaactacaaaagaaagggtatagactacttcattgctgactggtgggaggtagctagaaaaagaagggtggacaacacattaatgggcccagtggtttccatttttcgaggctttaaatgagtgatggatgctagctcgtgcataattaattattagataatgtggtgcatatcattaaaagaaaaatgccaactataatttatggacaaaagataatattgctcaagagacagttgcaatcacttaagtatctgagctgacataagttagttttggtcctctgagaagcagatgccaacatggggtgagttttgtaagggatttattggaggaaacacccgagaaagataaaaagagacaatgggagtaggtgaagagaaccttcaaaccacaatgaagatctgacacctgtgaaaggagagacagaaggaaggaagactgggtagaaatagcttcaaaatgtagcatgatttttaaagtcaccaactagccagactcctatgataacaaaagaaatggtgactctaactaaaggtgcctaagagtctattggcagtggtttgagattgactgaaatgtttagggtcattcagaaaagagataatctctctattcaccaccacacctctcctctgtttcagacctgtattccagtcgagaaaagaggacagggaaaataatcaggatattttattatataaaaatgtattgatgaattgatcatcaaagggtcactggactctatgaaagttagttattgctgggagaactttaggcattagggtttcttgagtattgtttctgacttcaacttctcacagacccatctccaccataatcaatcctaagtcactcccatgaggccagggatctgtcctcaatgcctcagatgtgcttcccacatttgtgccttaatagaaatgatatatctatgtcctgagtatggagagagttaactaaaatgcttacgtgaagtgcttcaaggcttcttttactgaagatacaagagccaaatgcaatataatcaccacaaatacacttgaaaaacccgccaaattattcatttatatatctctcctagatagtggatgcttccaattctacagtgatcaccaaaaagggcattaagataagcaatttagcattcaaatatttaaagaaaaatttaaatttatctttatactactagaacattagatgttgaaatacacataaacttgcactgtatctcactgcaccttgatttgcactgtatctcatttgttgtaaatttcaaatagaaaaaaatgtgtctttatagtagaatgatttataatcctttgggtatatacccagtaattggattgctgggtcccattatttatttacatttatttatagtagaataaatcatcctactataaagacacatgcacacgtatgtttattgcagcactgttcacaatagcaaagatttggaaccaatccaaatgcccgtcaatgacagactggataaacaaaatgtggcacacccacacgatgtaatactttgcagccataaaaaaggatgagttcatgtcctttgcaggcacatggatgaagctggaaaccatcattctcagcaaactaccacaggaacagaaaaccaaacactgcatattctcactcataagtgggagttgaacaatgaggacacatggacacagggaggggaacatcacacactagggcctttcagggggtggagggctaggggagggatagcattaggagaaatacctaatgtagatgatgggttgatgggtgcagcaaacaagcatggcatgtgtatacctatgtaacaaacctgcacgttccgcacgtgtatcccaaaacttaaattacaatttaaaaaaaaaagaataaaaagtggaatgtgctcaagagtaaacactccataatcaatagctattattggaaagcagtaaagtgtgctgactacaatggctggttttgactcagaccatctggatacaaattcgcagtgggacacattaatttcaccaccttggcaaagttatttaatatcactgcactcctattttctcatctataaaatgggataatgacataaactttctcatgttgttaaagaaattaagtaagataatatatgtaaaaaacctagatgagtgtcaggcgtgtattaatcatttagtaaatgccagataaaattatcattattactataatttctgccataaagataaaaatgcattttgcttaccagtaaatatcagcttggaaactatagactttgaaaaactgagatctttcagttaaaatgtcataaaggaaaagacaaaaattattactacagagaaaatgtctctcttctaaataaaagtcacaagaccctcttaagctatttccgatattgttattgacaatctgacctccaaataccaaacagagttttcttaatgtgcaacccaattgttctctctggagccttactttgaggcagaagcagtcaccccaaagtttcagggtgggaggacaacctggttatggcttcacatgtatctattggatttgcaatttttaaatataaaagtttctaaattattaactttccccaaagtgataattgatggcaaaagtcatttctgcatgaagtattaagtgatttttatgaaaaaagcaaagtaatttgacagagcataataattacactgtcaaagaatataagtttctattttctcagagaagtctatattacatggtttcagtttcacaggctgtcatcaagacagcaagatttatttctcctttaattgcactacggcagttttttttatggaaaatgtgtatgccatgactgcttctcagaaggttgaagaactaactcatggcttctcagaatggtgtagaacccatggcatcacttacatattcactcatgtgcacaattaagagactggcttgcatccagtggatttggaaaagaacaggcatgaaagccctctggtgttggtcaaatatggtaagatatataaggatgatgatctagtaataatgggaaggccagaagtactatttttcatgagtgttttcccctgaattgaagctcaaagcaactttccaccaaagaaagtgagttttatggttatttcaagtttgtaatctccccttttaacctcagaaatttcacacataaattatatagagggagaaaacaatccagagctgaggataaggggataaagttaacattggcattcatccttggagcagaagcttatgtcattgtatgccaatttaatttgtctgcatttatttcaactccaaatctattcaatgtcatgcattgagagggattcagaagttatgaggttgatgtcttgttttgtgctaggccctaagagcagtaagcagtcatcctatgtctcatttttcagaagccttgtatatgcattggagaattaaaacttgggtttataaaagtattttataattggtttaatttttttaagtgtggtcatattccagataattacagatatttattttgctttagatgtttggtaaagttggggagtatttgttgagtttagatcttgaagggcaaataagtgagagagagaaagagagagcaagtggtggagactcaagccccttccatcttatgcctctaccatttgttgtctttaaagaagtgtcgaatacaccatccaatggagaaaaagagtggaggatatgcatgatgtgtgggatggcttcatgggctaaagtggaagtggcatgaactatttcctcccatactgtgtggaagtgtggagagactgggaaatatatctttgtgcctagcagtgacagtaaattgtctggtgaagtctctaccacttactctataccccaaactagtaactgaatccttcctggtttatttaatgaaagattatactctagtactagtagccagtacctgaaaaccgggaactgattactaaaagagaaggatccactggctctctggctaacaagccctagtcctgggaccaattgccagacaccctcttgctgcctaccttcttggaccccaagtacttgccccactctgggagtcctgactctggatcaggtgacagtctattctcagtgacaagctttattgcaattcccacctcctatgtaaccaccatagctcttatgcattgttgctgtttgctgacttattttaactacaaaggccattaagcatttactctcctatgttcagcaatccttgtgaaaacatccccagtgatgcattagttaacagtctgtcaacactccataataattttgatttatcactcagctataaaatttttcaaaaggcaaagctcgcctacattgcctgagctctgaagcagttttatttgtactcactttctaaataaaacttggggaactcaaagggtggatgagcaagactggcaactcaaaagaaaaagtgtgagaaagaaataggcaagcctaacgagagaaatgagagctttccacaaaggcacggggagttaccaaaggtggagggaaaaggagagagagcacatggaagagactgactgtaagcagaataccaaatgaagagccaagaaagaatcaacaatgagagatcccattgccttctttttggtatgtatcaaatctccctctgccttattcatataaggatacacttaattcaacttagaacccccctggatatttcaggagtatcttcacagatcaagatccttaaccatatctaaaatgtccttttcaccatataactgcccagaattagccaaaccataaggtctgaaagtataagcctcatagaatgacaccaactacaagtttggggtggggagctccaaaagttgaaactttcagtttcaacaattggctagaaagacttacataatttattgaaggctattatactcacacttttggattactacagggaaaggataccattaaaatcagccaaaggaaaagacacacagggcagagtctggcaagtttccaaataggaagtttctattgtcctcaggacacaataccatcctgacattgatgggtaataatatgcatggagtattgtcaactaggcaagctcacacaagttttgatgtccagaattttggtgtccagtattttggtattcacagatacccaagctttggtgtcattacataggtatgattgattgaatgagtgagtgattgcccatagggttaaactcagtcttcagatcatttgatatcatgacccgaagtccccatctttagtcacatgactggaatttcttgcatggtctgcctctaatttttgactgtcaggtatggacggttctaccctaagatctgctgtggcccagcttctgccgtgaaaaaagatactcctagcaggtatgaaatagattatctcccaaaagccaaaggcagaggccgaactttcctctaggcaaagtcaaactctttcctctacagtaatactcacagtttttagggaataagacacatctatcttggaggggacataatttagtctaccatataaagttttattaattcatcaaattcttattggttgcctgttatacactaggctctatacccagggctggagatagaaacctagatggagagatctcagtaggagctaagagattagtcaagagttcatggtgttttggatatataacaagaaggaaatttaaggtttctttctaagtttctgacttcaaaaaaacagatagtgaagctgaagagggaccaatttgaggagaaagttcatgtattcattcctgaataaattaagtttacagttcctttgagatttctatatactaatttctgtgtgacaactgagagaatcccaaactcagtagggttgactaggtcaacctgtttcttaataacgtgttgcttttcccatccaaatacaccctttcttgcctttattgtgtgttcttcaataatgtagatgaattctgtaatcatttgccagttagattcatgtgtttgtcattagagggctctggatgaaaactggaggaggaaagagttttttcccctagcttgagcatcctctctcaagtacctacagtggatcactcttgcagtgccattctgcaaaacaagggggtcagcaatatccccagtagcttcctctggtaggctactaagcaactttgaaattacttctgaatgaagccatctgcctcagactatttccctggcacctcagaggacagatttctaccagggttctcagcaagtgtctctggtgctgcatctcagaaaaccacttctgcattgtaagccacagctgagacttctccagcaagatctagatctcagtcttgggggaaaaatactgttgataggttaagtaagagaaagggtaaaaatatttatttcatttagttacagagagatcatgaataattttaaagagagctcttcggtagagaagtggacaggagccaaattggagccaactgaggaggaagggacaggagataaagtcaagaaaatgccataaatcagtttgactataaaaggagggaagagaaggtaaagagctgaatggctttcccaccacataatgcagctttacttttggctttgcaaatctaagatttttacctctaagattccctattctatagaatctttcaaggtcagatcttaagatggcaccaaggcagccgtggggcacacctcaggccatccacactgtttctgaggtgcaaatgaaattactactagaggcaactcatcacagaaagtgagcacccagcaatcccttagatcccaatcagaaaactctcagaagggttccagggataggaagataacaacctgacaatccagaagggtcttattttcattaatgaaagtgcagctttggggaacatctcagtataaacgaatgatatttctgttaaagtagttagcatccaaaagtaataaatgtactgttttatgtggcaagcaatagtgacagttctattttccaagataatcactctcattaactgaagctgattacttccttagcattaactcacttaatcctctgacttgaggcaacaccacctatatatacatatacattccttttgatcttcaaaccatttctctatgctttgtttgttttggtagagtgagttttataatggttaaatgtggcaaactgtcacttgccactttctcatgacagcaatttagcatctaatgtccagaaattgcaagcacaaggaaatacagaggcttgctagctgattatggacacacacaggagtgacttcagaaagaggcaaaatgcagttcaggatagggcgctgtgttgaagaaatatgacccaagtgtgtgggggaaggaaatacaaggcaggaactttaaaagcagattattgatggaaattgatgacacggaagaggagcagctgatatttttatgtgttaggctggtgcaaaagtaattgtttttttgtattacttttgctcggcagtgcaaagaaaaccagcacttaggcaaaaaattcctcagcaaggcaaatttacttctggagaagggtgctgcctgcgtcagtcatgatcacaagagcactcccagcgggatggggcaggggtttttatttgtaacgcaattggttcttactgctgtgtcttttccccattgactggggttggactgcacaatctaagctaacctgattggctaaggtttaaaattgaatagggtcaattaggtgggaaggtagaggctgcccgttactgggcgggaaggcatgtctggacttgtctgggcacagcaaaggcgagaagtgttgtttaacaggtagttaggagacaaggaagtacaaagaagttggtcttgaaaaacaaagaacaggaaactaaagctttttgaagaggaatttatcatctgtgatactttcaatggtaaaaaccacagttacttttgcaccaagctagtaatagtagcagtgctatggtttgaatgtgtcttcttcaaaactcaagggttgctaatgtgataatattaagaggtgaagcatttaaggggtgattgggtcatgaggacacaagaatgggattacaaaagaggcttcacgcagcattcagtgcacttacctttccaccttctgtcatgtgaggacccagcgttccttcccattggagaatgcagcaacaaggtgccgccttggaagcagagagcagctctcaccaagcaactgaatatctttgtgttgctcttcccagtctccagaactgtgagaaaatattcaagttctttataaattatccagtctgtggcattatgccacagcagcacaaaatggacaagtaataatagcaataattatcataatgttgttattagccctctttcatcaagtaccatgtattgtggtgtcacacattgtgccaagggctttgcaagatgatctcttatctaagcacgtagagaacccatcaaatccacagagcacactctatatactaggcaaattatttaactttccacaccctcagtttgcaaatatttaaaatgtaactaaggtcacaaatctggttcatattggcagacatagattttaaatgtaaatccaacaggcttttaagagaaactgttagccgtcttgtacgatttggactattaataatggcatccgtgagctctcttcatatgatcataataaatgaactgtgtgcctcagatccagaaaaattaagcaactttctgcaagttttcccacttgtagaatgaaaaggttggaccaggtgatttctttggttctctttagacttaacattttacctttctccttactgcaagctttcgtagagaggcctcttggttttcttctgctaccatcaggcaaagcaaaccccaaatagcccttctcagctgtagaccataatgaatacgtgaaaggatgaatggcaacatcattgctttcagccctgtgtcacaggaatagaggaatgtgtgagatatagactgagaaccaacctttctctgacacccctaaattctaggggttctgtctaacgagagaattcttaggctttggaagggatgcacggatatcaaacagtatcagtcacctaaatgctcttgctacaacaatttcttgttttccaccttgatttcccaatatcaaatgaatcagagtccagaataccctgtattattcccagggattatcaaatgacaatgtgaaaagggggagtgttagcaggtccctctacccttcctctctgtgatcatggtctctcaaaaaggtgatgtaaactggaggcagtagtggattttgatgggctctacaatttattttcatctatcaaccactgccaaggtgggaaccctactatttcccagggaaacagtgattgcagaaatactgactggcagagtgaggtggaactatgagaatctgatagcactgatttatttacagtgttctgtgactaggccagggaaaaagtaacctgagaaattttcaaacatacatacttggatttacatatttacagaacactttatactcttttgcatttttcacccagtgaggccaatcttaatctgatgccaatcttatcgccatctaggttgtcctgttagtgctgtttaacatctttaacaaattaggaccgtatctaatttgttatattactgtgtcattaaaatatgacagtggtttggagtcttaggtgatctctatccttctctgactatgaccctaatgctgcttggttttctttcgaatgtgtggagataaaatttacttttgagataaaaacgaacagatgttcacttttcattatatttgagagtcactaaccaaaattttcctcactgtccttgtacttttgttttaatatttgctttctttttttcggctgtttatttggtttttacaagcctcttttctacttttaaagtttgctaatttcaaaaatctatttgtacaattcttgaattttattttcctcctacttaactgctcaatcatacaggcagtatatatattgttggtgaaataaaaggaaggatttagaaacagggaatactatactttgcagcaaaaacataatagatcttttcctctatcataaatgtatgttaaaatatttaaatataaagtcaaagtttttcttctataagtagaagcccaacttgtccagctttgccttttttcattctatttcaatagatggtttgagattatatgaaaatatccagacttgctttcattcttgtttttctcacagaagaaaaaatacagtgcaatttgacaaaggtgaggttggaatttggcagatattgagccagattctcagttgtctatttggtttagttcatcaattttgtacaaatattaatataaagctacatcttcttcctacagagtcatggacctcaggtaggccacggagaagctgacagcccggtgtgccccttcttatcaactgcctgtttgtacactgtgcctggaattgctcattctgggagagactgctgtgtattggagcaggagtcctcccacaatggcaggttgtttcattttccctctttttctgctttgttcctgccatttaaaggatttttgtttgttttttccattgcaacatttgtggtgagcttttgattaggctgaaggctaacacagctaacgctaacaatttaaatgggataactctcagggaacctgtatagctctgtccttctccccttcctccccctcaccatcaataccaacaacagccactttgcaaaccacatgcaccttgcaaaccttttacagaagcagattcttccctgactaggagctgaaaatatatggaaggtgagtgtgtatttagactttgggctagtgacaacaattttactttcctacaaaagggaattcgtgatttcataagcaaggtcgttcgtttacttacagtccaagatcttggaatttctgacaagtcaactgtgaatggaataattcttccccatctgttccttttcggagacaaattgaccctgaaagcatggtgattgaagctctttaacttctctgcgatggggtcttaacagacaatgatctgtaaaaagagggggtgatggtgatatttattttgatgattgctaactagctcctgctttgcggtctttcattcgattgcatgtctgtcatctcttctaaatctcaccagcactccatagtgcagtcaggcctgccttagaggatttgttaaaagttcagaggcattaattgcccaaagtttcaccagatggtactcccctgtcaattaggtgtgatgttcctgatatatctgatattatctttattgaacaaaaaatagttggcttgaactattgacaaaacctatacttccacccaggcttgaggtcactgactagaaagtctagatgaaggatgagaactctagctgcatttttttttttagacggagtttcgctcttgtcacccagtctggagtgcaatggcgcgatctaggctaactgcaattagttgcataattgtaaaagctggtatgagatattccaactttgagctcaaaatccatttagaacatctgccatgtgaaatcccacctgtagttttggccataagctatttttattgttaattatgactttaggtttacactgaattattttatgttgatgtgctacagttgcaggactttttcttagttcagctaaagatggggttctttgtcccatggccacgaaaattcaggctggcagacaatttttatggtgagtaagacagggttttattgggtgaaaaggaagaaaagggggaaacaaggacaccccacaaggccagaggccctgttagcgtgcttcccacccaggtatctcaggttccacacaggaagaataggggccaggttcctctctgctgccaatgggcaaactccccaaggctccaccccagtgcgcaggctggctggagtttttctggggaccccttcacacctgactctctcactactatttcctaataatgggaggctgggcatggtggctcatgcctgtaattccagcactttgggaggccgaggtgggcagatcacctgaggttgggagtttgataccagcctgaccaacatggagaaaccctgtctctattaaaaatacaaaattagctgggcatggtggcacatgcctgtagtcccagctactggggaggctgaggcaggagaatcgcttgaaccgggaggcagaggttgcagcaggctgagatcatgctattgcactccagtctgagcaacaagagcaaaacgccgtctcaataaataaataaataaatacataaataaataaataaataaataaataaagggagactactggcctggcactaaaatgttcaggacgttttaagtattgaaataatgctaaggcagggcacgatggctcatgcctgtgattctagcattttgggaggccaaggcaggtagatcaccagaggtcaggagttccagaccagcctggccaacatggtgaaacaccatctctactaataatacaaaaattagccagccatggtggtacacgcctgcagtcccagctgcttaggaggctgaggcacgagaattgcttgaacccagcaggcagaggttgcagtgagctgagatcatgccactgcactccctcctgggcaacagagtgagacttggtctcaaaaataaataataacaacaaaatgaaatgaaataaaataaaataatgctaaaatgaagaaaaatagtagtaataataattcccagccccttctgagtgtttactaggtgtcaagagctttaaaatctttcaacagccctgagaagcagactctactagcatccccctcattttatagaggaaaacactgaggcttagagtttaagttacctaagatttaaggctttgagacattaaaatagtaaattactcaagactacctgttgatgggtgatggaatcacaatttaatataggcattttgactccagtgacagcagggttcatcactccactaggctagttctctaggctttatacccagaagaccagcggaaacatacttaagaatagtacaaagagcatgtggagattcacacatctgtgtgtgagcatgtgtgtaagtgtgtaagaaactatcctcagagtgtgtggctgagactatgcaacagtgacccatctttgcttccctattgtgcttgcagatctacgacaaattcatctggattttcagcagatttggtggtctttggaggaatttctctgagcttagcctagctttctgtcccaaacacaacattttcagttctgcatgttaggtttcatgtgacatgtttgtgctactaaaataaactccctcttaaatatgaatccaaatttcttgccaatatattttagtataatatggaattaatgacatttctaatttgctcatcagtatactttagaatgatgtggaatcagtaatagataatatatcatatatatgtgcatatatatatatatctaaacattaatctatttatctgtctatacatatactgtgtatatatatacacgcacacacacacatatatatatatatatatacacacacacatatatatgtacataaagtgttatttgggaggacagtatacaaaaatgctattgaaagccatctgcgctgtgaaagccaatgtgtgtgtgtagctatgtgtgtagtcatcttctaagatataaggtgttttaagactatatgttatgaaaaagacttttttctcaaaaatgatcttaatttggaaaacaggatggtaaaagtaactttaacatattattagacatgaaaatttaattaagacattagttctctacctaatgttttgtgtgtatgtatatctatcttagcatatttatggcataagttacagctaaggacaaaggatgaaaaatgctaaattaccctctctttgttcctcatttgccaagcaaatgaatgaaaatgtatatctctgtcatttggcttaagaatcccccctaagaatttaaccaaataaatgattttaaaactgtgtagaaatacaaatatatgaatattcagaagagcattgtgttgataacattaaaaaactaaaaacatcattttgatggttgattttatgtgtcaacctgactgagctaaggtatgttcagagagctggcaaaacattacttctgggtgtatctgtgatggcttttctggcagagattaacatttgaattgatagactgagtgaagaaggttgtcttcaacaatgctggtaggcatcatccaatcacttgaaggcctaaataggacaaaaagtggataaggggttaatttggtctttgcttgagctgggacaccatttcctttttcactcagacatcaatgaccctggttctcagttctttgaacaaagaccagaacttactccagtatccctgccaattctcaggcctttagacttggaatgaattataccatcagctttcctggtgtttcagcttacagagtgggagctctcagcctctgcaattgcatgaaccaattcctattatatatatgtagatgaacagatagcattttaggctgttcttgcattgcaataaggaaatatctgagactagataatttataaggaaaagaggtttaattggctcatgtgtctgcaggctgtacaggaagcatggctctgccatctgctcagcctctggtgaggcctcaggaagcttataatcatggcagaaggaaaagggggagcaagcatttcacatcgtgagagagggagcaaaagaagcaagagaatcagggggaggtgccacacagttttaaacaagcagatctcacaagcactcactcactattgtgaagacagcacccagccatgagggatctatcctcatgacccaaacatctctcatcaggccccacatccaacactggggattgtgtcccaacaggagaattggaggagacatccaaaatgtatcagagagatggatagatctaagattggctaagaatcaatacattgatttaatttaatacaacctagctttcaacatatcatgacagaatgaatttaagaatatagaaacatgaataatgcagaagcatgtcaatgttaaactcttaagtttaaaaaataagttaataatcgcagcactttgtggggccaaggtggatggatcacgaggtccggagatctagaccatcctggctaacatggtgaaaccctgtctctactaaaaatacaaaaaattagctgcacgtggtggtcggcgcctgtagtcccagctacttgggaggctgaggcaggagaatggcgtgaacccgggaggcagagcttgcagtgagccgagatcacaccactgcactccagcctgggtgacagagcaagactccatctcaaaaacaaacaaaaaagttaatgaagattacaacatgaacttgtttttgaacagagtatataaaaactgataggaaaaatgtgtggaagcgcatatagaaacatgtttagatacttctttttagagagtttataaatgatttcattttttcttcatagtgatattaatgttcatatttttaatcaattcatagaaaaatggctttatactttcatgagggttggctgtgcccttatgtaaactttagttgtcttctgatttgcatgttgcttgaataagttactatacgattgtcaaaaaatatataaaatacttaggatttcatgattcttatattttaaaactgaatgaaaattagagaaattaatatgtcttttagaataaaatatgtggtttgctgcagaattcctgtacttcctaattgtccttccatgactggaatacaaacccacccatgggcttaccacagttggagagatataaatggattgttctcttgaagggagcttcagaccaaccttcctcctcattctagtcttcaagcctctctcctgcctctgaacaaagcctttcgggctcgtgatgtgctgtcccaattgcagaaatagttccactatcaacctgctacatcataaaattcagcctgatcacatggagaaaatgtgaccttctgagtaatttgtcactctgaataaagtatctccttattagagaagagactgtctgtcctcagggcactttggaacagtcaattgctaactctatttagacgtttttcctcattgcaaggtgaataaaggtagaaaccttgctgtgagtcatgatccagctcatgccatctggttaatctaagactctaaataagatgtcaccatcatttgcctagagaatgtcattggcccagagaatatctcattctgtagagtctgagatattacattacggctacctttgttttttaccctaaacattctctctagccttctctctcataatgcttctacatttaatctgagagagcaatgtttacactaaaagagggtctcatgcactataggaggtaatggtggcatgtatattgaagggggcatattctcaggccagcctcctgccatgatggtaaagatgggacatgaagagagggtatggccattgcccaagactccagctgaacagactcggctgcactagggctggctgccaactaggtcctctgtacagttccaggtgtccatgcagggaaaaagtccagccccacatttgggccttaagcaaaagactatagcgtcaaaaggccatgatccaggccagttgttcactctggaaattctgaggtatggcagcagagaagaatccagtcccagcagtttggacaagtgtaagcagacacacatttgacatcataaaaatttacaggctaggtagttagaccatggccctaagagaggttgcaaagataagattccagagcttggagagaaatctaaagaaaaattgacagggcctcagttttatagggattgggataataaacaggttaagagaacctagggatatggcttaagtgctgtggtttgaatgagacctcaggacaatgctggctcacaagcaagcgtaggaatactgaggccttctgtgcaaggttggtctaggagatgaagaccgatgatcctgcaggtgaccatagggtaaagagatcaaggctgggcgcggtggctcatccctgtaatcccagcactttgggaggctgaggcgggtggatcacgaggtcaggagttcgagaccagcctgaccaacatggtgaaacaccatctctactaaaaattctctattaaaaatacaaaaattagccaggcatggtgttgtgcccctgtaatcccagctacttggaaagctgaagcaggagaaccacttgaacccgggaggtggaggttgcaatgagccaagatcacgccactacactccagcctgggtgacagagtgagactccgtcttaaaaaaaaaaaaagaaaagaaaaaatcaagtgagcagctctagtgttgctttcagatgaaagccccacaggaaaacttgccttctttctgaagagctgtgcccctggatcacatttcagcagtgaggagagaaaatgcttctataaagcttccttagtgataccaacaagcaagtgtcagcctgtccttgtcacagcattggggaaaatccctgactcacagaaataactttgttttgtggtctgcgctaaggtaacaaggaagagagaccctggtttaacctaaagtctctatcctcatggtctggtctctctggtattcttgctgcacctcatgggaagagaacaaagaataaatgagtcctagaaatagaatcataatctttctagcctgttcatggcatattaattttactgtttaatagtaatttttccagctagaatataagccctgtgagagtagggatggggccagtcttattcactgatgtgtccctggagtctgatgggttcctgggtgagtttgagtagtcataggagggagtgatttcaggaagctgtaagagattttgtttttatgttagacttaccagactggcatatggctgctggatctggctactgcaggagagaagacagatactagaggcctaaaatgcagtgtgagctcatcaaggaaggagagagaccaaaatggaaaagtgagtgggacataggaagcagaattgaagcctgagagaaagaagactatatagagccagacaccccagagtgaggccagtctccagagaggcctgagatggggatgggcttggaggaagaaaatttcaagtgttctcttagtaaaaggagctttctccaataaagtgagcccttccagaaatccaatttctcatctcatctcatctcatctcatctcatctcatctcatctcatctcatctcatctcatctcatctcatctcatcatatggtgatgttgttgatggtaggtacccgaccctgtctcagagtaagaatgctggttatcaggagctcaactgaggtgatatttgaatgatcagttaaagcaacaagacaaaagcaaaagtaattgccaaggactgaatcacttactgcagcagtataatcaagaggtcaaactagagtggagtcaaagtattgacttccctctttccatttcctgtcatggtacagcacacctatagcagggtgtcactgcctagtgagtcctgaatgcaaagctcacacagtttattggccctgggacctggcagagagagaggggccaccaccaaagtgggaaaaggataggaatggattctccccagagcctccagaaggggctgtcaatagatggataactcggtttttgatcagatgaaactgattttggatttctggcctccagaattgtgatggaatacatttctgttattcaagccaccaaacatgtggtaatttgttacagcattcataagaaaataatacaccctctgccaccagcaccattgtccatgctaccatggtctaaaaatggttcctagtaaagtttcaagagtctccgaacttgtgtccctaatccacattatcacccaaaccaaccaatttcctacattacaggtaaaaaggacattacatctaaaagtgatctcatgatctctgatcgtgtcatccactttccctagcttctaccacttcttcaaaggtttctcattgttcctaaaatagaaaacaatttttatgacagttacataatttgcaggcaccttcatggtctaactactggctacctctccagctttatcttacactcctctttctcttttttactcaagcaaaccagccacactcatctgccttttgccttgtgcactccttacatttcctgcttcatcatctcttctccctcctacccaaccacatttaactccaaatcatccttgatgttacagctcatctttctgtaattcttctgtcatactcctacctcccaaagtcaaaacaatctattttatggtctcctaacataatatacctctgaagttatacttttaattagcatatgtgtgtgtgtgtgcttgtgtgaatgtgtgtctgtctgcctgtctcctctcagagtaccagctttcagaatataaaccccatgatggcaaaaataatttatgattattctctccattatatcctctaacctatcatagttgatgctcagtccattgaataatttgaatgcacataaattaggagactgctgccccaatcatggcagtaccactgactagggtgcttccattaaataaatttctgtcttttgttattaaaatttatgtgtacacatgcaaatctcacccactagggaacctaaccatttgggaataaatcatttaaagggagttctcagtctctggaagtttgaatagagagaattgtacatattgcttttgttcccatattccagattaaataattgagaatgagagaaggcagaggttctattcagcattacccgctagtgggtctggtttcaaactcagctttgtatacactaaaaccacaacatttccttaaattcttcctgctaactccatatatatatatatatatatatatatacacatatattttaggtgtctctgtgtgtgtgtgtgtgtgtattcagatacacagagacagtagactatatactgggagtgtgtatatatgtatgtatacatacaaacacatacacagataataagatgatatatatgtatatgaatataaatatatctatatatgtgtatatctatacatatatgtatagatattatgcacatatatttttatatacatatataaatatatgtatataaatctatacatagattatgtgtgtgtatatatatgtgtgtgtatttatgcataagtgtgtgtttttatatatgtatgtgtgtgagtgtatagtctctcaaatagactataatatactctttgggcaaaggggcaatgttttataattccatgttaagtctaactgaagccctagaccagtggtctaatgcttggagaatggatcaggtatacagctggtgatcaaggcagccagatccaaaactcctgacatcaggagagtcagacactatagggcagagattatttgctcactgatgggtggagaggttaactggatcactaagttcctgtattttctttgtttcccacaacccagtatgcagcacctctaaataaatatggcattaagttagattggacagttttgcaataaagtttttaaaaattgaagatctgcttttaattccagtcttaattaaagccaaactttccttagaaactcaggaggagagatttgctctcagctcattcccttccattcttaatagacagaagaagaaagaccttcagatgcataggctggaagaaaagtttaattctctctaagccatatccggttgggttgtgaaagaaccttacatatcctgacatcctcctcaattggctcccctagtatgaccatactgtagtttcctgagagactaatgctgctataaagaaagtcaatatttgatgagcaatttcctgagagactagtgctgctgtaaagaacctcaatatttgatgagcaatacttgatgagtaaaatgagaaaatctctattattttcaaaaagtaacaaataagcaacaaaagtaagacccagaaatcttcagaaaacatattgcttgggagaagagaaaaaagaaaaaaaatccactttctcttttgtacttacattttcttacattcttgattgttcttgagatattcactaatcctatcttggtccagatcctttagaggcaaaatatcagatatgtaaggtcagcttcgaggagagtcacgacagagaacctctattggccgagacactaacttcaaacctgaatttcaagtgattatgagcaatactaaaacatcgaatggatctttttgttttttctggagaagagtccacactgagttataaggggttctagaatctgcctacttccaattttgttcatcctgccttcatataagagtaacagcccattcttggatggacagtttagaacttataaacaatctcatttataatgcttaagagtaactctgtattgaagttaccttgcaatgaatcctctgggaattcaaatagtccctttattctgtgaaaacctatgactctcaaaactgtgctaatttatcatatgagtttatactggtatacaattacctacagcttacctgtagttcaactctactcatccttatttatgtgggcgcttcatttaaaatggtgagtattaatttcattttaatactcggtgcctttttgctatttgatctatgcctttttgctatctatgtgtcttctttttttcctgaaatcaattgcttcatttgtcacttctcatgttgtcactctaaaaataggatatagaaaatgcagtttcaaatcgtgtagccaattatcactggagttatcacagcctgacagcaggcagaaaggaaaaaaaaaaaaatcagaactatttaaatcatggcattagtaacatcccaggcccagctgtgagaagagaggttgtgctatggcaggaaaaaacaccagagtggggaatcccaattaactgggcaagtgaaattcaaaattcattattttcttttcttttttttttttgagatggagtctcactctgtcgctcaggctggagttcaactcgcctcccatgttcaagcaattctcctgcctcagcctcccgagtagctgggcttacagacaagtgccaccatgcccggctagtttttgtatttttagtagagatggggtttcccgttgttggccaggctggtctcaaactcctaacctcaaatgatcctcctgcttcagcctcccaaagtgctggggactacaggcctgagccatcgcgcctagcccaaaattcattttgttaatgcatttagtttgtctttttattatgtatttctggtggggaagatataaaaataaaacttttcagtaaaattatttctgaattattgtacatatatctagaattctaaatattttcaaaggaaacttcaagacacagcgaaaatattttcgttctttatattttgtagcttagctgccacacattgaggatttcaacccaaaataggctacaggtccatttgagagaaatgaagggcctaaaattaaaataaaacaaaaccaaacttcaagtagtcttaataggaggagggcctaccattgtctgttcagtttctacatttaactcaagtaacactgagtttttcttattatttgctttgagggatactaagattcacatctgttaattaacaaaataaatctgtaaattaacaaagcagaaaatactgtctatttaaaaacaaaatagccgagtgccgtgactcatgcctgtaatcccagtgctttgggaggctgaagtgggcaggtcacttgaggccaggtcacttgaaatcctctctctactagaaatacaaaaattagccaggcatggtggtgcatgcctgtaatcctggctactcaggaggataatgcaggaaaatcgcttgaacctgggaggcggaggttgcagtgagtcgagatcgcgccactgcactccagctcaggcaacacagcgagactgtatcaaaaataaataaataaatacaataaaataaaaatgaaaacaaaataaaacaaacaaaataaacaaaacaaaacaataatacccagtccagtgaaatctttcccatgaatatgcaatcaatgttgtcactataacaactgcacacaagaagagggaaggtcaggctgttggcattggatatggttgcatatgaagcattgataatgtgctttcttctcttctttcatggtatgcatcttcttcaaagaaaggataagatctcaaagcaagaaactttcttctgttcaatctgtgctacaagctgttagtcagctggcttgtccaaagttactcctcctgcttgggtggattgatagtaagcccgacttcctagcctggataacagccacttttacaaatcctattatgtcatacacttctctctttccatatgcacaaaagttgtgaatattcatccaatgccatcagcatttgattatttctatctcacctactaggctataagctccattagtacaaggatgtgtttttgtttgtttgttgtttgtttcacttttatgcatcctagaagctatttctttcagttatctattactgtgcagcaatttaccacaaaacctagtgactataaaccagtgtgatgattactcaaaaaaaattagacacaaaattaccacatatggttgtaaatttaaaacaactgaaagcaagaacacagacatttgtatgaccacaatcatagccacattattcacaatggtcaaaaggtgaaagcaatccaagtgtctattgatggatgaatggacaaagaaatattattcagtcttaaaaaggaaggaaagtctgacacatgctgcaaactagatgaaatttgaagacatcatgctaaacaaagtaagccagtcacaaaggagcaaacactgtatcattcaacttagatgaggtaacctggagtagtcaacatcatagagacagagagtagaatagtggttgccagaggctggggagaaagtgtaatggtgagttagtatttaatgataaagaacaacagttagggaagatgacaacgttatgaagatggatggttggtgatagttgcatgttttagtccgtttacacactgctgatgaagacatacctgagattgggtactttataaagaaaaagaagtttaatggactcacagtttcatgtggctggggaggcctcacagtcatggcagaaggtgaaaggcatgtcttacatggtggcagacaagaaagaatgagagccaagcaaaagggctttccccttacaaaaccatcagatctcatgagacttattctcacgagaacagtatgggggaaaccgcccctgtgattcaattatctcccactggatccctcccacaacatgtggaaactatgagagctacaattcaagatgagatttgggtggagacacagacaaaccatattattgcacaatgatgtaaatgtacttatcatcacagaagtccatacttaaaaatggttaaagtagtaaattttatgttttgtgtattttactacaataacatgcatgcacacacacacacacacacacatgcaaacatattacttcacagtttctgtgggtcagaaatttatgcataacttaactgggtcccctgtttcagagtccctcacaaaactgaatccaggtggcactgactaaaggtctcatctgatctatgactgaagaaggatccacttctaaggttgtgtggttgtttgctgagtcaggacctcaaagtttttaggaccaaaagcctcagttactaactggatattggttccaggctatttttctgttccttgctatatggtcctcttcaaatgtcaactggcttaatcaagacaaaccagccaagaaggcaataaagagagcagcaagacaaatgtcacaatattttgtaatataatcagagaagtgcatcccttaatgctgtcatattttttggttatagccaaattgcttaaggagaagacattacaaatagccataaatagcaggaggttaggtaggacttactgggaccgttttagaagtctctctaagaaggtagataataggaatgggtgagaactccgaagacaagttgaatcctcccacagacaggaggtcattgctgagcagcagctctaccctgaactctgagtctttagtaaggaaagatgaaattacaggctagggtcatgtcagagtcagtccagaaggaaggcaattttgttattttaggaaaataatgaccagctttctgggtcagggaatgcatagagcctaagactactgccaggatgcagcagtatttaagactcagtccagttcaaatgctctacaccttgctggatgggttatgcagatatttgtggttgaagcctagaccttagatttttctaattactttctgtaatggctttataattgggatggattccaagttaattgtctgataggcttctttggttaaaaacttcgactgcaaaatatttgccaaggcaactctacttgccatcttttctgccgataagatttgagaattatacttctgggccaagggcaagggaagcttctcaagagctccaatgcaaggtgatttttctgactcttgagcaaagaaatttctgggtgatcaatgtagcctttttgaccaagaactttatttggggatatggggagtaaaggtgataatacagctagagtggagagacagaggagaatgttttgtttatttttatgaagagtcatcatggcttttttgtttgttttttcaaagtgggatgctcaataaaggcagggggaaatcatgtcacctagtgaaaggacaaaaaggcacatcaaataaataaaatggacaccaaagagcctctcctcaacctgaagctgtctcctccaatgttgtgcatggctatcatttgttctaagtgacaagaacttcagattccagaaaacaattagctcttagtccaacattttgtaaaacaaaaaatgacatccttcctctatctgaatcaaataccctaactatatgaatagttaatatgtaaatatttacatgcataataatactcacaaactacatgcatgtatttgcaaattgcatatgtatttacaaataccaaggacttttcatttccatttcatttttcatgaggattttttatctcaataggaaatcaacgtatagagtggccatagttatcttcctgtaattccatcataggagattattattgttaggtaaaatgacacacagatatgttaacttagtcacaacaattttagggatgagaacgggtggacataaatggggaagtttctagtggattgccttccttgactcagtggagctctttcacttaatcagcctaaaaaatgcagttggatacagaatcctgccactgaagctctaagtaacatgaagaaggtaccttagacatcccataaggaatgtgaatccaaagaactaggaactagccaaacctcaccttcatcaacaagtagcttgtttctagtctattttgctggttgtaaatttgctgtagtgcaagtaaccaatcctgtatgaatgaaaaaaaaacatatcaattaataacgaaggcttttatggcaaagaagccaatattttagacagatttaagatgtcttcatcaaaaagatgaaaacaatgtaaaaggtttgcctttactgactctgcttttttttaaaattctgtcattccaaacagttcaaatgtaaaagtgatactattttccattttttcatctaggaattcataccacctcccactggcttgaatgtaatatctttaaaaaaattcactatttccagtgttacaagtatcctcttttaaattatattcagtctaaaaactcattctctatgataaagtaagttatctttcttatttctttttggaataccctgaacttgcttatcaatcttggaatgcacttgagataccaaacctcaaaaaatacattgagctctgaaattttctaagagaatttctcagcacaccaaggctcgctttctgaaaccatgctcttgaaaccaggcaactccaaaggctcttcctccttttcctcaaatttattgtcaaaaatttgtgaaattctttgtagaaacaaacagtaaaaaccagaatgtgttcctgtcaacatactattttgctttaaaatctagtttctccttcctcttccttctcatttatctgtcttaaacaccttcctgaaagattcagctttatattttgcatatactctagaatgcatgagttatgtagaatccttaagtttggcaataacatgtctgattccatttacatcttgtagaggaagaagggaattactgcttatacaaaattatattatgtccagcaggatatttttgatgacccaacacaagaaatgcaatagaacattcaagtgagaggtccaaaatggtttattcttttatacatagacagtcaaattggaaggcttactgtatttcggttccaacatactgtaaatgataaacactttgataaaagaaagatgttttgttataaatttaagtaaactccaatttacccacagttttttttacctctaatttgttttgtgtaatgatttcttatattgtagtgcattatacttacctcaataaaataatttttcccaaaacagggatagaattggtttaagtaaatgtgtatttaagtttaattccatgtttaagctcaaacaatctcttttggtaagaattcaaacacacacacacaaagacatacacataaatacacactgaatttttcttgataggtttatggaaaactaaaaatttctgacttttgcctgcactatgtttacattattttcccccttctattatctcctcacccatgttgatataaatataaacatcatatatatatatacccatatatttcatgcttgagtttccatttagagattcaatccgaattctatacacaaatatgctcaaaacttgaaacacataagcttactttaaagaatgactcattgctgcccatgaagctatgtcaatacttatgcaattccttttcctttcaaatttatctttccatactctgcttcatgagactgtgcaaacaactcttctctgtcattagatggcttcctcttaagtcccatagaaaaatgcacaaaaggaagacaaagacaggaggaagagaaaaggaagggctcctttccattctgttcactgtttctgtcagcaagttacttacttgagaagcagcagtgttaaaggatgtagtttcttttgatattcctggaactagccgcctctgaggcagcagaaccatgtgagcatggtttatgggaatggtttgatggtttacttggcactgaatatagcagtgagttcttcactaaaagaaaatgggaaaatggcaatccatggcactcagtttccttacaattaatgtcacttgtggttgattgtgacaaagatcttactagagcaatagctttgggcactaagtggcaactgtactttatcttacagaaataataaagtctataaagcctgtgagtaagatggccaatactcactgctctctggagctttcagaaagaaattatgaacttagtctctaatctctgagatcaactcagtggctaagtaacagaaaacttcaatggtggcctgaaactaaaatcttatttcttgcaactctctaaaaaagaaatccaaattttattgtgtgggttgcatgactacatgataatgtgatttacagtcacaaaacccctcatgtggttgttaggacattggaaagaaataggaaccatgaccttggaatagagacatctggatggatttagaagaaaatgaacactttgaacacctgaatcattcagtgccttttctaaaaaaaaaaatcatagcatataaaaagatattttaatctttttgcatgttctttgaatacagagcttatcatttgatataaatacagctcataattcatagttttttggccttcttttacatttttttctttcccccttcaatttacagtgatacctactcttggcaaagccagcaactttaaactaaacataacagtttccacctaccccaaacctgtatcttttcatgggtctcctactaggttaacttctattcatcaaattaattaccaaattcagttcagatcagaaaagattttggaatttactacatgcctataatgatgctagacacaaacactgatatcgaagtaagcttcacacccatgcatcccttttcatttttttctactccatcttaataatctccttattgatcctcctcccttagttcttctttttctcataaagattctatttttggtcagtattctaagctattatctctagagagtctatatataatttataacataaagaagataccaacataggccaagaccatggtaaagaaagaagttacacacactatcttgatatcatctgattcactttgtttttaaaattcctgtagttgattgactcaaaatatctaagtaagcagaattgtgtaacataattgttcaaatcttctttccagaagtattttccctctggaggtaatggtttgatacttcatatctatcttaatgaaatgtatctactatgccatcatatcatatatgatgttatataatttttctcttcagtctatataatgctgtaatgtaataaatgcatcactgaccctgtctgatggcattgccaagctcctctgtttggtaaaagagcctgaaacaatagtagttatatgttgacttattgataatgaagaaaaattcccaaggccaggctgatatttacatatcaagagctttgcattgagaaaaatgttgtgttcttgacatgaaaataaaaggttctcacatttgttttcctgtcctggaaaaattattaaacagaataagtgagcagagttgagctgcttgatacctcaacctctatgaaattgaaatgtataataccacaggccttatttcatttcagagacttactggtttcagatgtttaaggaaatcctcctcaggtgattagctgacaactaaggtaacttaacagagacttcagtagccatacccaacaaagaatacagatttttcatatttggattacaaaagtaattaaatgaacaactataacaaaaaaaaataacaacaacaacaaatcctgcgaggggaaatctgatttccagaattgtcatattgcattatgtattaatatagtgtcctgttttccacagaagattatgagacatgtagaaagtagaaagtatggctcacatacagaaaaccaaaagcagtcaatagactttgtttctgaagaggcatagacattggacttactagacaaatcagttattttaaataagttcaaagaactaaaggataccacatctaaggaactacaggaaagtatgagaatgatgtcttgccaaatagagaccatcattacatagatagaagttttaaaaatgtaccaaagagcaatactgaagttgaaattcagcaatgaggcagggcgtgtggctcacgcctgtaatcccagcactttggaaggccaaggcgggtggatcacccgaggtcaggaatttcagaccagcctggctaacatggtgaaaccctgtctctaataaaaatacaaaaattagctgggtgtggtggtgggcgcctgtaatcccagctactttgggaggctgaggcaggagaatcgcttgaacccaggaggcagaagttattgcagtgagcagaggccgcaccattgcaggggcaagaagagccaagaagagtgaaactccaattcaaaaaaaaaaaaaaaaattcagcaaggaaataaaaacgtcagtagaggggactaaagcagatttgagcaggtaggaaattaatactcagggaactaaaatataactcagttaagactatccagtcccagggacaaaaagaaaaatataatgaagccaaatttaaagagtctcagcatcctgcagggaatcagccagcatcccaatctgtaccaggaaatcccaggaggagaggagagacacaaatggaggcaattggatgacacatttgtagtgataaaagaaaaatagtctcagtgaagaactcttatctcccgtgaaactccatcaaaaatgaaagtgaatttaagatactcccacataaagaaaaactgacacgccataactagtagacttgtcttacaataattactaaaaggaatctttaaaggccaaaattaaggcaaactagacaataaccaattctgtacaaagaaataaaagagcagagatagagataaccacttccgtagtctgaatgactccatcatggtaaactccttccctcttagagccacccccctgacataacaatctcttgtttacctagtgcttgtcaaatgtacttccactgctaaaatacccatgattcatggaaaaaatgatggcgaaaagtcattccttttctttttgtatggcccacttttgaatttttgcattgctttttctaattactctttctcttgatcacaggggacaaagatattcttgtctagacactgccataaatctaaaattttggctttggggaacaggtaaaaacattagagcaacctgctgtcagacccacttcatgcataaggcaactaagatcctgcaaaggtgatgtgatgttttggaagtttatataaataatgctattccctgccttctagtgcaagtaacaataacactgcgtttttgtaatgcagctatatcaagccagcagcttatagactttctggtgatgagcatattctttttgagacaatattttaaaatcagaaggcttcacatagaactatgtagaaacaattgagagatactgtggatcttagccctgtgttccatgtaacacttaaaatgctattgctttgggttcctgtcaatagctcggtggtacctattgttttgatgtcagataactctgcccatacaccctgtctgactcccatacacctgtctgacatttatctttgcaagccaaccttggcatcatacacttacaaaaaattcaatatctactataatacaagtaaggcaatacagaactggaatatatatacacaaaaacatttagatagacatatacatgattgcacacccacatattaagttacctacgtttatcatatggttcaagtgatgtcagacaagcatgaggattcagaggaggctttggagttaaacagcctggcttcaactttcactttatcactgagtaactatgtagcactgggaaagtctcctgaacttactgagacatggtttcttaatttgcaagatgaatatgatggcatttttggggaaaaaaataaagaaactgagtgaaacttttagcaaagtgcccagtgttcatagattgagatttcttgcaggctgggaactggcaccaaggtctcctgacttccaggcagagatttttcccatcatgtcacttttttacactcactatctcttatgtgtcaccctagtccctagtctctgctgctgtgtaatgtaaaagattcatgaggtgggaagagtctgaaaggtctcataaccaagcactttatgagtgactgaacatttttgacattctgtgctaacaaaagccaccctcaaagatttttatatggggaaactgaagattgctctgtgtgggcagtggctcactgagtcatatattcagtttgatcctgagtaggactactgtagatggttttatgtctaattagccatgactgttaaagacttaaaaaaatgagaataatcaaattttatgcttcactaggtcaatcaatggctatggaagtgcagctgctctcctttacaaatgcttccaagagtttttcacaattcattggacacctaagtgggtgattttacctctgttgaactaatgacttgtaaaatttatctgaaccccaagtccagaccactcaattcaatgtctagatgcaaccaggcttcaaattctcaattttcttccttctttctccactttcaggcatttgctgtgaatcttacaatacctttgctgattgtatgagcaaatagcacataagaaaactcagactgagggagcagacatgctttttgagacagtattccctaagcctctggaacctcataaatgaaagtatctgaagcttgcatgacaacattcctcaaagtttggtgcttggcttacctgccccagaattacttgttgtcaattataaaaaccacaaaaataacacgcaaaaaagtaaaataaacaagaaaatgaaatagagaaagagagagaataaaagaaacctttcaagctcatactgtaacaaactttgcaatctctggagggaagacgcaggaatctgcctttgtaacacatgcatttctaatgtcactgatgcacagacaactatgagatttcctgagcaatttgctcaatcaatgaatatttagagtagtatgacagtttgagaattgtttgaaatgtatggaaactattggaattacttcagcaacacatcttacaatgtaggaggaatcatagaacctttgaagttataggaccaaccctctaggagtatacagtgctcttcaattccttgcatacaataaaaccagaaaaggggtaaaggaggtgacatgatttaagataggccattaagtatagtcaggattttattttatttatttattcatttttttttattatactttaagttttagggtacatgtgcacattgtgcaggttagttacatatggatacatatgccatgctggtgcgctgcacccactaactcctcgtctagcattaggtatatctcccaatgctatccctcccccctccccccaccccacaacagtccccagagtgtgatattccccttcctgtgtccatgtgatctcattgttcaattcccacccatgagtgagaatatgcggtgtttggtttttggttcttgcgatagttcactgagaatgatgatttccaatttcatccatgtccctgcaaaggacatgaactcatcattttttatggctgcatagtattccatggtgtatatgtgccacattttcttaatccagtctatcattgttggacatttgggttggttccaagtctttgctattgtgaataatgccacaataaacatacatgtgcatgtgtttttatagcagcatgatttatagtcatttgggtatatacccagtaatgggatggctgggtcaaatggtatttctagttctagatccctgaggaatccccacactgacttccacaatggttgaactagtttacagtccccccaacagtgtaaaagtgttcctatttctccacatcctctccagcacctgttgtttcctgactttttaatgattgccattctaactggtgtaagatggtatctcattgtggttttgatttgcatttctctgatggccagtgatgatgagcattttttcatgtgttttttggctgcataaatgtcttcttttgagaagtgtctgttcatgtccttcgcccactttttgatggggttgtttgtttttttcttgtaaatttgtttgagttcattgtagattctagataccagccctttgtcagatgagtaggttgcgaaaattttctcccattctgtaggttgcctgttcactctgatggtagtttcttttgctgtgcagaagctcttgagtttaattagatcccatttgtcaattttggcttttgttgccattgcttttggtgttttagacatgaagtccttgcccatgcctatgtcctgaatggtaatgcctaggttttcttctagggattttatggtcttaggtctaacgtttgagtctttaatccatcttgaattgatttttgtataaggtgtaaggaagggatccagtttcagctttctacatatggctagccagttttcccagcaccatttattaaatagggaatactttccccattgcttgtttttctcaggtttgtcaaagatcagatagtcgtagatatgcggcgttatttctgagggctctgttctgttttattgatctatatctctgttttggtaccagtaccatgctgttttggttagtgtagcctagaagacatgattgtatatctagaaaaccccattgtctcagcccaaaatctccttaagctgataagcaacttcagcaaagtctcaggatacaaaatcaatgtacaaaaatcacaagcattcttatataccaacaacagacaaacagagagccaaatcatgagtgaaatcccattcacaattgcttcaaagagaataaaatacctaggaatccaacttacaagggatgtgaaggacctcttcaaggagaactacaaaccactgctcaaggaaataaaagaggatacaaacaaatggaagaacattccatgctcatgggtaggaagaatcaatatcgtgaaaatgaccatactgctcaaggtaatttacagattcaatgccatccccatcaagctaccaatgactttcttcacagaattggaagaaactactttaaagttcatatggaaccaaaaaagagctcgcattgccaagtcaatcctaagccaaaagaacaaagctggaggcatcacactacctgacttcaaactatactatagtcaggattttaaagaaaggacagaaaaagacagaattttccatatagggagggacaatatggataaatgggaggagatgctaatagtatgttgtttagggatgatggaaaaagataagaatgaacaaagataaagaaactgcaaatgtgtacactgtttccaaaagtagtaatggcaggaatactttttgtgttgcattgtagtatcttgtattgatggaaatctctagatctagtttatggtgtacccagtgtgaacctggctgagatatttgactctcaaagtctcctcctccaaagtagaccagttccactttgggcttaaagtgatgggaagctgaggcaagacagaatgaaggccctgagatggcaaccaaaacctccacaaacagcaggaaaaaatggaaaatggggaacagaataaaggcagagacacacccgtctctgcttgtccttctacctggatcccaaggggctacctctccactctgaaaaccaaagaatcacctctaaagaaatttgtatgtgtatgaggatcaacctacagaacttagcactgtaaaatattgttgaagtggaaactggaaaccacattcattttatttaaatctaaaatagagaattatatttttctcaggattttgtattggatttaatgggttttgttttttgtttgtttgtttgattttttggtaaatcctggatagcttggaagatctacatatgatgaacatgtgcttttttttctggtttgtaaaatcgaagaaataacatttttattctttctctttccatcccctgactagattagtattgctcattaacactgttctggagctgtagttagttctgaggtggtatttgagtatggtgtgtgggcactcatgcaggtttatctgctgaagttgcttgcattcctagtggcaagtggaagcaaagcttacatgggagagtcttctggttgctgtgctctgcctacttcttatagtaaggcctcattgctattggcagtgaaaggtactgccagactttatccaaaatattagtctaagcatcacaactacacaggatattcatgtacacaattagtacactggaaatatagttttcttaaatcaccctatatagatttctcctacctttcatgaaaagtactttaacttctctctggggctcaatagcttccctgccctcaggctgtgttctttcaatgtggccgatcccactccagttccagacatgggcataagacttaagcccaagccaagaaacacatttcattcccttgactataaacattgtggtgagggtagttatgaaatcacagtggggccagtttgaaccaatcagaggagagattgatcagaaaagagaaagattttttttaattgctatttctcttcttttttcctggatttaatcctgcatagagtaggagaacctatctgagaatgaggccagcacacataatgggagaagatgactggagataaatttcatggatgatatcatttgactactaagtcaagctatgcatgaggataaatgttatcttggacttttttaagttttattacaaaatatagtcttattatacttttggcatcaagaacatttatttgtttgcatattttcattttccacttatgagtgtcctgatgctaatttttaataataaaatgcatttgcttcttccaaagtttattagacatttcagcaatatgacatcattcttttggctagatatcagtacacagtaccattttactttagttccaaatcctttccatctccttcatgtatttttctagtgaatgacctataaacaaacatgtatagtgaaaagactgccacttaaagggcttctttgtttaatctcaacacacagattgttttgaaagttgagttttgtcatctaatacattactatggtaaaatatggctttcatatgcttgattttctaaagcatgtattcacctataagatattctcattcttgagtcctacttggtctactgatgcttggtccactggttttagtataaaactaaagacattaggtattattaaaatataataataccaacttattgaaagataacgcctcccctcccctcttctctcctctcctgcccttccttccttccttccttccttccttccttccttctttccctccttccttccttcttgtgagggtggggtattgaagggataaaatgcccagaggaaaactccaagatgggatgggagacataggtccaatatatcagaaggttaaattgagtgggcttatgagagaagcaggagaaagggaggctagagagccaataaaacaaagttcatagtgataactggaacagaatagacctcaaaggcttaaagatgtcaaagtccctgcattttttcctaccttcagaatctaccaccttcagtcatggagaagtcttgatgaagttacccaatctataacaattctatgctgtgcatgctgattgaattatcttcatcaatgcattctgttttgcttttatcttttgcaggtaacacagtttctcactcattgaagctcctccaacatttctagaaatatggagtacaaaaagaatacgtaggttttgttaattctatagattgaattagaactcccaaatgatttttcaaatgaatatcccctctcaaatcatttaactttttaaagaggtaatttcactctccaattagtattttctagtaattgtacttaaatgtctcataaagtgctcagtaaatgttacttcagcttttactacctcttgctagaaacagtttctcttcttttttattaggaaccagcatcctaactaaccagctccttcagaatgagtttactaaaggatatattttctaaggaatatccacattgtatatttagggttcatgccaagctgttattgttgtatgccttaactgattactaaggatttattgctagccacttcaaacacatactcggtagtgtcctctccattggccaacctgtttctccgaccttccatctacttgaaaacatccatgactgtacatgactctatcaattccctgggcaggggttggggggatttactgatatatgttcttttgctatttattgaatcctctcattttgtttagtattgtcctggatgttacagaggatgtaatgactaaccacataagaatactgtcctcaagaaatatacagtctaatagaaagaaatgaagaccaataatttgggatcagttctggaagggagaaagtcaaaacaggtcttacagtataaattgaaggtgtgagcagggttgtgttctgtctggagtttctagggtagaattggttccttggcctttctagctttgagaggctgcccacattccctggttctcaatctcacactctgacctccacttatattgtcacatctcctttgctaactctgacccatacaccttataaggacccctgtgattacaatgggcccactggctaatctgcaataatctccctatctcaaaatctttaatttaattacatctgcaaagccttttttgtcatgtaaagcaacatatttataagttctaagattaagacatgaatatttttgtggtggggacaatattctgcctgtcatagtctctatgttgttagtgaaataaaaatgctcacggagccatttagaaaaggcctatcacctccaaactcgcctttccatcacttttgaacagtaggtggattgtaccacctaaatgtttcctggattcatcctataaaagtcccttactggaagccacacactgaagaacagagtcagaagttgagtcataaaaccaacttgcttactatggaaaggatgaagcccaaatcatattaagttaccagctgaaaatcacaaggatatgtagctgttacatgacatggccttttcacatgtgtgaatataaatttatatgaatctaaaaacatataaaatctttcagtgaagaaatgaatcaatcaataaatatattatctttatcttcttcttttcccctgttctttcccaggaccttaatcaagcacctattttgggacaagcaccactgagaatacaatggcagaagaccatcttaccctcaagaaacattgcactcacagagaaaaaataagacaaagtgcagactctgtctatggcaagaaatataaagaaaactatgtttcatgtgagttcagaacagagagaaatcacttcatcatctcataatgttactggtgaagagatcgaagttacgccgagttactggctgcgaatccctatacatctgcagcatcttgaattcttgcctcctcagaagaaagaatttgactgaggggcataaagcagaaaaagagactgagatgagttccagagcagtagtagaagtttgtttaaaaggccttagaacagaaaagaaaggaaagttcacttggaagagatccaagagggttcatgaaggttaaagagagagaagttcaagtgccccattgaaccatgatcctaggactttcataggtgcacctctttcccatgattcttccattagggtgcgctttcctcttgcacagtgttctccttatccttgggaatggagcacctgcactatgtttagggagttatatgcttgccaacctgaggctttcttccctttttccaaaggggcgtacccagaagatcatacgtcaccatttttttctcttaatgttcatgcctagaaagttgcttctttctggggtgtacattcaattaatattttggtgttaataggtgtggaccatcaggaaatgacctctccatggcacaggctgccaatttatcccctctagagaggcaatgatataaccggcaaaccatcacctgacatttctagtgggtgggggaaagagccctctcttgccctgctcatgcctgactacctgtaatagtaaaatacttacagtgcccaacacacacacacacacacacacacacacacacacacacacacacacacatctccctcatgtagacagggacagtgttttgtccccactctttttgttgttattgaggcagagaagctatatcaatcatctcagattataaaactaaaaagtgatgaaataggattaaaaacctgttacccaaattataatttattatttcaccttctccctcaaaaaagacaaaatgcaaaaataaaaaaaaaagaacacaataaacaaacaaatgctaatgtttaaatctcttacaacatagcaataaagaaatcatgctggcccacatccaattacaaattcaaagctgactgagttcaatatgtgaattatgtatcaaacaactctattaatgcaaagataatttaaaccttaaaattaaatattaatttccatgaagcattcctccttctttcttttctaggttctaaatcatcctacatttttgccagaggagcaattagatattttacaaatatatcaatatttttctacactgagaatgacatgaccaagtgcctggtgccgcctcatgagtccagctctgggaagaagggagattccttgcttggctttttcaaattgacatggcatttcctttgttcgataatataagcctttaaaataaataacaaataatgtgcaaaagaaaaattaactacataatatatcgtaaacataaattatgtacagtgaagtggaacatgactctatttgagcataagggaagataaatatagctctaccatatacattcacattccgtgtaccttgaactcttttttaaaaattttagtaacattttctatcactggaaatgataatgatcttgcctcctagtttctactgttatattgtcaagagttaatctaattgtaaatatacttgtaaaagatacttgtgctatgatagtccattgacgtttacgatttcagaattttaaaatattttctgaataccctaaaagtaaagatttagtaaaaatcacagctaagttataagattattgtgaagattaaataagacagtgtatgcagagtgtccagactaaattgaataaaggtaactgtgagactggcataaaagagcaagttaggcagctaatgagtgtgcctactcagtggcccttccttcttgtctcaattatttttaggttccctacacattgtagactctgcaacacagaggttaaggcatgtggagtagaactgcttgaatgccaactccatttactagctgtgtggttcagcacattacttaattcttctaagcctccgttttcttagactcacaaggttataattactgcacttaggtcatgggactgctgtgaggatgaaaaagagaaagcatatgtttaaggtgttgagaatagtagatggaacataaacagtgcttagtaaacttttagcgataataccaagactagtggtttgcagaaatatctgaatatatctctccagagtgccaagggtctactatttatgcagtaaatgacagcatggtaacaacagttttcagattttatgacatctaatctgtataattgttaaaacttttttccatcccatagtgtctcttgaaatatgcagaaattaaacatatatggcacaaatactgttacacttcttcctaatctatgacaattaaaaccaataaattcacgaattatttctgggttttggaaaacccttagaattattctaaacacaaatccagaccagcagcatgtttgtttactattgctactgtaacaaattaccacagtttttttagattaaaataacagaaatttatttgtttgcagttacagataaaagaagttcaaaattaaccttatgaggctaaaaatcaacagttctatacaactgttacctctggaagctccaagggagaattaatttcctgtctcttccagcttcctgtgttgggtggcatgcctttgcttgtggtcaaactacttcaacttcatgcctccattgtcttaaatcttactctcttttctgtactcaaatctctctctgcctctcttctaaagacacttgtgattatatttaggacacactcatatatccaggaaaatatccttatctcaaaacctttaatttacttacatctgtgacacatctttttccatataaggcaaaagttcacagattccagagagtagaatgtggatgtgttggggagctattattcagcctaccaggaccacaattaatgggtaatagcctgcacatgagattcagaaggaactgacttgatggagtcaagaagacaaatttgggttaggggagaacaaaaaaatgactgaagtcttctgtagcatctgctaaggttattcaatcttgtgaatactcatctgtattatgccagctaaatgatttgtagaaacataaatctagctcattttcaaaatttgtcaatgagaaacctcaaataatataatatttagatatttatataatatttaggtgctgaagtaaaactgaccaaaaagtttacctttgcaactgggtggtgaagggaagaatacagagaatgagaattggcagttctcttttaatatgtggataaatactatcccatttcttcaatcacttatgaggagatcaataaagtcttaaggaaagattacagaacaaaagagaaataacatcgaattttaggcaacttgatttcagggcataatctttgggttatattactatgatctttgagataaattcttaatctaaattaataattgggtattttcaggtttgcaatgaaaatacagaataaatgatggaaaggtctctattactatgccctaataaatgtgaaggaaaacaggacttggtgacttcttgataatgactatctccagcatatttccctatagtcagtttttctttattatgttaaaatagttttaaaatagttacatatctccaattggcccctaatctgatcactgaagttctagaagtcattgtttctataccgaacctattatagttaattggaccacaaatagacactgaatttaagttaaaacaataaacttttctcatatgggatttttgaaatccatctgatatttttatggagcaagtctgtacatttctgaacctgtctaaactggcaatatatatgttttagaatttagaggcagcagtaaaatttcatttggaaagttgggaagcagggcagattacggatgagaactaagagaggccaagtctaaaaactgggaaaagaataagcttttccccaggatccagttcttttcttaggtttgactatattgttcagtaacattgcttacactcaacttttgcagtcaaagtcaataggaggcatacgattgacacataatgctattgtggacatccttctcgaactttcccacctcttcatgatgcttatgctttaaagaacattcttattaatccttacaataaccatgaggtagatattgatatttacattttacagatggacagatggatactcagattgattgaaataagcttaatgctaagtagctagtagaagacaagtttggaatgctaacccaggattactggtagtcacaaagttatttccagtaaaccattcttgtcttccctctcctcctcatagaaagttgactatcctcaaatcctttgcttatccatgactatggctattgactgtggatttatcttcttccatgccaagactgtttaagtttcttttcagttttctcgagccagtgtgaaatgctctcagacacactccaaaaacatatggcatgatgaatctttatagttgggaaaaaagcccttaaagataaagggctctctgtcaaatatagattttgtgtgtaatacaagaaatagctctcttttcaggttttcaaagctgtttactaataatttaatcttctcatattgctaaaattaatttttttctagctttactagtacaaatcagtgttcaggaagtagacagcactgtgtttacataaatttggacaatgagattgaaaaataaaagatccgtagtgtctaaacataagatctcaagcagggtccatgataggagctactgaaatgcggtagagttctcaaattattttcccaaaggctttcctgtcactattcttttaacaaatactaacaactaacatttcttgagaatttgacaataaccatactaagaaatttcatgtattatttaagttaatcatattatcattcttgatatactgtaattactcttatttacaatattttaaagatagactttcagagaaagattaagagatgcctgaaagtcaatggctttataagtggctggttatcctacccaactgtatatgattgatgaacttcaccactgaattaaacttctttcacactagtaaaaattgtggaagggtagatgattagttataataatttgggagacagcaaaaacaaagagaaagagtacttccaaacaggaccaactgagagcagagatgcatgctatcaacagtgatttcagctcttcagctatagtcctcactttgaggaagtttatggtaggtgactgaataataacatttttttcccagtttacaaattatcacatccatagaccacgagtggccattttgtggcacctctttttattttttcccttttaagtcacttttttcaacctaatttttcctggagcactgatgctgaagatctcatgctttttttacggttcaaagtacttctgtttaccctcccttggctcttccaatttcttcttctgttttctctctctcaccatgagatacaatgtgtcatgagacatgaagtcatgagaatgaaataggttaaaagaaatgatctattacatcttaagcctttctttaaaaagaaacacagctcaaattttggttttgtggctagatgatatcttgtgggaatattgtagatctttcaacctccattgagtgtcatttctgacaaaaccttgagagataggagcttcaataataaatcttgttactcattccacagcatctgtttcactttgtcaaaggggtgtttctatggctgaatctaagtccagatgcacagccaactcaagaaatattgaatgtggatcaccagtttatattgaaaaagctctcttcattgaattattttctcacttctactctactctatctagattcttaaacttatctgaataactagtgtctgatacctttctttaaaactgactccttaaattatgtaataattgtgagaattctcttcaatgtttccctacatttccaacaatgctgagaagagagtgcccataggcaagggtaaccacaatctcttttcacgcaacctacatctcctccttatgactttgaggaaattgctgtacaaaaaattttatctgagcaatctgggctcggtatcaatcttgtagcaataaagatttattactaggaagcttatttatgtgtctatacatctggagtctttgtttcattactgcccacacagagctggaaatctgtggagaatgggaaaggatcatctttattataaactcagtttcacctattttctacccatcaccttttttagtataatttatgaccatctgaacccagacctaaaaaagaaaggtttaattttaataaagatgtgaaaacaggtgagttattgtttgcagtttcagtgtgagacaagatctggataatgtgtcattaaatgcatcattataaaagcatattattccttccagaagataatcagttatgtcactgtatctggttttatgtccattcagggtgagtggattctccttttgacatgaaaatttggattgtagggaaagtaaaaaacagaaaacaaaaaaagaggctcactgactagttaattaaaaaaagagagagacgcatctgctgttttcaaagtagcaatatgtgaagtgatatctataaaaggaatcataaaacagccattgcaaattaaatgaatgatgtttagttattgaaaaatacatctctttgcatatttttccaattttcaccacgctttaatatctctaaataaaacaaagtggaacacttcaactttggaagcttcattataaatattagtcttagcctattttaacttcctttcatagatatcagtttctttgcttaacttagaactttgcaaggtcccatttatggaggtaaaacttcagactctgttctatagattagctaattaaagacaaagaggttgcttctctgcaaatgagaagggaaaaaatgggcaatcctttccattgttcctcaaacttctctgctgatgagccctcaccctgacttcaaccacatcatggccattttttcatttttcaagactatgttagttatgaatatcttgtctacaagtgacaaaaactaaacaaaatagcttaagctaaaaatcacaaaatattataaaatagaagacagaatatatatgcaatacatagtatgtgagtgtgtgtgatacctttagatgatactttccttgagcagagagcctacactaccatttctttgttaacagtgtgaccaggtttgtaaagccaaagttggcacgtactgacactacggaagtatatatgacagtctacttggtgcagatacttgaattttgctccttttgcatttctatgataattagaaccattgctattttaaaagtatcctttcagcatttctttccttacaattaatagaaatgtaaaagtttctgttttcatttttaaatgtgtaaacctaaagtcatagagaagtgtttggaaggaaattacataaatacatgcaagcaagacagcatatggaaattatttccattagtcttgcctatgattttgatatctaaaaatctctgtgagttaacgtaaaggagcatgttaggtagagtcaactcaggcacctgtcaaagacctccaggcaactgactaaaggttaatttttttttccttttctctgagttgtgcttatggaaaaatgaccaggcaaaccttttggtaaagaaatggaaataataatgtttggtccatcattaaatatatttgtcacaaaaaatagtcccatgtattttttaaaattatttgtcttcaaattattaacataagctcatttgtttctatagtgcttgtgctttctatgcatggattggtgaagctaagtattttagtgattcgtatgagtaaatggaacatttaaagtcctggaagttctatagattaagtagcacacagagaaaggagagaattagaagcttcttaataagaaagtttaaagcacttgagcatctaaggaaaacattttgaagattaaatcctggatacggaaaccttattattaacaggttgctggaactattttcatagggtgactaagatatgaaagattagttttaatgagcactgtgaatgcatatgaggagagtaagaggagatcattaaaaaaccttagctagaagtaggactacatttttataagggctgtaaaatgacccagtcattatgattattgttgtgttcctatgaagttaagtgtatcacattgcaaaggagacttggcttttaaattaaaaaaaaaaatctgatgttgaaaatttggtttaattacttcccagctttgtaaaattggtaaacctctctctatgcatcgtttttttttacaatgtataaaactaagattttagaaagctatcttgcttgattgtcagagagttacatgaaataatgaatataaagcagtaagcactgtgtctagcatatagtgagttctaaataaatgcggtgataattttcaagataatattagacatgatatcttcaacatggcctctccttccaaaatttttctgggaaaatataaatttcatatatatatttccccccaccctggctggtcttgaactcctgaactcaagcaatccttcctcctggacctcctgagtagctctgactatatatgcataccacaacacttggcttgaaactttctaaaactaaaaaaaatcaatgagaattttatcaggttttcttaattcgttaaatgttatgaaaagccttctaaattccacaaaagtttgtggaacaaattgtaatgaggcacaaaattccaagagcaactcatattagaatttaaaggaagtaaggagacatattagagactttgtacttaagggacccagaggtggttactagcactcttcactcaagacttcccaatcacttctggaactccacctccccaagggaacacagaaaaattcaacacgagagaaacagcaaggacaagacagaattgcaccatatgaaagccataaaatagtttagccccctctcaatcctgaccaaagagtaaggggtagcctacagggccttatccttccccatagcttggataaactgtagataggtttcttcctgactgcaggccccttccattcattttctaaagcatttactttagaaaacttgcaattttaatttaaactttatgcaacacagggatgtctttctcaaagacctgggaccagtgaaggattcacctactaattaatttaaaaatatttccgttcttactagactcagtcattatgctagacatcctaaagctcacccttatggagttccagtccaatgaacttcatcaacttttaggatcacagaaaggaattttaagacacaaatatgaccctcatcgctgtatagaaatgaaaggtttataaatatttttgtatccattctgtggcaggcatataagcttcatgggaaaaactgtacctgtttcttttcatggtctaaggaattaattttacataataaattgcccattacactattcagagaattatgacatagaggaatcattttttaagtaccatttaccaaaaggtcatgtggtacatataatgggtgaataagggaagctcttctagaaagtaaatacaaataataataatactaataataaaataaaatacaaaaacaaagataatctatcaaagtcctttacagagtgagacattctggccagtcgctaggacttggtccaggttgaccatctgctcatactgaattctaatccactatctatttgacaatgtctctccaagctcatcttcatagaatatcctttctgagtaattttctcaccataggaggtcctgttgccctgatttcaatatattctaatcttcctttttttgtgttggcagtgttacaccagatagaaagctaaataatgaggatttgaagtaaacccaggggtcaagcaagaagtcaaaaagttaattagaccacgcccaagttactattcagtagcgctgttcaacctaatttttaatatcgttttgatttgcaatttcttcggcatgtgtcagtggaaaattgcctgagacaagtaatgttatatgaaatataaccatggcacagctgcagaactaccaaatcagccctctgggtttttattctttggcttaacttgaagtccaagctaaaatgattacacaagttcctaagtgggaacttgatggtcttttataaagataatgagaaagcaaggtccatatcttcaaaaacttgttcttttcctcttaccacaatgtctattccatcatcccaccacatctatcttgaaagctctgataaactacactgtcagaatgtcacatcttactctttggcttatcacaaattctccctaggaagtgaaacacatcaaggagagtatgatgacctcaataggttcctttcaatgcttgaatacacacaataaagacaaccattaaaaaagaatattgatgatgtgtgtgcattcttaagagtgatggccctgtaggaaaatggagaaatcctgcagtgagcacttggatgtcatcagacttgagagaaacccttcaaatacaccgaagtgctgagccaaacatcaacactaatagaatgcttgtaaaatgatgcctgttacccagacacagtaaatgaagcaagagaaaaagctggagatttgtgggtggtttttagtgaatgtgggcagggttagagaggtacaaactcacagtgttctgttggtcaaatgggctgtgaagtataaatgagatgataaaaccatatagtgtcttttgttgtttttgtctgcccatcattcgtcttcacttctgatggcaataaccttctgattttacttgttgaacaactacttttatactctcaaaccatattaagatggggaagccttgggtctttttagctataaagattgacatgtggttcaggaatatttaactggagcatcacatctcactgaccacagtataagacatgaagagagtaaggccaaagtgaggaaaagatactcaattttataccttctgttgaaaatactgaaaagagaacatacttttccactagatttagaaattaacaaagtacaaacctgtggccatgggagattacctgtggttgagggatttgttttagaatgaagccaacacacatacataaacacacacaaagcaagtctgaaagatcaagagaggccaatactaaaaaattcatctgagttcctagccagctttcctcagttattattatatgtgagcaaatagtaatgcttattgtgttttgcttgaaattagtttgagttgtatttctgttacttgtactcctcaaaatagttgtgaaatatgcaaatcattaagcatctgccttacttagtttctcttaaaacataaagcctgaccaatagggtcttgtatgtagctaatttatttcaggaaataatcccaaggaatgggtgtgggaactggatagtaatgcagtaacagggaaagccagtccaaggttatgttatcaagtttaccactactttgaagcactggtaatcaatgcagctagaggcattttcaggattgctcatccaaggaatgaatgagagagtagccactgttacacacacaatatacagtgcgtggcagacacaggataatcaccaccaaacctttctttcaaaaatttgaaaacaggagggatactcttcaatggttcaaaggattctgaactcaaatgccagattcagtggtagagcagaaacttagcagcaggacttaacttggccatgattttttttgaatacctttcattggtaggtttatgtaatttgcacattcaacatttctgttttcatctacttttctttaactcatggttaaatactgattatagttatgcggaggtatagatttctttcctattatttccacaagattagcataagaagggtcagtcagtaagtacataagcaagcccagcttcctctcccgcctccatgtcacagccgtgattgcacagcctattacatgtgtgaagccttagttcttcaggtgttaataggaatcagtgattacagactaaaagacagagtctatgattaactacgaatttaatttttattagaacactgggaaatgagttcaggcaaagagactaattccaatcacttggcaatgcctgctgagaatattgtttcacatgcatttctgaggccatgtgtgaaaataaacttctttaacgatgaataagagaatagaaaggattagcaaacaagccctccctttgccattcctgataaaggggtgaaagggatattgtctcaggggatgagaggcggaaccaattattcagtggctctcatcacagattgtcaagagtaactgtagggtaccaatcctgcattcccagattatacctccagattgtacatgtataaatgttcagaagttttctgccatcatcctatatcttggcataggagttgctccagagcaagaagtgaaaaatacagggcacaaggccttcggaaaggcattatcgagttacaccagtggaaagcataatgacataaagaagtagacaagagatatccagtaaagatattcttccactgactctttatgacactagactgtaacagcctgtgctgatgaatcaaaaaattccctagagttttaccaatatgaggagtggcattcttgctgtgacattttaagaattatattttctggatccacagtctaaccatttattaaaaatcagatttaatctttgagcagtaaattatgtcatttgagcttagggtacagctgctagatgtgaatgtcaatggaaataaaaattaacagtgcaacatgctaataaaatagagaaattttatttcctaatagcattcctcctaaaagtgctaatagcctgacccatatttattcttactttctgcaaaagatgctgttttcaataagtttttgggaataacactgaccgtaatgaagcagaaaaaaatgatgaatgttaagaaattaaggtggtacataataagctataaaattgtacctctttgttgtccatgcactattggtgagcttgcacagttttagacctctttaatttatgattaaatagttttatatctttcagcaacagtggatataatttcctcatctatcatgagaatggtttaatactttcattaattcacacatcataaagcacagagtaatttttatacccactcaaatcactcattgcttctgttccagaaaagaaagcactgttttctgctaatttcagagttagacttaaggccaggatcttcatgagcaatcacaattagaaagagaaaacatagagacgggcttctattgccactatttctttataatcatgttttgggatattgttcagttttggaacaaatcagaaatgcaacactgtaatactggctgtgtgacaatggaagtcagtaatgatgatccttgagaacagggagttgttttcctcactgaattcatgaaaaatccctggatgtccattacctctttttcagtggcaaaaacctttgatttgctgagcacatgggctagatttgaaagtagcagctcaagacagaggtgaatatgtttgagccaattctctagagaagccctgagtcttatcatattcctttcatctaagcagcttctcttcagaaggctctctctttccgcttcagagataaccactcaaatttgtattcaaaacatactggcgagaggaaagaggcatttatactgtggtaataaaatcctgaagtgatacaggccccaatagaacttttcaattatggtgattttctaaaattgatgttgtataaataagagcatgtcctctgaaggaaaggccacttgtgggctgatagactgatcataatataaaagcaggctcagaagatactgtgctaacaaaaagcttgataatttagccccattgaaaattttgaaaatgatggattttacctgtctcatgaaattatatggaatctaacaccaagattgcaagattaagaatttaagaatgaagaaaggagatacataacctaataaatgaaaataacctatgatatgaatgaaaaatatgcagtattcctatctgtcacccatgtgtaagacatcattaatctactaaaaaacactgtcaagcagagtactgagaaaacctcaaaattttctgcaacataaaccttcaggcagacattcctaacctttcaaagagaaacctatacataatctctgctctatcatcacgcccagttttatctcacatataccccaatacaatatgtcagtgcagtggagaatgttaaaagtgggttaaaaaaatacccagcacttttacaaactacccagaactgtcctatcactatttctagaatacttactatttctcactttaccacatattgctgtgtatatatgctattttataatttatataattcttttatatatactaactcttgatctttataataactatatgaagtaaagcaagataaacagtattattattaatgcaagattaaaaattaaaaatgcaaaatcagcaaacaaaccaatgagcaaaaaatgaagattgagtgatatatacgtatgcatatatatatatatatatatttatgtttgtgtgggtgtatacatatatatatgcacatgcttgagaccaattactatataaaaagccagcaggtaaaatgaagtttaatactaagttattttaaaggtttatcccaagagcaatctaagaattatttgactacaactagaaacggccgtctagttttcctaagatctttcttggctcctatttttaactgaaagctgccctatctcatccagcaattctgctcccacataaatagcatctccagatgccaattttagagaaaaagaaagctaaatatatatatatatttatatatattatatatatttatatatcatatatatatattatatataatatttatatatcatatatttatatatattatatataataaatatataacatatattcatatatattatatataatatttatatatcatatatttatatatattatatataatatttatatatcatatatttatatatattatatataatatttatatatcatatatttatatatattatatataatatttatatatcatatatttatatattatatataatatttatatatcatatatttatatattatatataatatttatatatcatatatttctatatattacatataatatttatatatcatatatttatatattatataacatatataatatattatatatcatatcatatataatatataatatatataatatgatatataatatataatatataatattatatattatatattatatattatatattatatacattatatataatatttatatattatatatactatttatatatttattatatataaaatatatattatatattatatataaatagtatatataatatttatatatatataatgggaaaagagatgcccttctcataatctgggacatttttttcaatatgctgaaacacaggcaactgattactcttttagctgtctatgtgactggctataaatattaatgcaggtaactagctgaccttggtaaaacaacaggaatagtttttccttaatgattacctggattgtatagcatggaattgtggaaagccattagtggtgtcactgccaccctagtctcaggaaggatctgtgttcaaaaataatgggttgcattccatctttacagctacagcttcatccagatttatatatctaaattttttgaaagaagaaagtagcactaagtattttcctttaatcagaaaaattacttcacaagaaaaggcatccttacgtaaattggagcttttgaaaaacaactaagtggaagaccttaaaccatttaattctcagggttattatgctctagtaatgaagacaatattggcacaaggataggtgtattaatcaaaggaacggaatgagagttcagaaatagacccacatataggtggaaaattgatatttgatagagattccaaggcaatttagtatacaatgaatacttcctatttcaacaaatggttctgggataattggatagctatattaaaaacaagcaaacacacaaattttgtccatgacttcacattatatacaaaaataacttaaaatatattagatatgtaaatgtacagactataatcataaagtttctagaaaaatgcaggagataatcttagtgacctccaattagttgaagaatttctaataggaaatgaaaagtgcaagagaaatatataaatttagctcaatcacaattcagaactcttgttcttcaaaagatactattaaacaaatgaaaagtcacagagttgtaaaaacctgttttttaaaacaaatatctgacaaaggatacatatctaaaatgaaaagaaaatctataattaaacaaatacctaataaaaattgacaaaatacttgaacaacaacttaactaaataatgtatatgaatagtaaacaagctcataaaaagattctcaacatcattactcatcaagagaatacaaatttaagccctcatgaaatatcactatacctccactgtcagggctaagttgaaaaaactaactataccaagtgttagtgacaccatggagcaactggaactctcatgtactaatggtagaaattaaaatattgcaaccatttgaaaagcagtcatatagtttcttaaaaagcaaaacaaattatcattatatgacccagttattgcacttttagcatttacttaagagaaacaaaaacatatgttcacacaaagccttttatgtgaatgttcatagtaactttatttataatagcaactaataggccaggcttggtggctcaggcctgtaatcccagcacttagagaggctcaggcgggcggatcacctgaggtcaggagttcaagaccaacctggcaaacgcagcaaaaccccatctctactaaaaatacaaaaattagctgggtgtggtggctggtgcctgtaatcccagctactcaggagactgaggcaggagaatcacatgaacatttaaggcagaggttgcagtgagccaagatcatgccactgcactccagcctgggcaacagagcaggactctgtctcaaaaaactaaataaataaataaataccaacaaatatccttcaacaaaacatatatgaacaaattgtggtatatacaagtaacaatatgctacacaatattaagaaggaaaaagatattgacatatacaatgatgaatttcaaaataattatgctaaatgaaataagtcaaagtgagagtgcatacaaattctcctaaaataaaaatgttagacaaatttaatttaacagagtttatttgaggttcagagagttccaatctaacacttgggcagtgaatatttacagacagacacaaaagtagtgtacagaaagagcttgattggttacagtgaggcatttgcattagaacatcgtctgatcaattggttgctggtgattagctgaagcttggctgcttgtgattagctctgatacagctgttatgaatgttctatatatacacacacacaaatatggatatagacagatagatgaatatatatacattcctaagttaatttttggtttgtttacctgctgagttaggttgcagtttgttagttatgcagaaaatcaaggtacaaggaaagtatcagactaaatttaatttaacttttccatttaaataaaaatcttaaaaatgtaaactaggaggaagaggcagagcaagatggtcaaatagaaccctccagtgatcatccctcccaccccaccccagggactccaaattgaacaactattcacacaagaaagcaccttcacagaaaaacaaaaattgggtgatcaatcacagtacagggtttccctgaggagaggagtggggagaataaagagaattttgtcttgtaacttgataccaccagctcagccacagtaggccagggcaccaggcagggtactgatgcctcctttccaggctctagctctgggatgaccttactagacatatgctgggccagaagggaacttgctgccttgaaccaaagaacagaattctggcaggattcatcagctgctgactaaagagcccttgggctttgaataaacataaatgatagccagacattacttgccacaggccttgagtaagacttagcaccgtgctgacttcaggtgtgacccagcacattctcagctatggtggtcatggggagagactctgcttaaggaaaggagaaggaagagtaaaagcaactttttcttgcagcttgggtaccagcttgaccacagtcgttaggggagcaatctgactcctggagtttctgattccagaccttggctcctggatagcattcttgactcacattgggccagaggggagcccactgccctgaaagaagagacccaggcctggcagcatgtaccacaagctgaatgaagagtccttaggccttgagtgaacatcagaggtaaccaggcagtactcacagtgggcacggggcagtggtggccatgggaggaaacttctgcttgaggaaaggagagggtagagtgagaaggacagtgtcttgtgggttggtgatatggtttggctctgtgtccccacccaaatctcaccctaaattgtaataatccccatttgtgaagggcaggaccaggtggagataattgaatcatgtgggcagtttcccccacagggttcttgtgatagtgagggagttctcatgagatctgatgggcttcccctttgcttggcactcattctctctcctgctgtcctatgaagaggtgcctgctgccacaaccgtaagtttcctgaggcctccccagacatgtgaagtggtgagtcaattaaacctcttttctttataaattacccagtctcaggtatttcttcatagcagcatgagaacagactaaaatacttgggtaccagctcagccaaagtggaatagagcaccaagtagattactaagtttcctgactccaggtccaggttcctagatggcatttctagacctaccctgggcacggggtaccttaccaccttgaaaggttggatgcaagcctgattggattggatttgccaccccatgaccaaaaagcccttgggccttgtgtgaacattggtgatagccagggagtggttgccatgggccttgggtgaggccaagtgctgtgccagcttcaggttgaaccgaacacattcccagtgctcgtggccacaggggtgcttgtgtcactccttccttagctgcaagtagctcagcatagagagagacagactgttttttgaagaggtgggtgggggagtgggggatgcgggaaaatatgggaagaaaacaagagtttctgattgctaacccagggaattatctcagctattactcaagaccaccaagttggttcttctatgagtctgcaagagtcaccgcagtcttgggcttggggtttcatctaatgcagacgcacctgcagtgactaaagacttatatcacatcactcaattgcctttgaatatgtggaaagcctttccgagaagaatgagtacaaacaagcccatactgcaaagattacaataaagacctaactcttcagtgtctagacattgacaaatatccacaagcaccaaggacatctaggaaaatgtgacctcaccaaacaaactcaataaagcaccagcgaccaatccaagagtgactgagatatgtgatctttcagacagagaattcaaaatagctgttttgagaaagcacaacaaaaattgtactaatctgattaaaacacaggcaaaagatatgaatagacatttctcaaaagaagacatacaaatgacaaacagctatatgaaaaaggtgcccaacatcattgtttatcagagaaatgcaaagcaaaactataatgagacattatctcatcccagttaaaatggttttattcaaaagacaggcagtaacgaatgctattgagaatgtgaggaaaagggaaccctcttccactgttggtgaaatgtaaattagtacaatcatgaggtagaatagtttggaggttcctcaaaaaactaaaaatagagctaccatatgatccagcaataccactcttatgtaaatactaggtatatgcttactcaaaagaaaggaaatcagtatatccaagaggtatctgcactcccatgtttattgcagcactattcacaatgaccaaaatttggaaccaacctaagtgttcatctacatatgaatgaataaagaaaatgcggtgcatatacacaatggggtagtgttcacatattaaaaaagaatgagatcttgtcatttgcaacaacatggatggaactggagcaaattatgttaagtgaaataagccaagcacagaaagacaaacttcccatgttctcactgatttgtgggagctaataattgaaacaattgaactcatggagatagagtagcagggtataatgttaccagaggctgagaaaggtagtggagtggggtaggagagtgggaatggttactgggtacaaaaatatagttagataaaattgatattatctagtatttgatagcacaacagggtgatagagtcaacaataatttattgtacatttaaaaataactaaaatagagtaattgaaatgtgtgtaacagaaagaaacaataaatgcttgaggcaatagataccccatttactgtgatgtgattattacacattgcatgcttgtatcaaaatgtgtcttgtatcccataaatacatacagctactatgtagccatcaaaaaaaaattttaagggcaaactaatttgcagttgcaggaaataggatcagtgatttcccaagaaaggggatagggtagagaagactagattagaaaagggaaatatgaaatttggggactagctatacctattatattgtttgtggtggtagtttcacagggatatgcatttgttaaaactcatcacagtatacacattacatatcttaagttccttataccttatttttcaataactttaaaaacatgaatataatagagacatgtacaatgtgtactttagtcttcctataatgaactgagactaccttggtttatcacagtgaaaacaggcttatcacaggacagaactttgcatggccaagacttctgctcttacttccaaatgatattttcaacagatgcagaattataggttgacctttgcatttctgcagtcagttcaaacacataaatacattactttctcataagaagtcagctgtaagtcttatttgtactcccttgtacttaattgtttccttcttttctggctgctttaaagatgttttattataatcattattattgcttttcagaaagtaatttgtgacatgccttggtgtgattttctttttacttattctttttgcaattaactgaaattatctgataatatgggatatttttattaagtatatcactcattccttctgtgacataatacactttttccttaagatacatattgtcttccaaataaccaaggttctgtttcattttcttctatgctttagttaggatagattctattaccttattttaagattattgaaattcttctgtaatgttgaacttgctattaagcctaccaatttttcattttatttattatactattcagttttagaaattctattttttattttttatttatacatttcttataatttccatcttgttatcacattcatctgcttcaagtgtgtgtatacatttataaaattaatatatatacaaattaaatagatacacacacatatatatgcatgcacacacacaaacacacaaattcctttgcttatttgatcatcactataatttattttctgtttctattaactaattttacttctgattttaggtcagattttactgtttcattgcatatttacataattttcaataggatttagtacattttaaatgttatgtagttgaatgtctagattttgttgtgttcttttaagaaaattgaattttattttattagtggttagtttatttgtagattagcataatccttttgagaatttttaatttttattaaggtaagtgtagaacagcctttattctataactatttgggcctattcttaaggcaaggaatttcatggttttctactgaatgttctagttgttgaaaaaggtctcatcattctggttggtcagaactaaaaactcttctaacccacttcagtcctgtaactgtttaatttacagctccttggtcacaggttgttttcttcatcttttgttcccatttagacacatgtagtatcaccctgcacttgaacacattattattaagccaaagactcaagggatatacagctttctgaagctttttgtttaaatggctccctttgttcttgtattttaccccataaattccacctccctccattctacctcctccaacttggattcccatatctttaattcggcgagttctttatattttgctttatttcctcttcgttgcctccttgggggcagagttcagtgttttcagacagaaagccagaattattgtagggctcatcatatttctttttcttctctcagaagtatactcttcggctgtctactacccaatatctaaaagtatgttggatttgttttaatatatttttacaattttctaattgtttatatcataaagctaatccataaactgttactcagttataaacaaaatagaaattaaaactttaaaaacgaataatgattataacaaattactggaaacctactccatagcctaggggagagtattctgtaatggttcagagctcacattctaaagtcagactgcctgggttccaaccttgctcctgtctcattgcttatctgcactgagcaggccacttaaactctcagtgccccaatttccttatgcttttaaaggatgatgataaggctacctacctcactgagctactgtaggggataaataagttagtaagtgtgaaatacatagactagtcactgacaaaataagtgttacttaagcataagacattactatttatctgatgttcaataacttagctcatttccttttctaagcctaatctaaaatccatgttcattctacattaattctcgtcgtttatcattttcttcctattttattttctagtgaaatagtttgattcttagcattactctgattttatatggggtcaaattctaatctaagggatgaccagatgagaaatttgtttctccgggaagaattgttcccatttttactcagcacacaatttaaataaattgattttcttttcctgaggataatatatatcaatagattcgatgcttcatttatacattttatacctagaaaataattctcttcaaaagcatactgtcagaggatctgtagagtgtcactttaccagctgaaacctctgtggccagcggtgcctctgcttgggttttgctcaaaccctctgggcttgttccacccagttggcccagcaggctgtgcttggttcacattactggcccagatcccacagctgccaagggtgagccagtcacagagtggtgagagatgtgtgagtgagtgagtgcagggtccagccattgtgcacagccaggtgtgccagctgtgaagggagggcagctccaggtaccagcacaggtgccagctctgttcaaggcttgtgggtgaatgagacataccacaagtggcttccacttcaggtgctggggaacacagtggagtccaaaatctcagaggcgccaggaactgcagagacccagggagggtgttacagcccgtcacagcccaggcttcagaaaccctgaggtctgggctcccagaagggccgcagttctcctctccttcttgctgcccacagcacagcaagtggggaaaggggggcatgtttcagcctgtttgcattatagttctttcagtccttccacccattgcatggggcagccacccagcaccagtggagagtgggagagctatagtgttacagcaggtctggctcagggaatcctgaggtctgggcccccagaagggtcaccactcttcactcctgcaatctaagagcatgaaccgcccacagcttggcgagctgtccagggacatgttacagctccttatgctcctgccgttcagcaggtcctgagtccttgccctgcttccaggaagaatgaagttacacagtacactggaggatgaccaagatggaaagagctttattgagcaacagaacagctctcaggagacccaaagttgagagctcctttctgtaggcaagtcctcccagtgagagtctgagtttggctgagtctgaggctttcatgtgctcagaatggaggaagtgcatgctaattggtccatgggtggccatgggtaggcttcgaaaaagcaccatctgattggctggaaagcatcaataaagtattcactccaggttgcagacttcacccagaactggtagcacagccctcaggcttcaggcacaccctgacctgaaggtggggtttcagcagggatccaccttttcctgcctatgaacctgtctgcctcccatcatcaacatgccatccacggcacccaggctttccacaccaaggggtgcctgcaggcctacagtgagcccctcagcctccatcccacaatcattagtgcccaaagtctggaggggccaaggtggcaggagactggcatgtcaatgcaaccccaagcatgtacacaccccgtcaggtggcaacagcactggggcttggccacaactttgctccacactggggcagtcactgggagtaggaagaggccacatagcaggagcaggcacttccaagcctgtgagagttgagtgcttcctgggccccaagagcgagggatgctgaggtccagtgccatggctgtgcagctgcagatgtgcacaggaacacggcctgtggccctgccaactcagtagggtgtggggctccctctgtgatcacctgttcctggcccctgctgggctccatggaacacacagcccaggccccacctaccctgctgcagctggtgtcctcgaagtggccactccagaaaggctgccaccaccatcaatactatccagtctttcaaatggaaccactggcaatggcatttaccttgactaagaaaattaagatgtttgtattaaatctcatcatatttactttccttgaatgtactgcatacaaattagaatctctcatgttttgctacaatccacacccccgaagtactcatatatgattaaatttgctttctgtcctttacttttcagatgtttgtatagactggattttacatgggtgacctcttacaggtcttttccctggatatcaatttgttatttcatgaaatatttcaatagtatgcctggaaatgagactggacaatttgcaaccatctccagcactgctctagagctttatacaattatagtgtaattaaataagtttaaaaataataaaagtagaatatttaaagatcttaacagcattttaaatagatttttaaaatatgctattactttagaaattaaactgcttttgatagccagtgaggagatgagcttttaaaagctatgtttaaaaatacatttaaattaaaatgtagttataaggtataatgcagtgacttataaagcgtcttctggctcaaaaaacctaacagaagtaaatgccttctgtacatttagtcatggcttatggcatctgtattatgcaggaggaacagtaacaaatttagcagctcaatgagaacaccagaatcagttcaagtttctctatatttttgccaaaatttattacagtcaccatgaacaaataagggtttaattttttaataagatatttatttagtattcaaaaaactattccgaaggagttgaaatcagtatgtcaaaaaggtatctgtactaccatgtttatcacaggactaatcacaatagcaaggtgtggactcaaattatgtgtccatcaagggatgaatgaataaagaaaatgtggcatatatacagtatggggtactattcagccataaaaaagaatgaaattctgccatttgcaacaacatggatgatcctggacgactttatgttaaataacataagccaggcataggaagacaaatagtgcatgatctcactaaagaagttgattatatagaagaatggttgttagcagaggctgaggtggttaggcaggagtggaggatggggaaatattgctcaaatgatacaggattacagtaagataaaaggaaaaaaatgcaagagatctattgtaaacatagcaaggtgactatagttagtgctgatacattgtatcaaaaaatgtagaaagagtggatgtcacctgttcttaccacagaaatgataactatgcaagataattcatttgttaattagctaatttaactattttacagtgtacatgtacttcaaaacatcatgttgcacatgataaaaacatacaatcttatctgtcagtttaaaaaaggcaaacaatttgccttctcttctaagggtatttccaagtcatttaaaatggttacattttttgatgacagcattgaaaagcaaatgcatttttttattggacatgaaattgctgaagttcattttaattaaaaatgctttcaaacaattttatattctttataaaattaatgtgctaaagtattatggacttctggtttccagtctagcatgtcatgagcttagaagtcaacaatccatcctaataacaaatataaagctgagcaaaatgaaaaatcaacaactcttctaagatttttagatctttcagagaagtaaaagttcagtgcaaaccactgccatcctcccaaattggagaaacagacaggcaaatactgagtgccacaatttactgaaatacaaacccagtagaagaaatctccatgggtaccagtggtaggttaggaaaacctgaattctaattgacaaattgctgaaagcttcacgtgaacaaatctgagtgtgaaaaactccggaaggatccaatcatggtgggaacccccacttttattttgcctccaggagtttgatctcaccctcaaagtgaatatcagagaaaaatctccccatacttccatgggggtgcagggagtaaccattttgaaatatgtcagaacattctgttcttactaaaagccctgccctaggagaaataatttatgaggctctagcctgctggggttttttagagcctaacctacccaagggagtggataggcacccaactctaaccacccctagtcatccatgtaggggaagggaaatatccaaccgcagtactctctagtaatcctgtcccaactaaagatgagaaaacaaaaacaaataaacaaacaacagaaagagggagtgatgaagtccacaggccaggggcacagtctcatccaaagtctaagactaatcatggaaatagaatgcttctcctccctcacaccttgctactacattgctaaaggccttaaatttaacacacattcttttacccagtacatcatatctgcctttcagtaaaaaattacaaggcaatttagtagaaaaggcaaaacacgcagtttgggaatcagaactaaaatcagatgtagcagtaatgttagaattatcagaataaagaacaaacaaataactatgattaatatgctaaatggtttaatggaaagtgtagataacatataagaacagatgaatgttagcagagagatggagattctaagaaataataaaaacatgcaagagattaaaacactgtaatagaaataaagaagtcttcaattagcccaccagtagattagacatggctaatgaaaaaaatctctgagcttgaggatataacaatagaaacttccaaaactgaaaagcaaagagaaaaagaatgaaaaaaaaaaaaaaaaaaaaagaacagagtatcaaagaactatgggacaaatacaaaagtgataataaacagtttgggggaatataagaagaagtaagagagaaaggaacagaagcaatatttgaaacaataactgaaaatttccctaagttaatgtcaattccaaaacacagatccagcaagcttagagattagtaaacaggataaatgccaaaagctacacctaggcataacattttcaaactacaaaaaaaaaaaaaaaaaaaatcaaagataaagaaaaaattctaaaagaaaccagaggcaaaacaaacaaaaaaaccttatgtatagaagagcaaagataagattgcatccaccttctctcagaaaccattcaagcaaaaagaaagtgcagtgtaatattttaagtgttgagagacacttaaatgttgagaaaacaagtattgaaagaaatattcaaaagaaaacaccaaccaaattctgtactctgtgaaattaaacagtgaaagagaaatactttctcaaagaaaaaaatgagaaaatttgttgttaatagacctgaaaatgttaaaagaagttattcagaggagagggaagaaacttggatctacattttaaaaaaaggaagaccatgacaaggaataagtgaaggtaaaatgaaaacttctactttttaaattttaaatgatataatcattttcttgtttaaaataataataccaacaatatatttgtgtgtgtgtgtatatatatatatatacatgcacacacacatttatatatgcttaagtgaaatcacagcaatgatacaaggggtgggagggaaaactgggaatattttgttattataaggtacttgcactacctgtaaatgctattatgttattttaatgtgacctagattaattgtgaatatacattgcaaactctaggactatcactttatcactaaaaatgttttttaaaagtataattgatagaaagtggagaaaatggagtcagataaaatacataattaaaaccataacagacaaaaaaatgtgtggaagacaaaaacaggaacaaagaataaatacaacaaatagaaaatagtaacaaatatggtagaaattaatctaatgatatcagtaatcaccttatacctcaatcgtctaaatacactaattagaagacagattgtcagatggattgaaaaacaagatccaactatcatctacaagaaacccacttgtaatatgaagacacatttagattaaaagtaaagaggtagagaaagatatacaacgctaacactaattaaaagaaagcaagagtaactatattttctttagacagtacagacatgagagcaagtaaagtgatcagggataaagaagatactacatattgatacaaaagagtcaatactccaataaaacataacaatccttatgtatccaacaatagagcatcaaactatatgtgaaaagaactgatagaacttcatggagaaatagatgaatccactattacagttggagaataaacatccctctatcagaaattgacagatccaacagccaaaaaaaatcaatgaggatatagctgaagttaccagtactatcactcaagtggatatagttgacatctatacactacttcacccaagcacaccaggttacacattttttttttttttttgcacagagaacattcactaaaatgcatcacatttcagtacataaaatacacttaaggtattatgatctattttttaaataaataattgtttgccatttaaaatctttgaattttttttaggacaagctgaaaataattaaagagtgagagaaaataatgaatttctgaaattctttctacagtctcaaaactatgtactacaaaattacagactaataagtaatatagctggaaaagataagaataccaaatatgaaataatgctatgacattacctattgtaaaattaatagttcatctgtaatcattgataaagaaactggagaggcaaaaactttagaagtcaatacataatataacttataacaaagcctcctaaattatttaaataaacatacttagaacgaccaaactatcatgaattcaaaaaatactactcagaacattataatgccttcttcctacttctatatacctaaaattgctaaagtatggtgttcaagagttcgcaggacactttgggagaccgaggcaggctgataatgaggtcaagagattgagaccatcctggccaacatggtgaaaccccatctctaataaaaatacaaaaattatgtgggcatggtggcacgtgcctgtaatcacagatactagggaggccgaggtaggagaatcgcttgaaccagggagttggaggttgcagtgagccaacatcgcaccactgcactccagcctggtgatggagcgagactccatctcaaaaaaaaaaaaaaaaaaaaaaaaaaaagagttcacagaaaaagagagaaaacaagtagaccactcaaaaggttccctaaaggacatgggacatgcactgaatcttcttaaaataagtagggtttggatgtgtagaatgaaaacaaagagagaatatgagcaataactgcacagatggtaaagaacatggctagggttggaggcactctggagtgggtttggtaaccatcacgttcatactgagcattggtcccaaaacattaaataaaaaagaataggtttcaatgaataataagtttgtttcatatgggcacaacaggaataaaaaaattcaaccttgatatcctatttcaaataataccttgagagaaaagaaattaagaaaccgtgggttcatttccagattgaagaaacagtaggctgagtattccacactgtaagtgaaatgaggatccaaatcagggcataccttgtcaaatgttagaattcaaaaagaaaacagaagactgtaagcatttccagagctaaaacagaagggaaaatacaatggcatcaggcatctcaatattatcatttgtgatagaaaaaataccagatcgatgtatttgataatattataaggaaaaaaaatttcatcctagaattacatattcagcaaaactctcaaagcaattttcagatatacataacctctcttcatcctctcatcctctacctcttccctctccttttcctccccctctcctgcttctctctccctcttctacactttttcttaggaagctactgactgtgaacttatctgactctgtggattaagcaaaacaaacaaacaaacaaacaagtaaactaacaataatcaagagactagaatttaagaaacaaaagatacactcagcagacacagtgcataaagaatgcaacctactttgtagtaggagactagaattctacaaactggagctctccagaaaaataaaaacgcaatcaatagattctgagataccgtttagaatttggaaagagaaatattgattggcatatgaaaggtcaggtatagctcatagaaagctctgatttgcactgagaagtacctgcaatatcataccaaggtaaacagtgactacttatttaatgaagcattcttatatatgtgctggatgtttccaggtcaatttggttaggtggaaactgagctaaaatgaaactatgtatcctagaatcccgagtcttgtatggtcccagattaggattaacaacaagagaaattggcatgagatttggaaaacgaaaatgcaacagctgcattaatatcagaaggtggatgtgggcagatacattcatgtatagatacaaaacagttaaatacatccagtttacctttattgtactcagatttgcatctggttcattttccacactgcagactgagcagccataagccctcaaccggatgaaaccacaactgtggaaccatagaagtggccatctcatagcagcacactttcgcgtctatctctcctttagctttcccttcacagttcagttttggtagctggggtttgcttaaattttcacatttcactaaaagctgacttgctcaactatgccagtgcttcacaaaaactattagtgatcctgtctcaaatccttcaactcatttccgacctttacctctccagctccagccacagatctgacatctaaaataaatctcttaatcccataatactgtactctgcctccatgattaaagattcagaagattcagatattggtattagaagtgtttccatagaaagagatgcttaagggtagaaatctagaattggtttgtagatctaatgagatttgacaggactaattacactgctgcaaggcaaaaacagaatgttggtattctctgttggttcattgcaaaaatatgactaaaattagaactgtcatcacctggagtgaagtgctttcaggcggcaaggctttgggtgatccagtagcagttgccgtagagccaaagagcaatttagtgggaaaaaaagagcacaatgactggttattttggattgcttctaacagtgctggatactttgaaggaaaaaaaaaaaaaagatgagctcaggagttcaaattcctaaacatttgagtaagcagccagaatacttttattctgccctaacagtactctaggaatggtattaagatttctgaaaacctaaacccaagactaaacctggcagattctcggattttcatgttaggatattgttggaaagaagagggacattgaaaagggaaatgaagatatacggtaaaattctcacgagattgaaaatcttgaacctataaattcttcacagtgtcaatttccagtagaagcagcacattctttcctatctgaatatattattatttttttcttttcctaaataacttgtaatgggctcccctgaggtagttgccttctggggaaatgcggattctgctcaggacctgtcatgcaacttctgtttgcatctaaatttataacaagatttagtgacagcagcccccaggagactgaatatgaagtatgagccctgaggagggacatacacaacaataagattgtacaaccttaacaatttactttatccaatcttgaattatgtatgggaattcattatgagaaatttggttctgagtgaatgaaatgcattgttgggttaagctaactgcttcaaaggggtgcactggctgaaatccctggattcagtaaaggaaagagcaatgaggaacaggtcaaaccgttttcttagtcaggtgtctgaaaattaatttacaggtggtctgcactgaattaagttaagatgtcagaatgttattggttgactacagataattttttaaaactttgaacactcaacttcatacattatgaaagatttgttcaacccagaaggcggtgaattttctgtcaaagaaaatagggccaaaggtatagaatactctattgcatggatagtaactagtggtttgtctggatgctcaaactggaaagaaagaagacaatggaaatattggtgatcaaagggtctagagaataagtatgcccatgcttacagaagagtattctcggcttggaggaaatctcagaaatcaactggttacgatgaactactcaatgagcgccatttagcctctcttcctaggcctccttttccctgcccaatgggctcatgaataaatcagccacagtggtagaactatagtttattcatggtctcaagagacttggacttcacttcatcaaggttaatcttgttacagctaccattgacacttcagcctgccaacagtacagattaacactgagctcacaattatccagggtgaccatggagccactgaatgactagctgattacacttgagtatttccatatgaaaggaacagtgtattgttctcaatggaataagcatttattttggaaaacggatgtgcgtttctgactataatgattctctgaaaataaaattttataggatgccttaattactgtcatgcatgccacctagcattgcttcttatcagggaacgcattttatagaaaatgagtgtagtcgtgaattaaaaatcggaattcatggtcttatcccattctacataatcataaagcaaactggtttgacacaatagaggggtgaccatttaaaatgcattgatggcatcagagggtgacaacactttgaggctctaaggtaggtcttctaggatttgttatgttctccaaatctgtgatcgataaacagtactctttctcccatttccagagttccaggatccaaggaggaagggaggcagataatgggtattactctattgctcctgcctgatcatccactagaaaaaaatttcctgcctactacacaaatttaggtcctgcttgcttagaggattttggtaccaacggacagaaacttccaaaacagtaaacaataaaacgattttatttaactggatgcagatgctgccatttagcaacattggtcttttcatgccagtgaaccagtaggcaaagaagagggttactttactgtttggggtaattgatcctgattaccaagggaaaattggactgtttctgaaaacatggagttagaaactaatatgactggaatatgtaatgtcctatggcctcctacttgatattactattttaaaatgttaataataaacttcaataacgaaacataggcaagacttctaatagcacaggtatttcaggaataaaggtttgagtcttctcatcggatacggaattatgacagtatatcttagtttgtttgtgttattaatggaacatctaaggtattaaaatgccattaactaataaagcatacaaaggacagggctgcaacaggcaagccctaggctaagttttgttcatggtttgttgagttttatgctgaataatattaatgacttgatatgatatcaattaatgtcttaacatgacaattataaagtgattataattaaattcccaaaataaactatataagcaaatagaatattaaacaactaagttgcataatatatcaatagaaaccttgcataaggaataattaatcaaattacacaccaaaaaatgttagacttgttagaaaaccttcacattgtcccttttcacagtaagaaggatgagacctcagccactaagcagtgactctgtcctacttccttacccagtgcaagcgtgccttaaggttttggtagttgtatgatactactgaattctgagcctcttatgaatgtagatttttttcttagttataccacttattaagcaagtactatactaaacacttcagatgcctcgtgtcacttaatactcttaagaactcactaagaggtattatgttcccattttagagatggaaaattgagtttcaccgaggtaaggtaatttgtctgtattctaacagcagaagtggtggagccaggatctaaaactcggtctcactgatttcaaagccttcctttttttcctaccaccttctatttgcttgatagtcaccttcttcccttatttattagagcttctcttactaagcttctagattctatgagacagacatagtagactatctagggctttcaattgaatggttgactctagacaagcattgttcaacagatatataatgagagattcatatataatttaaaattttctagtggccacactgaaaaaagtaaaaaataagagttaatatgaatttccatatattttatttaactcaacaatccaaacgttatcatttcaacatgtaatcagtataaacctattaatataaggcatattacacttacagcatccacagaactagctccatttcaaatgctctatagccacttgtggatattatattggttagtgtagctctagactaaacattaaacaggaagtctgattatattgccccttataagtgaagtcttggagaaggagagggtaggtgtgcgatggaataggttgttcaaaaagtccgccactaaacataaaaaattagctgattttgcctttatcttaattgactgatttgtcatttatgccattcacaggcataaactgcacaaagctctgagaatagatagtgttaaagtgaaaatgcacttgacaaagttaaataggcaagaaaaactatctaagactattgcaatagggaaagagattgatttctgctctgctgaaacaaaggttggagtttttaagagctgcagttggaggatcataggctatcagggtttgctaattagccttaccctaaagaaaagttaattactcttatctttatagcaagaggtagttattcaactttgagcaagacacctaagaaagtgagactccttcctcccatagagactggaaggtgtaccatcatctttagggatcacattgcaaacgcataactcctaggtctttaataaagatttcccctgggtcctgtaactggcaagagtcttttaaggcaattcatatacaattcaaaggaggtagagaaagaatttacaatgacaacttttctaaataaatactctaagacaagggaaacaaaggggctacagtcaggaggatacctgtttaaagttttgttaaaccagtgtgtcttttaaggctgttttggtcaataacttttcacaccccccttttaccctcaatcctgatgaacaaaaaactttccttcatcaaagtcacatttgccaaaacttcataactgtttaagtgcccaaaaggtattcctgagggcttcatagatttaaggtttttaagtttgtttgtttgttttaacaagaaaatttctttatctttccatgttggtcataagggaagtctgaaacaacaaagagcttagacagtaaaagaaaccctgcagtttctcttttctctctctgccctcagatatctatcaataatcaaatttgagagaagagagattgtgggaggtccagcctaaatcaaaacccacaaaagcaatcagagaacacagtaagaaaagcaagaagaggaacgaggcactgaggggagtgaggaaaaggaaagataatgaagtgtagtttccttgtaccaaggagaacagaagaaaactccagtaaacttaagtgcagcatatctgatagcgtgcccggtgaagggtatgactgttgatcactaatacactgtatcattgatgttgaggtggagtgctatcaggaagagaattcaactatcaagagaaaattcccttctttattgttccagacgtttgagtcaactgacatcaaaatattctttttctataacttatgggaatatatactgttctgggcaattgagaatacccaattgaaaattggagagaaaagatgaacagcaagacgattgttgatcatggtaataggcagaaaatatgaagctgcaaaggattagttggaagtattttcatcaaattgaaatatcctctggatctatatccataaagactactatagtgagagagaaagagacagtaacatgactaagttcttttgaatttctttatgtaagagatgtcatgagaaggtaactgcatggggtttagaaattagatgtcatttcaagcggttttcattcttcaataacaaggtttttttttgttttgttttgttgttgttgttgttgttttttgagacggagtctcgctctgtcgcccatgctggagtgcagtggcgggatctcagctcactgcaagctccgcctcccgggttcacgccattctcctgcctcagcctgcctcctgagcagccgggaccacaggcgcccgccaccatgccctgcccggccaactttttgtattttttagtagagacggggtttcactgtgttagccaggatggtctcgatctcctgacctcgttatctgcccgcttcagcctcccagagggctaggattacaggagtgagccaccgcgcccggccaagattttttacttgtatgaaaggaaacacattagttattgcaggggacagacactgaccctgcaggttggctaactactccgatttcctacatgtgataaaatcactcagcagttacaccaaccttggatagctgatatttggatttcatttgatgtggaaaacaatctcctgaaggtttaagtctgtacagtcagaaattttgttacttgcagctagagacattccgcattaatataacttctaagcctaccgtacttacaactaaatgtcggaggccatggtgaatttcctttgcttaaatttaaaataaaaattaagagagttactgatcaattaatgagttttccatgtgcttcaggtaaaaatgagggaagtattctaccttcctgttctcttagttttcctgatgattagcctgtccactctctatcattcacccactcttgaggaaatagaaatcatataattccattgatgcaggacagacgaaccccaaaattggtgcttagaccagaagggttcttggctttgcccaggacagaattcaagggtaagccggcagtgttagacagcaacttttattgaagtggcagtgtacaatagcagcagaggctaccccataggcaatgtgcccagagtagcaactcagaggcagttctgcagtcatatttatactcacttttaattacatgcaaattaaaaagcagattatgctgacatttttagcaaaaggctagtaatttctgggtcagtgggtcattgccatagaaagggggattaacttgtaggttttgccatggccatggtaaaccgacatggcacactggtggtgtgtcttaatgccaaggtgctctctcctcttccttatttaagctagtcctaaatttggtctagtgttcaagctccatctccagaattcagtcctgcctcctacttcattcccctctcagagattagaagctccttaatataaaggggctgtagaagggtagaggtccaacttctgtaactcttcctgctaattttatgggcatagaccatgcctaccactgaagagtaaatatttccgcctacctgatcttaggatcccagagacagaatgctttcattcttcaggtcagaaagttggaggggttggaagccttttgccaacattgtcttcacctggaactgttgtaatctagaagacacaaactttattaagaggttaaacaaacaagggccaaagataagtaataacgagatagttattaaaagccctaggagaggtaaaaaccacatgagacttgcgaaggcacttttgatagtcaaccagatatagttgaggtcaatgccctggttatatctatgtaacaaggtagcttgtgcacagatatttgaatgttaacctcaatctgtcagagttgttaatatatgtgcatcaattttattaataactcacagactctacctcgtgtggctagtaaataatacaatgacagtctgttatcgagatctacatttgccaaagagtctagggactctcgaattctctttactgcctgacctgtgttgatggctaaggattcttggggttaaatcaaattttcaggattgattcatggtaaacaaagctgcccaatggtgctgctagttctagtgccacctcaattcctgtcagaattattcctagggttcatttacttctggtattttggggtcttatgaggttatacactgtgacccttggaggggtaagggtggctaatgtatattcacctgtgttccaaggttttgatatacaagagaaaggtactataaaagaacaagtggctccctgggaattcgggcaggtatggagtgtgaatttttcccactgatggccacaaatgaaagcaaggctagttggggcacaaatagaagccctaaggggtgtgatatctatcctttgatgctaagctgggtctttggagatattctttcctgttccaacggggatggctgaataacctttgttttccagaagagggcagtactcccaccttcccagattagtcagctgtttttgtttgtttctctgttttttttcctgtatgttctgatctgggtgaagacaccatatatggtttcctcacccataaaggggtcctatttatcttgctatggtattgggaactagagttggatcaaagtattgcaagaaaacctccacttttgtgtcattaacacagcagtgagttcaaaagatagaatgattagtgcactggaaatatagatacccaactttccaggtccagataatagtggtggtggggttctgacggaatccattaagtggggaagagtttcatctagcaagtaggggcctggggagatgtccatgagattttatggataagccagaagatggaactatctatcctggggatgttgataaacctatcaaccatgaagatgattccctgatgctatattttttgaaacacttaaaatagagttttgttttcatacatactggatcaggataattgggaaagcaaacaggattaatagtgatagcatggtgtccagatgggccgtagagtgacctctatacccacggacaagaaagatgtttcccaggagaaggcagatgccgaaagcaatagaaaagaagtattatagccaggaaggaaataaaaattaatgctcctgtttccatccacagcatcacactatcacttctgactgagtgttgattcttttaaatataaatctttcaaaggttcacagttgtagatcatggtatcctctctttgtacctgtgactcttgagacacagatttaatatttgataggcgtacataagtaattatttcctgacattgtacagtggtgggggaatttaacaatgcctgataggggtatttccattttggttataattgatcctcagcagattcttcttgttagtaagactaagtctcctggttgaacatgggagctgttcttttcctttgtggggaagggcaatattttattttcatcttgaaggaccttttgaagctggcctaattgacaaagaaaaaggggaaggtatagtgaggtacgtctaacccctctgtttctcactgtggcctgaattaggtttttgggtttctttgggattctctttggccaagagggaggtgtccattaagtctgttggggagctatagattttaatttttttgttcagattctcccttttttttttcaaggtgtgccagagcgagtattgatggtcaaggttttattttctctcatactgatgctggggtggtgtgctacctgctctaaatccgtcatgttcctcagagggacccccatggccaagagacttggagccaaaagactgactttatagccaattaaacagtctagagcaggtgggaatggaggtgggcaggcacttattagcccttaaaaccattttaagcaatgaaagagtccaaaattaaagccaatattaaagttacacctgaagaaaaaccaagagcatagaattaagctatattgaactagggaggagccaagacggccgaataggaacagctccggtctacagctcccagcgtgagcaacgcagaagacgggtgatttctgcatttccatctgaggtacccggttcatctcactagggagtgccagacagtgggcgcaggccagtgggtgcgcgcaccgtgcgcgagctgaagcagggcgaggcattgcctcacctgggaagtgcaaggggtcagggagttccctttccgagtcaaagaaaggggtgacggacgcacctggaaaatcgggtcactcccacccaaatattgcgcttttcagaccggcttaaaaaacggcgcaccacgagactatatcccacacctggcttggagggtcctacgcccacggaatcttgctgattgctagcgcagcagtctgagatcaaactgcaaggtggcagcgaggctgggggaggggtgcccgccattgcccaggcttgcttaggtaaacaaagcagccggaaagctcgaactgggtggagcccaccacagctcaaggaggcctgcctgcctctgtaggctccacctctgggggcagggcacagacaaacaaaaagacagcagtaacctctgcagacttaaatgtccctgtctgacagctttgaagagagcagtggttctcccagcacgcagctggagatctgagaacaggcagactgcctcctcaagtgggtccctgacccctgacccccgagcagcctaactgggaggcaccccccagcaggggcacactgacacctcacacgacagggtattccaacagacctgcagctgagggtcctgtctgttagaaggaaaactaacaaacagaaaggacatccacaccgaaaacccatctgtacatcaccatcatcaaagaccaaaagtagataaaaccacaaagatggggaaaaaacagaacagaaaaactggaaactctaaaacgcagagcgcctctcctcctccaaaggaacgcagttcctcaccagcaatggaacaaagctggatggagaatgattttgacgagctgagagaagaaggcttcagacgatcaaattactctgagctacgggaggacattcaaaccaaaggcaaagaagttgaaaactttgaaaaaaatttagaagaatgtataactagaataaccaatacagagaagtgcttaaaggagctgatggagctgaaaaccaaggctcgagaactacgtgaagaatgcagaagcctcaggagccgatgcgatcaactggaagaaagggtatcagcaatggaagatgaaatgaatgaaatgaagtgagaagggaagtttagagaaaaaagaataaaaagaaatgagcaaagcctccaagaaatatgggactatgtgaaaagaccaaatctacatctgattggtgtacctgaaagtgatgcggagaatggaaccaagttggaaaacactctgcaggatattatccatgagaacttccccaatctgacaaggcaggccaacgttcagattcaggaaatacagagaacgccacaaagatactcctcgagaagagcaactcaaagacacataattgtcagattcaccaaagttgaaatgaaggaaaaaatgttaagggcagccagagagaaaggttgggttaccctcaaagggaagcccatcagactaacagcggatctctcggcagaaaccctacaagccagaagagagtgggggccaatattcaacattcttaaagaaaagaattttcaacccagaatttcatatccagccaaactaagcttcataagtgaaggagaaataaaatactttacagacaagcaaatgctgagagattttgtcaccaccaggcctgccctaaaagagctcctgaaggaagcgctaaacatggaaaggaacaactggtaccagccactgcaaaatcatgccaaaatgtaaagaccatcgagactaggaagaaactgcatcaactaacgagcaaaatcaccagctaacatcataatgacaggatcaaattcacacataacaatattaactttaaatgtaaatggactaaattctccaattaaaagacacagactggcaagttggataaagagtcaagacccatcagtgtgctgtattcaggaaacccatctcacgtgcagagacacacatagtcccaaaataaaaggatggaggaagatctaccaagcaactggaaaacaaaaaaaggcaggggttgcaatcctagtctctgataaaacagactttaaaccaacaaagatcaaaagagacaaagaaggccattacataatggtaaagggatcaattcaacaagaagagctaactatcctaaatatatatgcacccaatacaggagcacccagattcataaagcaagtcctgagtgacctacaaagagacttagactcccacacattaataatgggagacttataataacatataacttataatacataataataataacaccccactgtcaacattagacagatcaacgagacagaaagtcaacaaggatacccaggaattgaactcagctctgcaccaagcagacctaatagacatctacagaactctccaccccaaatcaacagaatatacattttttccagcaccacaccacacctattccaaaattgaccacatagttggaagtaaagcactcctcagcaaatgtaaaagaacagaaattataacgtactatctctcagaccacagtgcaatcaaactagaactcaggattaagaatctcactcaaagccgctcaactacatggaaactgaacaacctgctcctgaatgactactgggtacataacgaaatgaaggcagaaataaagatgttctttgaaaccaacgagaacaaagacacaacataccagaatctctgggacgcattcaaagcagtgtgtagagggaaatttatagcactaaatgcccacaagagaaagcaggacagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaatcaatgaatccaggagttggttttttgaaaggatcaacaaaattgatagactgctagcaagactaataaagaaaaaaagagagaagaatcaaatagacacaataaaaaatgataaaggggatatcaccactgatcccacagaaatacaaactaccatcagagaatactacaaacacctctacacaaataaactagaaaatctagaagaaatggatacattcctcgacacatacactctcccaagactaaaccaggaagaagttgaatctctgaatagaccaataacaggagctgaaattgtggcaataatcaatagtttaccaaccaaaaagagtccaggaccagatggattcacagccgaattctaccagaggtacaaggaggaactggtaccattccttctgaaactattccaatcaacagaaaaagagggaatcctccctaactcattttatgaggccagcatcattctgataccaaagccgggcagagacacaaccaaaaaagagaattttagaccaatatccttgatgaacattgatgcaaaaatcctcaataaaatactggcaaactgaatccagcagcacatcaaaaagcttatccaccatgatcaagtgggcttcatccctgggatgcaaggctggttcaatatacgcaaatcaataaatgtaatccagcatataaacagagccaaagacaaaaaccacatgattatctcaataaatgcagaaaaagcctttgacaaaattcaacaacgcttcatgctaaaaactctcaataaattaggtattgatgggacgtatttcaaaataataagagctatctatgacaaacccacagccaatatcatactgaatgagcaaaaactggaagcattccctttgaaaactgcacaagacagggatgccctctctcaccactcctattcaacatagtgttggaagttctggccggggcaatcaggcaggagaaggaaataaagggtattcaattaggaaaagaggaagtcaaattgtccctgtttgcagacgacatgattgtttatctagaaaaccccatcgtctcagcccaaaatctccttaagctgataagcaacttcagcaaagtctcaggatacaaaatcaatgtacaaaaatcacaagcattcttatacactaacaacagacaaacagagagccaaatcatgagtgaactcccattcacaattgcttcaaagagaataaaatacctaggaatccaacttacaagggttgtgaaggacctcttcaaggagaactacaaaccactgctcaaggaaataaaagaggatacaaacaaatggaagaacattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcccgcatcaccaagtcaatcctaagccaaaagaacaaagctggaggcatcacactacctgacttcaaactatactacaaggctacagtaaccaaaacagcatggtattggtaccaaaacagagatatagatcaatggaacagaacagagccctcagaaataacgccacatacctacaactatctgatctttgacaaacctgagaaaaaccagcaatggggaaaggattccctatttaataaatggtgctgggaaaactggctagccatatgtagaaagctgaaactggatcccttccttacaccttatacaaaaatcaattcaagatggattaaagatttaaacgttagacctaaaaccataaaaaccctagaagaaaacctaggcattatcattcaggacataggcgtgggcaaggacttcatgtctaaaacaccaaaagcaatggcaacaaaagccaaaattgacaaatgggatctaattaaactaaagagcttctgcagagcaaaagaaactaccatcagagtgaacaggcaacctacaaaatgggagaaaattttcacaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaatacatgaaaaaatgctcatcatcactggccatcagagaaatgcaaatcaaaaccactatgagatatcatctcacaccagttagaatggcaatcattaaaaagtcaggaaacaacaggtgctggagaggatgtggagaaataggaacactcttacactgttggtgggactgtaaactagttcaaccattgtggaagtcagtgtggcgattcctcagggatctagaactagaaataccatttgacccagccatcccattactgggtatatacccaaatgactataaatcatgctgctataaagacacatgcacacgtatgtttattgcggcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaaccatcattctcagtaaactatcgcaagaacaaaaaaccaaacacggcatattctcactcataggtgggaattgaacaatgagatcacatggacacaggaaggggaatatcacactctggggactgtggttgggtggggggaggggggagggatagcattgggagatacacctaatgctagatgatgagttagtgggtgcagcgcaccagcatggcacatgtatacatatgtaactaacctgcacaatgtgtacatgtaccctaaaacttaaagtataataaaaaaaaaaaaaagaattaagctatattggtgaaaaacactggttccacagacctctaagacacaatgttttagcatcaggccataacagaattggggagaaaaactcacaggagctgatgaaaaacctaaagaagagagacacgtgaatctatgaagcttttaaaagaaatagattacagaactgaaaagtaaaatttctgagaaattggcaaattcatatcttaagaaaattagttttaacatgtagaaagtctattataatcattttctttttaattttttcaaatggagtctcactttgtcacccaggctgcagtacagtggcatgatctcggctcactgcaacctctgcctccaaggctccagtgattctcctgcctcagcctcctgagtagctgggattactggcacctgccaccaaaccagattaagttttgtatttttagtagagacatggattcaccatgatgttggccaggctggtcttgaactcctgacctcaagtgatcagcccaccacagcctcccaaagtgttgagattacaggcttgagccactgcacttggccacaatttccttttaattacagctaacaatcacacacaaaattgctttcataaattcccctttaggaaccttatcacaatttaaacagagcatctacaagatacttggactttctggctcttcctatactacccttttcttaaataaccggtcattttactctagcacaagaatttactatacaatatccctcttcatacaaaattactctttctttatatctttccttgccaaaaaatacattttcaatctaaaacgttttttatacctttttctctactccttgattctctcatattttgaacctctctctctctcttttttttttttaagatggagtttcactcttgttcctcaggctggagtgcagtggtgagatcttggctcactgcaacctctgcctcccgggttcaagcgattctcctgcctcagattcctgagtagctgggattacaggcatgtgctactatgcctggctaattttgtatttttagtagagacggggtttctccatgttggtcagggtggtctcgaactcctgacctcaggtgatacacctgaatcaacaagtcctggactgcctaccagacactggcattctatagatgagaatcatttcataattttaaggtttttaactatacgaaaagctcactatttaagcatttattcctttcaaatatatttaattttttaacttttagtggttttatctaaaccacctacaagaaataaaatactatgcaaagctagtcaccattaagtcattttaaccattttaaagcctgtgaacattagtgatttacttaagtaaaaaccttaaagttaaattttagaagacacaacattctcttcaaactaataagcttagactagtcttgtttaatttttgaatgctctcttatttataagccaacctgataacatgctgaacaacatacatcacaatacctgtgtatacacctaaacaaactcatcaaataaaataacctatacaagacaattggattcaagctatttacaaagttgggactcatctactaggccaaactatgtttgccctagtaggtatagaagacacgaaaaggcaaggaaggggataccctggcattaaacaaggtagagagagggaaaaccgtgttgctcaaagggagacctaggaatccctgatatggtctggctgtgtccccctgcaaatctcatcttgaattttggctcccataatgcctatgtgttgtgggaggaacccaatgggagataaatgaataatgaggagtggtttcccccatactgttctcatggtagtgaataagtctcatgagatctgatggttttacaaagggtttcccctttcacttggctctcgttctctcttctctgctgccttataagaaatgccttttgccttccaccatgattgtgaggcctccccacccacgtggaactgtgagtccattaaacctctttgtctttataaattacccagtctcgagtatgtctttatcggcagcatgaaaacagactaatacagtccccaagctgctgggagctcacccagcagccaagacactaaagaaaaatgttgatccagcttcttgtctgccactgcaagaaactatccatcaggtaaagggtccaagacccccagtaaacttacttaagcaaggcagctctttggggctcgtggaagaaaattgatgagaagcatcttttctctctcaccagaaacagttaggacattctcattgtcaatgatccttttgctcatagtaggagcaataattctggcccaggggccggtgagttgggggctcctgtctggacatcccagatgctgatctcacaacagtttctcaggatggataattctgaggtggcagggggcttacagcaactatgaacaattgcactttttggctatttcctttggtgtttttcacctctttttttcctgtccctgttattgtaaactttaaaggccatgtttaagagtttgcttttaagagtttgaggtcccactggtgctttttgtagcttcctcctaatgtcaggggcagattgagtaattaaatgtgcatccagaagggcttgccgttctgggcagtctgggtctaaagtggtatctttcctgagtgcctcaactaaacaaccatgaaacagagaaaggttttcatcttttcccagagttatttctctaatcttgtcataattgtcttgtttagccacactatttttcctttgcattttttctatggcacagccagttgcataagaaaatgatcaacttaacaagctctataaactttttaagccaaatttttccttgtataaagccaaattggacaaagtaaatggctcatgtaccctaagtattccatcattttcgttagctgcctttcgcaatgaacccaagtttgattttatgggcaaatatggggccccactcctggtggtactgtttgggcttactttcttggccagtgaggggtataagctggttctagatggatactggacaggggtgtctcatgacctgggggtagagtacttcattagagaactggtgggaacaccctcagaactgggggaacagagactttggggagggtgtaggcattccagggggcctagctaggaggagaccccttagtcatggctttctggtgcctggaagtaatgtgaaccagttaagggccataaaaatctgtacataagggaccgctcctcatttttctcctttttcacagaataagtccaattgcaaaatataattataatgtatagaatggtgtttaggccaaatatgttggttttctaatttttattgaacccaaatagtattgcaatagaaaatgagggtttttttctttttctttaagccaaatttgaatttgttccagtagcctaaaagacatcctagtggtgagtcccctgggatctcatcattgtccccgtgactaaccaggatttttactgaacatagaaatttttctaagtctagtgagagggaaagaaactgagcccttgttattttcccttttagatttccacttccttcagagagagtgtaagtacaaggagcaaggcattacaaaaggaattaggagctacacatgggcagtaaaatgttgagcctaaatttcatggagagcaagagttgggcagagatggggctacacaaatggtggctgtggaaggaaggaaaggaaggaggtagacagcattacccaagaggatacctcagaggccctgacctgccagaaaaccttcccagcagcagagacaccaaaaaaatgtttgggtagccacttgtctactgctgtaggtggtcgtccatccggtcaggggcctaggaattcccagtttcttcaaccaagaggggcttgaacaaggcagttataaatcagcacacaggatggggcctgaaactagctactggggaaataataaattctaacttcagggcagaaaaagcgaggccattatttctctaggtggaaaggctataacccacaatcctagagggaatgtaaataccaaaaaccccagcgcatctcggggcaaccaatgacaccaatgctgaaaaccgagagtgcccaagtaaccctggggcacatcaggggtggtcaacagtgaacccaagaccaagttgggggtcatagaggaaggtcactgcagcatcctagagtcaacacaatgggagacctctcacagccaagtgtcctgccttaaacaattgcccaaatacaattaatgaaaagtaaatgcaaacataacactgaaaatgaaatatacatttttaggactaaaaataatttgtggagcaattaaatggagtcagaggggaaaggactgggggtagaggtgataaagaggtggttgtgacactcaaatgacaaggaacttttaactgactacttagctaaaggcttttattccagctcaccagatactatggcgagaacagaagggcactcacccatccacaggagtcaaaatggtgctaaccgatctttgatgcaggacccaggtgaacgtctctctaaggattctccagcatgagtaggctcagctatcacacagggaggggcgcatcaggggaaccagtaacccactggtctgccagtcagagtggagggggcacacagaggaggcagcaacagtatggctacttgctcctctgttcagctctgctgcctgccaggaaaaatgatggctctgaaaagcagctttggttcgtattagagctctgtagggttagcagaactttatggtcaaagcctgagtattacatctctttcaggctcaatcacaggctgcttcgctgtctctcactgtcttgctgactgctgtctctcacatttctctccaaacaccacctccccactgatcacttacagccaccatctctgctgtgtcactctcttgcctctccactgatcaccgccatctctgctgtcttcatccctttgtggctatcagatgatgcagggcaggcaagccctaaacttgggggttagcccaggagggtccttgtctttacccaggaaggagttcaagggtaagccagtggtgttagcaacttttactgaagcagcagtgtacagcatcagcagaggtactcctccttgtgaagcagaagcagggctaccctatcagcagtgtgcccagagtagcagctcagaggcagttctgtactcatatttatacccacttttaattatatgtgaattaatgggcagattatgcataacatctctagaaaaagggtaataacttctgcgtcatcaggtcgttgccatggaaagaggtggtaacttccaggtattgccatggcaatggcaaactgacatggcacactggtgggcatgttgtatggagagatgcttctgcctcttccttgtattagctagtcctcagtttggtccagtgtccaatctctgtctctggagttgagtcccacctcctgagttaagtccaacctcctaactcaccatcatccctcataacaaacttaaactcacacccttcagtgctggtaaattagggtaaatctactcatggtggagatgatgagtctggaataaggtcaattttggaggcatgagttcaattatagtgtctaaccagtcactttaaccttatattttccctcattactaactctgaagatcaattgctgatttaaaaaccagatgaacagtcttatatgagtctgcaagaaagatgtggattgattgagcttactcacctaacatgcaatgcaattgttggtacactgaatccttattatttattttgcatgactgaaatctcttaaaattaattgtgctttattcttgaatagaatttggttttatatatacatcttgtgaaagcaaaagtaatctcgagactccaaacttactatgccaaagggaaagttaagctagggaactgagtcattaaaaaaattgcctgctttttgttcccaaacacagagccttatacatgtcaaatcctcatacataagccaggttcccacagcagtagaaagccacatgtctccccagacggcccttcctcacaagtcgctcataaggcatttccttgtggaccctaaaatctttcagaatatatgttctccctataatctagccctaaaagagagtgctgttaaatcttatcctgacaatgtaaattttcagcttatcttccaagtagcagacaaagacaagaatagaaatcatccttccgcccacctagagaaaaatgcataattgacttcttcattcaccccatcttttcacacattttatcttatataaaatgtggatttactgagcccaagataaatgcataattgacttttcctctaacccttcttttcacatgtaaaatgtagatttactaggtgttgatcaaagccttacaagaatataactacttgccttactgcctaccctttcccacctttaaaataaatttctttcttcgcctctggtttgctctttctcctttaaatactgaagtcctcaaaaccctcttaggaaaaagcatggattacaaaagctccagtgatttgtgtttctttcccaggtgcaacctcaactttggcaaaataaacctctaaattgattgagacttgtttcaatcaatttttgctttacaatatgtgtgtgtgtgtgtgtgtgtgtgtgtgtgtgtgtgtgtaatttctcattttctcagctataattagctataatcatcagtcaaattcagaaaccagttaggtgattcttactaaatttagaacaaaattggtgtggaagtgtgctatagagatcacatccaggattttagcagtatatatcaaaaaatgctaactattagaagagagcaaatgataccaaattaaactttgacgtgtatttataacaataaataagctaaagcaaggaaaatttcctttcctctatacaatactattagaagtggggtctttcaagtagggatagaagaggacccagctccatagtagtgaacaaacctcagttttccagagcagaagtcattttttctcatagattcttgaaaataaccatacctcttctttaagtcttaatccaaactgtctggaactcttatttaccttttaagatgtgtccgcattttcttcctgggtttaaagccacctagggccagagtttctatatatttccaatttttgacccagaggattatttgcatatagtcattgttcaatacatagattctagtttttaaacaaattctaatttctctggcagaaaaactggtgatttgagaattataagataaatatgaaaacgttggtttttaaaacattttaacatatgctaggactccccaaaatctgcaattttcaagtgagatgtaaaatgttcattggcattacaagcttctcaagcaaaaaaattgcattctgagacaaggtcatttcgttctttaacaaagttgctgaatacaaaagtcaggctttgatgcccactgctgtttcttccaaaaacataaacaatattataaaagggatctagattaataatttataaaaaggagctgggtattttcttccactactttatcaactagccagcaattctgtctttcttcagaatctgccttaaacttattttctattatctgcttcctgttgcgccaaaacaagtctaattttatttcatgcaaaccactgagtcactactgaaataagatcaattctgaatctctctcaagcaacccactcctttgttttttatcagtgttaataaaatcacagtgtcttgcaaaattcaatttataattattttagagaatttcagcctcctaaaaatgtccattcatttttggaacaagtcatacaaagttttagaaaataaatatgcttaaaaggaactcaagtagaaagaaatattactctgttcttccataaatcttccttagggagtagatacttaagtttattcctgttgtaattccagtgacaataacggcaatgtcaactagtaaaaagtaatgttttagtgaaagactcaaatgtaagaattttttacttcattattaccaaaataaaatatcttggcaaataatatgtttaaataaaatcttgtgatattgatatgaatattttgccaatgctcaatgaacttctgaattttatttatttttttactttattatttatttatttatttattttgagatggagtttcgctcttgttgcccaggctggagagcaatggtgtaatatcagctcaccacaacctccacctcctgggctcaagcgattctcctgcctcagcctcctgaatagctaggattacagttatgtgccaccacgtccagctaattttgtatttttactagagacagggtttctccacgttgttcaggctggtctcgaactcccaacctcaggtgatccgcctgcctcagcctcccaaagtactaggcttacaggcgtgagccaccacgcctggcgaacttctgaattttaagtgttccacatactacctaaagatactgactttgccattcattggctattgcatcaaagattaagcagctgttatgtacatcacacgtttctagatgctgcttagtacaatggtgatgtttacttttacaattgtccttctcaagtcaaatatattttccaaactaaaagttaaaatatgtgtgttagtcagggttctctagagggacaggaatgatactttgtatccttcaatccaatcaagttgactctcagtattaaccatcacaatatgcataattagttcttcaggataaaattaaatatttcagtgttgaaaatccaatagttgatcatactatgggtcctaaactgattatgaaaatagagacttatggaatcatgacctatagaaaatatgaccaatggatatgacaaagtgttttttgtcattattagctaaattaatattctttaaccacattttaataagatcagtgcttatggtgtgttcttactagatttattccatttcattctttaaaaaatctttatttggccccaggaaatttgtcataacatgcactgcatctcaaactggagctcaagtgcttgactcaaaattgtcttttttgactcaaaattaacaggcatgcctgggcaacagagcaagactctgtctcaaaaaaaaaaaaaaaaatctgaagcatatcaatctaagaccttgaatgtaatgataaattaatcatatttaggtccctaaaaaaaaaaaaaaacaaataaaaacaggaaaacaacaagaagaaagaaaataactccaatattctagaccattattgagatataaaataatgtttacagacaaaagggtttaggcccagcatggtgtcccatacttgtaatccctgcaattttggagggcaaggcaggaggagaatcacttgaggccaggagttcaagaccagcatggtcaacatagtgagattcatttctgcaaaacatatacaaaacagaaatttaaaagtttaaaaaataaaacaacatgaaattaaattagcctggtatggtagcacatatctatagtcccagctatgcgggaggctgaggcagaagtattgcttgagcctaggagttcaaggttacagttagctacagtggcataactgcacctcagcctggatgacagacgaagaacctgtctctaaaaattttgttttgaaagaaaaaatcaagaaaaaggtaaaacaaatattgacttaaggacataatttagatatatttaatattgtttttatagattttctctagaccaccctatgttcatgaatacagcaaggtagaaaatgatgttcttcccaaatttaggcataattcaattactcacggctcacctggatgaccatgcacaacctggggattctcatatgttggactaaaaagtcaaaatggaaggagaatatgtgtttctccacttgtgcttctgaaatgtaatattgtaatggctatattgttatcctataattcaaaactctggaaccagatactttactgtccgacctttccaagtgttcaaaatttccttattttctatcttatttttgtgatttgtacttggccaaagaatatataagacgaaaatttttgttttcagtgtaggaaaactttgtatgtgcttttgatgactcaactctgttttctatatctaaaaatgccttccttcccccagacatcaagagtcttacatctccatcatatgcccctacaacattaattttctttcaaagtattaaatgaaaaaaaaaaagttgggggaaaatgaaaggcctctgccaaatttgaaactagagaatgatttaccactggacattccttgtggatatttttaggtaaaaagttatagaatcacagactattattctgaagaaaacagaagtgatcaagccctagccttcactgcataaagggaagaatctgtgactcaagaaattatttcatagagagatacattggtagatctaaaacagctttcaaatctcattactgtcccagagcaatgctcttcttcatattttaattctagaaacagggcctaccttttagggtcattggaaatacaaaatgtaaagttcataatgtaacatctcaaacataaatagtaggtgattgaaacggttagttattaactatattacacctcatgttaagaggtctgtgctgccctttcatgccaaaactagagtgattctaacagacgctggctgtgagtataaagtcaatgctttatcacactctacttactgtaggatccagcccatatgagactaactggctttggggccttcttagaagaagacctgagatagatttagataagaccagtgccagtcttctagaggatctaaatataaaacacaagtaatgcaatttattcaaaaacaaacagaaggcccataatccccagatgtttatttttgatagaaaagaaaaaaatcggaaacagggctgtaacaatacttaaccccaaagcagaaaaagatttaaaattcctgacactttaaaggggaagtcttgaatacctgcctcccccgggaattctgtaagccatgttagcagttctcttagtgccactaaactgcatttagaactggggctaatgtacattctgaccttatcatccctccgtgttacagcataaggcactggccagtgtaccttcttcaagctcaccttgtcttgaaagtcagcctggccagtagctgaaatacatgggttcagaatcaggtctaaaagtcacaagttcattattgctgccaggctggatctaaatgccttttctcctaagatatcagcatttctcatccatcagtgaagcggttaatttgaaatgatagtttatttccttctgattttcaaaattttgaactggaaacaggcttgattatctcttctttttagaatggtaaatgtttaaaatagatcaggggaaggcacatgctctttgacctagaaattccagttctaagaacatattataaataaataataggacatgtgcacaaaaatgaaagatatatgcacagggatgttcattgatatttcgttcattataacaaaaaattaaaatgaatgaaagccacttaaacatctatccataaatatttttggggcatattgttagcaaaactttttatctaaagggataaatattaaatatgtgaggctttgtgggttctacaatttctgtcacaatcactcactcactgttgtggtatgaaagcaactacagataaggtgtaaacaaatggtcttcatagtgaaatgagatcagattcagaggagtgctgactgctgcacaatccataaatgaaggaagcacgtatggaaagaaaaccatagggggcttcctgctcaactgaaccccactaacactccttgtggaaccccactaacatcccagtgtggaagtcagaggagagtgcatgttgtgggatgtttcagattcagtcaatttctaacaacatccttatcattataggaagattctttctattcatagtttgagttattttatttttctttctggaatgagttaattagaaaaaaattcaccacctattgaaatgtgtatgtgtttttttctttagcacactaataaagggacttacatggaaattttttacaaatggacattgtgaaactgtgtcgttgtctggggtaaatacctgaggtttgtcatcttacgccaaggaaatcaaggacatggacacacatggagtgaggttaagagcagagatttcataggcaaacaaaagagaaagaggaacagctctttctcctgcgaaagcgagagagagagagagagatgcctgagtggaaattctagcctgtgttggagtgcacagggttttatagacaggcttgaggaggtggtgtctgatttacatagggcccaaagactggttggacaaagtgtgatgtttacatagtgggtgaggaaactggccaccccaccctaatcctttattatgcaaataaagtctctacttggctgcaccatgttgcctgctccttactgtgcacatggttgataaggaaagaggaagatggagccaccatgttggacatgcctagcccccaggtagcctttccctattggcacagctcccagaattcacccgtgtgagcttgtagcttgacttactatgcttgcagcttgaattttcaggctgctttttgttagaaaagaaaatgttttgggggctgcttttcattaaaagggaaagcttaccgaggacttccttaccctatctgcctaaataatttctttttaactcctatatcaattgcaatgttccaaaaagataaaatttatttacagaaacagttatttttgcctacctgctgtagtttgtttattttcttggattcatctgagaatagaggtttcaagataaactatcactctaaaagctggggagacaggcaagttgagggagttacagcggagagcttctttctgcttctgtggaacagaagccaatgcagccatgtgcttgtatcaaaatttcagtggtaattttgatgaaattccataggctgggtgtggactatgtcaaaattgagaaactgccgatagctgcatatttagataaatccaattggtcttacctactggatccccaccaagttctaattgtgaacatttgagaaagttcccgagtggttctggtggggtaaggaaagataaatcattgtaaaatgcctcaaataattcttcataataaaggccgattctctagagcaaaagtctttaagataaccttattcaacctggaggaaggatattattttttctcttgtaactacccttagctttcttatctccgcaaggggaaataaattgtactaacagaaaaaaaaaaaatccagcatagaccggggatataagcatttctttatccattgtcacatggcatttttcttgtgtgtctgagtcctctgtgttcaaatttttgtcttcttataaagataccagttatattggattcaggtgccaccccaaatccagtacgacctcattttcatttgctttcatctgcaagactctatttccaaataaggtcacattcacaggtttcaggtcaatagatatatataaattttccgcaaggctatgcaaacgaatacagcctcttagtgaaaaagtagacattgtgctataacatatgataaatatagcagagaaataaaaattgtaagaaagtaccaaaaggcaatgttagaaataaaacaaaaaaaaccactgtaactgcaatgaagtatgctattgatgaacttagcaatacactgagcacgactgataaaataatcaatgagtgtgaagatcattcaatagaaacttcccaaactgtaattcaaagaaaagcagaagggaaaaaatagaacgggacattcaagtactatgggacaacttcaaaagttgtaacctatgttcaatgagaatgtcagaaagtgaggaaagaaataatgcagcagataaatatttgaagtaataatgactaggagcattcccaaattaataacagatgtcaaatcaccaatagaagaagcatagagaactgtaagaagaataaattcaaaaaaatagaaggaagagagagaaggagggaaaacaaagagggaagaaggaaggcagacagacaaactatatccaagcatatcatattcaaactacagaaaaccaaagacaaagagaaaaacttcaaagaatctaagtgaggggaaaagataccttaagagagagtggaatgaaatatttaaagtgttaaaacaaaacaaaacaaaacaaaacaaaacaccagctaagaattccctatccagtggaattatcccttaaaagtgcacaagaaataaagacttagacagcacctgagggaattcatcaccagcagacatcccctacataacatgttttaaaaagtaattcagagttaagaaaaatgatataggtcagaaatgtgtgtctatataaagatgggaagggttggagaaagaataaacaagccttatattaccaagagtgaacattaatgcatgcaaatttaaaaagtaacttaggaggctgagaattttcctagacagaatgcaaaatatgataaaacaaatttaattgtattacaaatgtatgaaacaatctcactgaagtgtgtgagagaagagggtattgaccgaaatgctttagaagtgacagaagtctgtaaaactaaaggcaaaattaactgcctataagcactgttctccagctgaaaaaggtgtttccttcagaaatacagttcaataattctaaagcctaaatactcacccctcacacacatgcactggagtttaacaattaaataaatggatagccgatgatgggaacagatgatttttccagacatctcagagttggagtaggagtttacatataagaaaggggaagagtcttgaactattcatgtagtaataaattagagctggagacatcaccataaattcatgcttaacctgatacacatactgatacatatagaaatatttatagatatgtgcatttagtgtgtgtgtgtgtatatataatatatatagcttagtatacacatatacatatatatatatatccttgttacatcagctgagagggcctagaggcaatgacactctcttagaatgagcacaactcacactcagataccaatttttagttctgttttccaacacaaaggacaagagctccttataaaaagagctgagtagctcattccaagactgggacaggctatacagaagataaatctaatatcattctagcatcagacattaaagaagtacacaaaaaacagacatacacacacatatacaggcatgcacacacagacacaagttgacggagtcatgagaaaggaatatgacagtcaactgaaagaattccactggccaaagctggaaatattggaacaaaaatacatataaataagattggattgcaacctaaaatataaaatgaatgttcatactaatataaataaatgattgaataaataaatgaggaaaaacctgcaagtttcccattcagaagaatctcagataatttatgtggacactctgtccttagggagtgaagcatagcagtcaactctttatgtgtgtcttgtgcagagtgacttccccccgaagcgtacagtatgcaaacaggcagggggagcaacttcactggagagacccgacaaatcctacctcagccaggaggtcaaatttaacattatcagtgagaaataatagtgatagcgtgtaccctcgaaatgacgtgatggaaattacactttacctctgtgatctttccaacaactcacaaccccaggttagctatgaaaaaaactatcagacaaatcctaattgacggacattctgcaaaataattgaccagtattcctcaaaacggtcaagatcattaaaaacaaggaaagtctgagaaacagtcatagtcaataggaacctaaggagacaaaatgactaaatgtaatttgatatcttggatgggaccctggcacagaagaaacacactggggaaaaatgaagggaatctgagtaaattacggacttaataataattcaccaacaatgattcactaattttaacacatgtaccataaaatgtaaaatgataacagaaactgagttggggggttatatgtaaactctctatactatttttgtaatatttcttaaattttaaaggttttctaaaacagaatttttttttttaatgtttgggcataccccttttctaggtgcatagttggcaggtaaacgacctgatggaagcacctcggttttcagtggtgtagtcttctgcaatgtgttacagaacatgggcgacactagctcttacttggaagagacaggctgcttctcagggtttaaacattcagaggaacctggttatttaaaatatttgtgagcattcacctacatgccactatcccatgggttatggttccaaactttcccaaccacagtcctgactttggcataacaaacctctcttgattggacttttaactttcttgagtgggtatgtccccaaccagactattagatatgagtccttgtcctgaaatttctcagccttgcttttgcagggaaaaaaaaagagcttgttgataatataagtaaaacgccattaacttttacttctggcttacaattatctgtttttcaccctcagataatcattaattttctttatcttatcagttatacttagcaataaccatccaattctattatccttatatctactatttcctccatagtcttaaatacttaatgtgttctacttgcttgtgcatttcctccaccagaacagcttcccggtttaccactggtgaaagcttaacaggtgaaccatcacctgtgctccacctaccaccagtgaaggagttctcattgccagcaagaaagtgtttgatccagctccaaaatctcatctcattacatgtatctcaaaccactgcatttttattgctgtctgtagcaatttgggccatccaggaattgaaaaaaaaaaaaaagaagaagaaagaaagaaaagctgagatggtatctgaagtgtaagatactggctagggattaacatctccgaaagaaaagaaaaggaagagaaacaaaattaggtagaggaaaaagcagaaatgtgatgcaagcctgacaaagcctcagccagcaaggtggagacctttggagtgaagatttcccgtcaaaggatcctgattaaccaagcctctataactctgtccttcttagtgaccaagtgcaggcttccctggaacggatgatcaggattgtggtggctctttgccgctggtgcagccactggaagagctgacagctgaaggttgtgtgtggtcccactcctagcagctaggaaggaagttttgcttcaaagcaaaattctcttgctttgaaaacacactctctatcacaaagagaaatcaatttcccatagagtagacctgagtctttgagaacaaagatggataccactcctatcaacataaaatattataaatgaggtgcttgtatttttcaagatactcatgattttgagtgattttattttctcaacaaggaaattcaacataaacacagctaaatttactttttaccattaacgtttggcacatttttagttttaagtgtgtttaattacgaactgtttttttgtcacaccatatgttccagcttttgattaggaaaatataatcccttaatcacatgacctgtttcagtggccctcttatcaggaggcttaaacagatgtggaggtactctttatctaaagtcaaaacatgagccagaatttacagccaaaatagttccaatactccataaacaccttatgataaaaactccaagaattcctgatgatgatgatgataacttacatttattttatgtcaattttctcagccccatgctgaacactttttaaaaaaaaattatgtttaatttttgtgggcacatagtaggtgtatacatttatggggcacataagatgttttgatacagacatgcaatgtgatataattgttgcagcactgttcacaatagctactaagcaacctaagtgtctatcaacagatgaacggataaagaaaatgtggtacatctacctgatggagtactattcagccataaaaaagaaatgtgatcctgtcatttgcccatggatgaaactgaagatcattatgttaagtgaaatatgccagccacagaaagacaaacatcacgtgttctcacttatttgtggggtctaaaaaatgaaaacaattgaacttatgaatatgctgaacactttgtatgcactctatcaagcaatattcatacagactttggaagtgggtattgctaccattttaaaaatcagagaattggtttggagaggttaaagatcttatccaaattaacacggttactatgactaagcagagactctcctactgtttactctgaacccctgcatagtcatcttcatacaatctgaccaggctgtcaaaggataaggtatggaagccataaatatattatactaacttggaacaaatgccagaggaaaggcacttactctcttctatggcttatccatagaagccaagccctctgtgaactactccttaataatcaatatgattatccccaatatacaggtatcactacctattatttttactggaaattcactgtttcactagaatggtgagcaggattatttgattacttaaagggcatttagtcattcacaaaaaaatccattccaaaatgtaaaatgttctcatgtaagctaaatgtataacttgttgttagaccccttaatatctgtacagttcagagccaggcaaaattttctgatgtgccaggcaccctcatttccattaatgtattaaattctcacaaaagaatactttttcttttttcacagataaggaaacactacctaaaagagagtgctgagggtctcaaagacagatgagagaactggtgtttcccctcagccttcctaactccatgcccacaaatatttcctgcccatgactggccttcccctgggtatgttacaagtttagttgctgtggggataatgaactagtttcaaatattggtttttatcaaacagcatctgggtgatcttaggaaggttaactaatctctgcaaacctcaatgatctgacatatatatatatatatatatatatatatatatatatatataatacttataataatatccactttataggattactataaaatttaacacaataatgtatgctaagtagtttgcacaatgcctcaaagtaaatgctcaacaagtaactattattattctttctttggctgaagatgattttaaacctcgaagcatactatattaaaagctgacacttagaaatttccagagaactaagccattcggccttgtgaggtgaatgtcagatgtcatggatgggtgtaggtaatagatggaaagaaatgttgccagtagaaacagggctgactgcaactgtgttcttactctctgaaatacactcaaatcccgaaggattaactgcccctcatcatcaataccctagcatatcatgtttttctttttcctccaagagtcacacttcactcggacttgacatggcttcttttgaaactctgaggaaagagtttcagctctttcacaaagaaatctgaatggagaaattgtagcaaattgtagtaaatttattaatagcatcttccccagattgaatactaccttaacatctcggagctttcttcacttgtggtcaggaaagtaacatcttatctaagctataaatagccaatttgcatggttactgagggcaagaattaaactgtaatttctcatttatttccaagaagggacatcatcaatgctccaatcaaaacaagcccatgctggttcagggtataagtcccttcaaggcaaaaatactcctaatgcagaacctgtgacacgtagttgaagaaaaaattgtaaaattattcaagaaaattgtttggaggcaaaacttatcacttctagacacaggcaaaggcaaatgaattgctctagatttcccaaagaaatgatgtgtggtttgcaaaaagttccaggaggaaagttccctagatacatatgctaacattcctatttggtctttcctggggctggaggtgagattgctggacaataataaattaactcatgcaaagcccttttcttacttgtgagtcctggtgcccataaatagttagatgaaatcaactcactgacagctttacatgggtcttgaaaaattggatattgcaaaagccagcttctgtatccctcacagttctttcttttccaagaacaatattgcctggaacaagagaactagaaggaaaatgatttgaaatattttttatatgagaagctcaggaagatttataagcacatacctgaccttctccaagaaacattttgatttaatctcttttgtactctgctttttcaggaaaaggcttctttgaaattttctcaggataggtggaatataactcatgaataaaatttgtctggctcacaggctactgctgagctctgagctgcttcaagagaaaataatttaattccttcctcctaagagtgagagttaaacttctccatccttatgttatcaaggacaccattcaatatagcatcaaatctcaaactctgtttcttccagaaaaccctcacatacaacaacagtcttgtcttgctctctggtgtcctccttctctctttcttgctctttctctctctctccccacccctatattagttatgttgcacacctttcagtaatttgaatgcaccaaacatgtttttacctcagtttgtattatgcataaggtattccttattcctagaaagttattcttaactcttctttcaaaaccacactttccccctttaccaaacaggttccttcatatccttgacactgacatcattacttctgagggaacatcccttccatgatcctaaagtaaattggatccttgtattatttttctctaggactttatacttttgctttgtaacgattgcataattgttcactgcatgtatcttctttgcttactgtctgtctcttgacaaactagaacttccaaaggtcagggactagatgtgttttttgcattagtatgtctgctgcacctagcactgagcacagagtaatgtgactatttcattaacatttcttgaagtaatactttaacaggcttcctactctatattctatagcacttacttctgagtgcctctttttatactagtggtatacaccttaaatcattagctgccatggcatgtttttctttatagacgttagtaacttgagagatgattctgtctttttcaccctttctgtgactatgttttgtatagaagagaaacaatcaataattattggttcaagtgctactccagagtcaagcttctaatatctaatagagtgagtttaaaaagcaaattcaaaaggaaggaaaaatttgcagataataaatttccaagggcttattgtgtttgcatagataacatctgttaggaaacaaaccatctgcgggtcccagcctcctaaatatgttagcttttgaaatgccaaaattgatatctattttaccttctgcttaagttctaaagcttatggacttccataagtcttaggccaggaggtagcacaggtaggtcaaactttgccctggccttgttattaattacttgaataaacttggagaaaccaaaaacaactttaggcttctttattctaaatatagtataacattattaaaataaaagaatattttggagtaatctgttcctgcctcctaatcttaggaaagaaaatggatccctgactcaacttttgattgaatactcttagtggcaaagagctcactattgtgtgagccatcgtcttccattatggttgaatcttgctattaaaaattttctttatattgaaccaaatctgtatctgatcagttttaaacagacttctcctagcatatcctttaagtaggctcaaagataccttcctagccctatagtttcaggaatgtggaagaaaaatgactttctttcttctacatctccccatcttatttctttaccttcagaaagcacacaaacaaaaagagtgtgtgtctcaaaagaaagatataaaccaacactaggctaacttaaggtagcatttagtaatacaaaacaaagtggaggaataggtagaggccttatatagtagcacaggtgagatgctaaatttagagtgtccacacaagcattctgctttttttaatagttcacataatgataaaaactgtggttcctggagtatgactatcttggtttacaacccaccttcataccaaataatgtgtgttattgaaaatttgcttaagaattctgaactttgatttcatcacctggaaaacaaaactaataatagggtttgccaccaagattgtttttaggattgattatgacaataaagttcttagaaccaaaaacagcatatagtaagtggtcaaaaaaaaagtcagccaggcgcggtggctcatgcctgtaatcccagcactttgggaggccgaggtgggcagatcacaaggtcaggagattgagaccatcctggctaacacggtgaaactccgtctctactaaaaatacaaaaaaaaaaaaaatagctgggcatggtggtgggtgcctgtagtcccagctactcgggaggctgaggcaggagaatggtgtgaacacaggaggcagagcttgcagtgagccgagatcgtgccactgcattccaacctgggcaacagagcgagataacgtctcaaaaaaaaaaaaaaaatgttagtcacaggatcctgatccttacagagtagaaataggaagagtataggataaacagatttgagggaggggtaaccagatggaacacagggttttactttttttttttttttccccgtgtagatcaagagaatagtcacatatggcttccaggaactctagttcaagtgtgccaggagagttaaggatctaggtgcatcaccaaacagagaatgtgcaggaaagcatttgttcaaaagactgttcttaaatcttgcatatttccaagtcctgctttcaggattggctcctagcaactgagttctgggcactatgagtgttctggctgatgagtgtttttatatgtctgaggccttgagtcgccccatagagttttaacagatagtttatgctaacaatgtgatttatggtaaatgcatggattttgctttgggaactgaggtcagtcacacagtattgcatgcttccattaaaaactctggacaccaaggatcaggtagtctactgtgatctgttatactttgcatttgctgtcacacactgttgctggaaggacctagtttttcccagatgattccactgggaggggacacctgaaagcttgcacctggtttattccagacttggcccaccttttattttgattttgatatgtatcctttcattgtaataaaccataactgtgagtataacagtttctgatttctttgagtcattcttctgaatcatcaaatctgaaggtgggcttggggatctcaacacagaacagatgagctctaactccaataaccagatgctccatgaattctgttaattctaataaaatagcaacattgttttctaacactttttgaaactccagtgttacataaatttaaggaaatatcaactgactatattgaaatattgttattattgatgtgttattgctgtttttatcatttttgctagaaatagctggagatgccccttccagaattttaactgtatataggctcattaaggtataatgaaatcctacagatagatgactactttacataaatcttcctacatcctatgcctataggccagataacagtaaggttttttgtttgtttgtttcttaatggactgctccactatctatcccactagtattgaggtaacgtagaatcatgtaagacagaattcttttttaacaatttttaatcatttcaactttattttagattcagtgggtacgtgtgcaggcttgttacatgggtatattgcatgatgctgaggattggggtacaactgatcccatcatccaggtggtgagcatagttagcttttcaactcttgcctccttcccccccctcctccctctggtagtccccagtttctattgtttccacctttatgcccacgaggaccaagtgattagcccctgattataagtgagaacatgtggtatttggttttctgttcctgtattaattcacttaggacaatgacttacagctgcatccctgttactgcaaagaacataatttcattcttttttaaggtggtgtagtattccactgtgtatattaccatattttctttatccattccaccatcgttgggcacctaggttgattccatgtaagacagaattcttattttcctttcccaaaatgtttgtattcagaaatattcagaaattattgaaattcttcactatgtttttatttttatactaattacagcttcttgacttagtactgtgtgctacattaagacatctttgctgccttccagtttcaattcttgcccagagttctgacttgtccatgctgaagaatgcagatctccaaatttcccaaatgacatgggggctgtgtaagccaaagaaacaaagcaatttcaatgcctgatatttcccttaccctagagagactcccttaggatagggaaacatggtctcttttatctgaactagggctttatgaaaactgatatttcaacctgagcttttgtgatataaaaactttttaacagcaaagtgtgtataattatattgcaaaatgttttctaatactcagactttaaaatgtttaccacaaacatgatctcacttcaatattctccattcttcttaatgtgtcaccatctacactgtctattagatttgaaggcctgcactaattttaaaattcctatccacccagcccccatcatatacagtctactctaattactgagttcagttagtcgttcaacaaatattttatttttaatcaaatctggtctagtaaacaggtaataatttagttaatagtaatatatttgtgcacaaagtaaatacatagtttctgacctcaagaatctaggggtaagtgagaagtccagcattaaataattataaaaatcataccacagtgataatataaatgaagaaaacataacagggatgaatggcctagtattacaaaggactgcaattcagaacaggagatcagaaagttttctcaattgacttccagcatcacattgtgaagagctttgctgatctactgatctattgaccaataaaattggtgaaaattatttaacacaagcttttatttttggaaattctatgaaatgctactgagggcaaagaggaaattaaaaaaaactctccaagaaaaatctatttaaaaaatgataagaaaggcaagactctatggtgtttgaatgaaagttactccctccccagtccccactcccagtttagcaaggcagagaattcacttcagactgctacagctataatcaaagaactccctctctcctcagcttcaagtcagagggttttctcctaggcagagcaagattttcatcttttctcaccctgtcctcaactactggtttctaaggctgagtcctgggcaagtacatttgagaggtgagacctctagtcttgtttccagcctcagaattggaagggaaattttatcttgagcatggcaatatgagaacacaggcgctcctatgaaccctgcaactctccttgcccagcttgtgaggcagcggtttcttgccaggagaggtaaactgaaatgactttccactatttcgattttttccactgagtgctgaactcctagagcaggggtggcatttagaagaagcttaccattgtcccaccccctgctccagagctctggctaaaaatgttttcctgagaaacatgagtgaatgataaaacagatagcttctaatctcttcacaaagaaactggcttcatttgcaaaagagatgggaaaaatttaaacctaaaagtgctgccaaaaataaggggttgcaatgaaaaacaactagaagatttgtggatttgataaaggtacagcttagatggcagaccagctggtttgcaagagagactttgagaatatgacagctgggcggaggtcctctgaagctacaacaaatacctaccatggacttcataaactatttattcaaagaagctgcaatttgatgagtttgtatagcaatttatgccccaggtcacggttgaaacagtataacagtcaattggaaattggtagagtttaaaatctggtgtttttagaaaaagagaaagatagtcctacatatgccactgtcatcctgggatgactgtgggcatatctgaagctgtgcctcccttaggagaaacaacaaaatcttaacactgttgaggggaaaataaaattcactaaaataatcagccagtcactaacaaatgaaaaaacaaatgataaactttaggcatgagaataaaaaggaggtgatgggatgccattactcagagttgctacaatatattttaaaagtctagcttccaacaacaaattatcaggcatgcaaagaaacaggaaagtacaatctatgctgaaaaagaagcatacagaacaaactgcctgttagagcaaccagatgtcggatttcacaaatagtgagttaaaaatatccattataaatatgttcacagaactaaagggaagcatgcttaaataagtaagaaaatgtatggtgataacgtggcctcaaatacagaacatcaataaagagatactgcccccaaaatcaaatggaatttccaaaggttaaaagttacggaaattaaaaaaattaaaaaggcataccaatagacttaaaatggcagaaacaaaatagtaaagttgaagacagattgataaaaattatacaagccaagaacagagagatagaacctcagagaaatgtgggacaccatcaacagaaccaacacttgtgatgaagtgtgaaaaggagaggaaagagagaaaggaaaatgtttgaaaataattacaaaaataagtaataacaggaaagtacccaaatttattgataaggacaagtatacatctaagaagcttgaggggctcgagatagaataaacacaaagagatccagaaacagacatatcatagtaaaaatgccaaaagtaaaaaacaaggagaaattcttgaaagcaacaagtgaaaaaggattcactgtgtgcaagagaagcccaataagattgacagctgacttctcattagaaacaatggaggtcagatgcagttgaataacatacagtcaatttttgttgtacatggtatttatgctctatgaagtaatcgtgaacactgaattaacacatatactattgatcatagaggaaatataactttagttttttataagtctctgatcacaacatttttgtcaccaagtgcaacttgcattatttattttaaaatatttttctgcagccttccaatagtaaatttggcaaataactcttaaatatgacaccaaaagcacaagaaacaaaataaaaagaaaaatggatttcattaaataattttttaagtgttcttcaaaggatatcatcaagaaagtgaaagcacagcacagaagatggagaaaacatttgcaaattatagatctaaaaagagacttgtagccagaatacataaagaagtattacaattgcatgataaaaagaaaactcaactactacatggtcaaaggatctcaacagacatttctgtaatgaagatacacaaatgaccaatttcacttctgggcatgtatttgagaacagtgtaaacacatgtacacataaaaacttgtgcaagaatgtttacagcagtattattcataatagccaaaagatagaaagatctcaagtatccatcaatagacagacaaataaaatatggtatatcaatacaaggggctattagccataaaaaagaatgaagtactgatacattccacaccataaatgaaccttgaaaacattatggtaagtaaaagaaactggccacaaagtgcatgtattatttgactctattgagatggcagtccagaatagggaaatctatactgacagaaagtagaatggcagttgcttagaaaaaggagtgcaggtaggagataggggagttcatatctaaaggatacaggatttctttttgagatgatgaaaatgtacaattgaatatgatgattgcatgtgaatatactaaaaattattgaatcgaatatgtcatataggtgaattacatcttacgtgagctatatgtcaataaaaatatgtttaacaaaagaacaaaagacatctctaagaaagagatctggatgctaagacttcaacagtgtgttttggcgggctatgaagagatggggaagaacatccaggaagggaaaccaccaatgcaaaggccctgaggtctgaaaaaactgattacactggtagaactggataaaagctagtattgatagactgtggtaaagggagtgaagtggaagaaaatgagaaaaatagacatgtatttgaaacaaaaatggcaagaatttgctggccacatggattttaggctcatttgtaagtcgtgtgaataaaattaaaatgctctaagcaggaaagatacataatctgataggacttgtaaaaaatatatgggttgggtttgtagagaacaacattgtggggttgaatggatgtaggcagatgagtatgaaatctctaggaaattggtcttttggtcctttgaaatgtattagatgtacaagattttcaacatcttgtgtttcacggttggtgagagagaactcctcactgccaatagacacaggggaaataggactgatgcaaaatttaaggagacactccctatcagagtcgtgggagtgtagggtgaacactggcaagactctgagaatgactgcctgtttaaattctaacattttaagccctagtcacctcacttataatgccctgatctcatctctgatgggaagcttagtagtttgatcatgaggaaaatttgatgcctaccaaatatgtgaacagacacaaattcatgttatctacttcatagtgtgatactgctatatggatattatgagatgacaaccatgtatctcctatcaaaaaaaggtcaaggggtttaagaagcactcaaagttctttacaagataccttaaaaaaaagggttatgtggcttccctggcttaagaaaaaaataaagtaggttttgaaacagactttcataaaatccactcccttatttgagacataaatatatttaccacttgactgaatctacttctccagcctcattttcttataatgtaatatttcataagcatccaagcttcaggcaagctataattttcacccttctaagagtgtgtattattgcctttgtataactccatgtctttctaaacctactgcccttttgctatataatatctatttctctttgtccatccagcaaattccaactcatccttcaatactttgacaatgtgatctccttgataaagctttactccatacccctgaggagaattaattgtcacctttaactacaccccttaacaatggtttctattaatgaatttacttaatgtgctatggatcattttgtatgttatgttgtgttatgttatactatgttattgaatgttatgttatgttatgatattctgtctatatgactccatgaaactacagcattttgaaggcagaagagatatgctgttttctgtttaatttttgtaaccctggaaaacagagatacttatcaaacactgtttacagccatatttgtttattaagtcacaagcctttgtgagtttttatataaggtagctgttgtatttgactttaaaaatggtaattaagaagtttagaagaaactactagtagaaaaaatgattttgattcagaagctattattgtaaactgttacctgtagatcattgcatccttatctttaaaatgaagacattaagaaactctttctcaggaaattttattaaggcacgtatttaatgacaggcactggatggtaaaacattattgggatgagagttgctatattagattaggtattttgttttcacagatgttctcatttaatttgggagaactacaatctatatatattctggtaaaacatactaatatttataaaatgataaatacacaaggcaattgaggttgttacctaatggtaccattagttactatgtaatgagaaggacagaaataataactatgacttgaggtactaatggaatctatattgaagaggtgtgacatgaagaagaggtgggacttaaatgcagaggaaagagctgcttgtgctttcccatggggctcccgaatgctgtattaccaatggacctggcatacagactgaaaattggtccaatttgtgtggaacaagagaaggactgcctaaggtgagaaaagaaaacagctacttatccagaaaatgagagttgattaatgttattatggaataagaaatgcagttagagagtggtttgaatgagaataccaagaactagtagctagatgccaaacgcagccaagctttcccaagagttctgtcaatcaagaaaaatgacccaggcaagcctcaatcattttaggaggtttatttgccaaacttaaggacacacacctgggagacctttcctgaagatggttttgagggcttcagtattcacaggggaaagggcaggatattgagaaatattcaattttcatgtgagagcaggggtaggggaatagagtcattcatgcctttgtctggctcagtgaatctgcatttttacaaaagattacatagacaataaggcagaggcaacaatcagatatgcatttgtctcaggtggtcagaggatgactttgagttctgccctatgtccctgcacctatgaagataagctatgaatttacattgccatggtgaactttaacagaaatgctttagggcgaagatcttggggtccacaaggaatttctttgtgggcaaaatgtgagagaggtatgtagcttttcatctttgtagctatctaatttaggacacaaaatgggaggcaagttttcatgacccagttccgagcttgactttccctttggcttagtgaatttgaggttccaagatttattttccttttacagttcctaacccgcacatgaattccagccttccctccaacaggccatttgtttaaaggtagtttctgattctgaatatttacctccactgatggtcagtcagtaaatttgctttccaggtcttgctagggactgctcctatcattttcgaataccaatggacttcctaactggtttgccagtcatttgcatgcaaattgcaatcccagctgcaaagaggaaagtgtcagtgttgaaataagattctcactggcctccaaaataagtaagaaaataaataaataaataaataaataaatagcattgaagccagtgcctgtatccatccttagcagtagctaagactgctttttgttagatgtgttaatgaaaacacatacattctctaattctcttctcccaatcactgattcacaaatgagaatgcttataagtttttctagttcactcttctccaattacaggcatgactgttgtttttctgttgtcattttattggcatagctttccaaactctcatttagaaacatgtaatctatatccctaacaaactcactcgaaactccttgggtttttctataactcacagtattgttctttcctgaggaggcattgcactttgcaatcatctccctgaaacttgaataaaattaataaatatgtaagaccctgttggcaagttggctcatgcgtgtaatcccagcactttgggagggcaaggccgggggtgggtgggtcacaaggtcaaagttcgagaccagcctggccaagatggtgaaaccccatcattactaaaaatacaaaaattagctgggtgcggtggcacatgcctgtaatgccagctacttgggaggctgaggcaagagaatcacttgaacctgggaggtggaggttgcagtgagccaagattgccccactgcactctagcctgggtgacaaagtaaggctccatctcaaaaaaaatttaaagaagagagaccctgttgcttaaaagataagctataaattaaagcaatatttgaaaacagctctgatcatatatcaaaggttcatgttttttacttgcctcaatcaaatgaaaattgaaataaaacaagctctgttccttatccaacccaggcatgttggataagaatatttagatataatactttataattttaaatagttcagccccttctctagaaaagactttttgttttctctgaacagaactgtctggaaaattgcagctggtgttggagtcctgataattgtaagagtgaaaggaagtttctttccacctccagcagttttgagaactggagtctacaaacaaactggtaatagatgaacaggagaaaaagaataaaaacttactgatgtgcaagcacataggaatcatacaaagtataaaactccatgatggtccagacagttgaaacttaaatacccttttcttatgggagaggaaagtagaggatgtaggcagttgtggaggaagagtaaatattttttaaggaaggtaaatggacttaatagcctgggactaagttcacttgagctttgaggaaggtagcaacaacttatgggaaggtaaggggtggaactgcactatgaacagaggttgtcttattatgcagataaagcctctcaggtaacaaaccttagaagaacagatgaaaactttggctgtgctagtaacaatccttattttcttctttcatgactaacctttcctggttaatgagatttcagatagggtgtttatggcatttgtgttttttggaagagcttccctcactctgatcagagaattttagagagagcacctccttgcacttgggaagaaacaagggaaggtcagagagagctgattctaagaccttaaaatttcttttcattctaagtgctcagcatgccaaggtaccgtatttttgtggtatcattctctgagacccaacataatcttaaatcataaaaatatataattcttattatatcatatattatatatcatgtataaaataaaatatgaagctcagattgatgcaaagctaggccatataatcttttattgagaggtatcttctgtcatagcatacttttcttattccttatccaaacaactcagaagaagttactttttctttataagtctgccatgaataagacacaaaatattaagcccatggtagaattaataataatacagataataacagtatcactttggtgggacattcactattattgccatatactattaagtcctttgttaggtttttttaatttcataataattcctgcttgtttatctactctcattttcctccactgtttttactagctaaacacactggccttttaaagttgtacatacatattttactctttcccatcagtggatacttgcctatgtctttcattttatctggtttattttaattatgaagagtttcacttcccacataatcataaaccatcactcatttcctattattcccttgtttagtaaattcctagtataattctactcattcttctgtattttttgaaacattcttgtctcaaaaaagatcaaatgtacttgtcacacatatctgtaaactaactcttcacatttctgttgcatatttgtaatcatctgagtaatgccagtcttcctaatagactgcaaatttttcaaaggcagaaacagtttctctcttattcagaggtctttctcctcttatgcttcaactaatcaagatacaaaagacctaaacttccagcagaaagaaaagatactttcaaagttttcattctgctagtaatgggccctagatatgtgtcaacacagaatatgttttcaaagggttttagagaggagtcaaatatgtgaattgtgaatatacccaggtaataaaattttatattcaggctgtccaaagtcctttaaaaatagaataagaatagttaaaaaaaaaactaggattaaattcattgaatagatagtgagaactatacaatataccctgtattagtttttgtattggttatcaagttgctaatagctcagttttatgccccataacaaaacttacttataagtctagattttgtgacataataatttcacttcccatcaatcattaccgtatatttctttttttaaactctgttttttacttttactttatttgagtggttttgattattactgattttgaggaagtttctgttgctttagtatgcctacattatatttatgtttcttcaaatcctttttgaaaactcttgaggaataaaaaaaattctaataggtatctacaaacccatagaaataaatatcatatacatgcatagaacatgtacttcactgttaggagataatattttgcataatttatttttacattttgcacagtgccaagtataatttctttgacagagatggtgctcaattactttactaaaaatagaaagatattctgttgatgcaatgcattgagacatgagaagaatggagagaaaggtgaattgtcattgttaaaagaatggcataaaaaatcctctgtttgctacctgtaaattttctaaaacccaaagcagaagggaagggtgtaacaattgcgggctttggaatcagatggccattgttagaaacccagttctataacttactgatggtgagatcttttttgcgtttcttacactctctgtgcctcaatgtcctcatgtataaaaggaagattatagtatcttcagtgtacattcagtaactcattcaatgtctatgagtgtctactatgtgctaggcattggccaaggggcctttttttgtattagccatttaattctcatgatagcactcttaatttattattgcctactttatatatgaaaagaagtgaggcttagagagattaagcaacttgcccatgatatgtagtaaatgaatggctcaagaccacctactctggaattttctagaataaatttcataggagtgacatttaaagtcattctcctagaatttgttagcttttctgggaagtcttatctgattgccgactttcttttgtgtccatagcagcatcccatattttcatctctgatagtacttattacattgcagaacaatcatccatatatgtatttcttctacttaaacataaacctattgaatgctagcagtgtgtcttactcttttctacacttctcttattaaaactttctagttaatgcttgttggaagaataaatgaatgaataagtgaatgaatgcttattgctctatcaattatattttttaaacggagtccattagtgtgaaaacattaataaatgcagcagacaaagctggctaattttttaacctatccaacatccattttcctttatttccttcctaatagaatcctacttttatttgggtgggggcagcgatggccaaacttcaaaataaacaaaaagaaatagtgtacttcttcgttttccttgcaattaagagagactattgacatattatgaacaatgctttataagtaaaaaccaattgaatatttctagatatgtatgtttttctttcctgttgttggcatgccccccttctctttgatgcttctttcttctttctacttggaatgtgagaataagctagatgagataaagccatctcacaactttgaaaataacatttgcattctaagcatagtaaataataaaagtcatatgctaaacctaatagttcatgaagttagaaggaacctggttcctaggtagctctacccatcctgggttacttaccaatgaaatacttataacatgaataaaattatttaattgttataataaccatatttttgttattgtattaacccattttcacactactgataaagacatccaagactgggcaatttacaaaagaaataggtttaatgaactcagagttacatatggctggggaggcctcacaatcatggcagaaggtgaaagatacgtgtcacacggtggcagacaagagaagagaatgacagacaagcaaaaggggtttcccttataaaaccatcagatctcatgagacttgttcactaccatgagaacagcgtggaagaaaacaacccataattcaattatctcccactgggtccctaccacaacaccagggaattatgagagctacaattcaatattgggtggggacacagctaaaccctatcagttgtatacagataaatatatatgattaaatgttaatatatctttttattaaaaaatttaaaaatttaaaaaaatataaatagtttcctaaaagaagagtggaggaatatgtgtgcaattaagtgtgcaattaggttaataaaaaggaaattttaaaatttggttcttatattaaaatacttaaggactaatgcatttgccaaaaaaggtgataaagtctgcctagtactttgtggaaaatgagtcatttgtaaagatatttaaatgaatgaattttcatttactattacaataagtctaatgtgttcaccaaaactatgatttttagcaatatgcaaagagtcagcattcaatcccatctctacttgagttacaactaaatattgacggcagaaaggaaacttgcaaaagagaacaggaagttatctgtattagtttcaattatacctttagtaataagtagtttgacctccctgagcctcaaattccccatgtttagcttagaaataaaaagcagtcagctttgtctatctctttttttgtgacaatcaagtcaagcactttgtaaactaaaaaatgttatacagatatgaaattgagttttctttttgttttgatttgttttgttttgttttgagatggaatcttgctctcttgcccagcttggagtgcagtggtgcaatcttggctcactgtaatctctgcctcctgggttcaagcaattctcctgtctcagcctcccgagtagctgggattacagacgcccacaaacatgtctgactaatttttgtatttttagtagagatggggtttcactattttggctaggctggtctcaaactcctgacctcaggtgactcacccgcctcggccttccaaagtgctaggattacaggcatgagccaccgcacctgaccgaaattcagttttcactataccaaaattattctgttatttctatttggctcctcagtgtcaagatatttctcattcacttactcattaaggaaatgattcttaagagacagaacactgaggatactgctgagagatggagacctccttcttgacttgctggaatttggaagtctaatgggagaaagagactcaaataatcacataaatagactaaaatttgagactgtgagaagtactgtggtagatttaaaaagggaggtgtgagagaatacaattctaatttgttctgattattctcggctgaatttagtcattgtgtgtctcagtttgtcccagcaagatcaacttttttatgactgtaacctcagaaggaggtgtgctttgtatgtgcttcagttggaacctatgtctgaatttaaaactcctctgattgttgtttacattttacattaaaaattttgcctagtaagatccaaatgattagcatagagggagaaaacaatgcagtgctttactatcctataaaacatcaccaacaactactacttccaaaatttattcaaaaagagctgcatctccatgcctgcctactattgccacaattatttatgcaaagtacccactgagaagcaatcaaaacagtgattatctgagcattttcaccagcaaggtgaggtccaaaccccagaaaaatgatggctctaagagctgagagtctagaatatttataagctatgcttcagagaagtcttgaattaagctcatgttttctttttgcacctcttggcaagagataaaaacttctctgtaaatatcatagtcatgagtagtgggaagttttgctaaattttctggatggctcttataaccaagcagcctctccattaccagaatatcttttcacagtctggaaactcaatcattttctttcttttttttttttattatactttaagttctggggtacatgtgcagaatgtgcagttttgttacataggtatacatgtgccatggtggtttgctgcacccatcaacccctcacctacattaggtgtttctcctaatgttatccacttagtaattttcaaaaatattgcatgtgtacctccaatcgtttagttacagatatatgcctagtgaaaaaagagttaaatctcaataaggatttatctggagccctctgtttattaactataggccaaatagccttaactacagtacgtcttcctcttcattacatgcacaattatatggcctttggcagaaaaaccccctccatcatatgtctaaaattcccaggataggatgaagattctctctagtgatcttctgtacctcctgggctgtagtcttctcatttgtgtttcttgttctgtaccacacagttccatacttaaaattcatctcattaatgctctacctgtattctaatcttatataaacataacatttatcagtccatggaagatatatggggcacagtgacagggccataatatacaccatacagcaaacaaataaagaaacgttattatgaatgattaatatatctagccaaagtaaagcaatttgtgcccattgtgttaaaaaaataatgaactgaaagagacatgtgaaagccaactgtttaaaggtgttatgcaatgggcaatgtaggacagtgatcacgagaaaaggggaacaaatggaatgagctacaacattgccaggctttctagcaaaaaatcatgttttagatgatagaaaaggcagggaaaaccaaacaaaatacagcagctttttctaaggtgattacacagagtttgtagttctgggtaacttgtaggtaccttaaaatgtggtgcaaggtacaaaagatgatgggggatttatttgcagaaggatttccagaaaattgcttagggatctctttgagttttggacaaaaaacaaagctttgtattcacaggtaaaatttaagaattccagaaaaaaagaataataattagggagaaaaatcatcatcaaaacaacaactgcctgggagagatatgataagtgaacaaaataaccttcaaaatttgcacagggtctgaccatggaatgggaaaacatctcattgaaaagacaaagttttcaatagaaatctataaaggtttctattgaaaccttagaaggatactaccttctaagtagtatatctagtcatggagcacaagcaactagaaatttatctttaaaaagtgtaaaggcaaaattttaaggaatcaagttgacctgcaagtaactgaatggacagctagaccaaacttaagactctattaaggcagatagaaaactcaaacaatcaacaacgtaacaatcacactgtcaaacaaaaatgtcctagaaaaataagcaagaacacatgacccattgacccattctttactcttgacattgatgagaaatgtcatccaaaagataaaggctttaaattggcaaaggtatgaaaatagaagacaagggcactaagcaagctttacacacattttcaaggaattgtaaaaatgtataattataatgagaaaaatagggaatcatggtagagaagtagaaactacaaaaatcagcaaatacaaaatataaactaataaacacagtataatatttttaatttaaaacatttgttggattggattaaattttcagtcaccaaattctggtcatggaccaaagctgaaaaactcattatttttaaataaaattatgtttggaacacagccacgctcattagcttacatattgtttttggatgctttgatactatacatctccaagagtctcaacaaaccctaaatatcataaagaaactattaaaatcataatcagacagctgagagccatagataaagtgaacatcttgaaagcagtaaaagaaaagtgacattattgcataagggagagtaagtatttttaaagtctaatttttcattatcaacaatggaccctcagcaaacacctggcttgctatatatcccaacagccttccattcaagtgatagttgaccacactgtttgaaaaacatactccttgattcgggttgttcctttgattctacttcataactcatatgactgctctacctatttaaaaattttcatggcaaaagtttttcattcctctttctctgtccttatgggcctcttttattcaatagctgtacttataaaatatctaagagtaactatttacttattaccaatcatgctggtgatggcttaaagtcaaagtgacaatagtatgccagttgatttataatttataatgacatacttttgtgtgaacacacaaatatacacacatatacatccatagtataaaaagaataggaagaataatagatgatagatagatgcatgcataaatacacacaattttattagatcatattggaagtaatagtaagtcaggattaacttgaagttgattgcatagtaagctaaggatacagattgtaaatcttaaagcagtactaacaacaacaaaaattacagagaattatagttagaaagtcaacagagaaattaaaatgttatatagcaacatttttctcataagggacagcagtgaaggaagaatgaaaggaaaacagagatgagacaaattgaaacagaaaaatggtaaatgtaaattcaacaataaaaataaataattttaagaggactaaagcactcaatcaagagagacattttcttaatgaatgaattaaagattataataactatacactctatatacaagggatgcactttaaaattaaaggcaagatataatgaaattaacaggagtgaatatgaaaatatgcaaactgtaagtacaaggaaggtgacatggctacagttggatcagactaagcaggctgacacaagaaatgttactagaaacaacaagggacagttcaaaatcaaaagatggtaaataaaataggaaaatataaccatcataaatatataatctataagcaaagtagctccagaataaaaataaaggtaaatcaacaaagttgaatatttcataatttctctcagtaattgatagaacaagtagacagaaaatcaataaggatataagccttgaacaacatcatcaaccacctttctaccacagcaaactttaagtgtacattgagcacttaccaagacagaccatatgccaggatataaaatgtctcaatgtattttaaagattgaaagcatacagagttcgtcatctgaccatatgctaacaaattaaaaatcaaaaataaaaagaaatctaggaaacacagaaatcaaaactggtaaaaatgtgtaagaagcatctagagtagtgcctgaagaataaaaataaaatgacatgaatgcttattttagaaaagaagaaatatctaaaaacaagctagaggaaggacagcaaattaaacttgaagtaaatacacagaaagaaataatacattttggagcaaaaattgacaaaatagaaaacagaaacgtaatagaaagcctcattaggaatatctataataaaagagggaataccatatttacagacattacaaggaaatagaatgatatcatcaaaaattggatgcaaatgcatttcataactgagtttaagttatttgaaagataaaagttaccaaaatgatataaatacatatcaaaatgtgattatatataaattagtggtatatacctaacacaagggagaatggaagttttttcaagaaatagtattcaaacaattgtattaactgagatgcaaaatctaaaaatgaaacctaaaatattaaaactctcagaaaagaatacagaatacttcacaaatgtgagatatacaaagatttctaggaggggacacgaatggcaaaaccataatttttagaaaaggttaaaaaaaagtaaactgttacattttgttaagtgagtaagccaggcacagaaagataaacacagcatggtctcacttacatgtggaacccaaaaaagttgaactcatacaagtacagagtagaatggttcttcccaggggctagggatgtggatgagagatgtttgttaaagtttacaaagtttcgattacacagaaggaacaagatcaagtgatctatgatatgacatggtgactatagtttaaaacaatgtattacattattgaaaatcactaacaaagcagattttaagctaattaagggctaattagctcaatttagccattctaaaatgcatatatatatattaaaacatcatgttatacatgacaaatacatagactttttatttgccaatcaaaaaactaagttaggggaaaaaataaactggacttcacgtacattaaaatttctgctcatcaaaatcattattagctgtgacaaagataagacatagtctaagaaattactttccatagacatatctgaaataggtcttgtacctagactatataaaacacctaaagattagtaataacacaggaaaaaaatcaaataaataacatgcccaaaagaaatgaacagattttacaaaagaataaagtaggccaggtgcggtggctaatgcctgtaatcccagcactttgggaggctgaggcgggtggatcacctgaagtcagaagtttgagaccagcctggccaacatggtgcaaccccatctctactaaaaatacaaaaattagccgggtgtggtggtgggtgcctgtaatcccagctactagggaggctgacgcaggagaattgcttaaacctgggaggaggaggtttcagtgagctgagatcacaccactgcactccagcctgtgcaacagagcaagactcagtctcagttaaaaaaaaaaaacgataaaataaaaaacaatcacagaaacacctgttgatgagaatgtggaacaactgaaactctcataacaatgttggtagtatataaaatgggaaatcatcatttgacaatttttcagctttttctcgtaaacatatccctacccaacggcccactattatgaatttatctaagggaaataaaaatgtgtggttactgaatgaattgtaaaagagttttaaagctctttatttaaaatggaataacccatgtctattaattagagaataaacatatcatgtcctatgcatataaagaaatattctttggcaataaaaagaatgaactactaataaacacaataacattgattcacctcaattcattatggtaaatagaaacagccaagacataaaaattatacctatttcatgattcaatttgtttttaaataaagttcaagaacagacaaagtaatctatggtgacagctgtcagaacagcagttgcctgtggtcttataggaattaatattaagtgggtacaaagagactttctgggctaatggaaatgttctttattagtattgatatattgtctacctaagtcaacactcgtaaaatcatgtatttaacatgtacttattttactttatatgatttaaaggaaacaggattattgtagtgggcttagtcactaactgtgcctcaatggactcgtctatcaaatggtactattatcatgactgtctgattcatcttcagagacgggaaggttaaatgtaatagacactgtacaaagaaatatcacgatttcatcattgtctatcttctgggaaagttagagattttatctactgtgttctgagggttatctggggtgcaactttatttattttgtgttatttaaagttgtacttgaatgctttctatatttaccctgttttcagttatttagtattctggtatttttcttgcaaatgtttatttctattttctcccaaactccaaaagacatttaaaattaagaatggatgaaacaaacaaatattgcatttctacataagagatgaagtgaacacgcaaatagccacttccagacagattaagccacctcagtaagtgctatttctaaatcagatcacctcatatatggagacagggaatgctacgaagctgcttttgagacatcactcaaatatcaaataccaaagtacttccatacagtaaaaaatatgcctgacatagtgtgatattcccaaagaagaagctcttctgggacctaacaagcaatatagatactcatttattctcttattacctgactctaccaatctgtccatgagaaacagcatacgtatacattagagtaatatttagattttggaggaccggagctacccttagaaaccattgaagaacataaattgcattaattatatcctagattctcagatgaactccctgaagaagttttataacttgctattatttagaaaaagcatttaattaatctgtacttctgcaaggaagaggttgtaccacagaccaagaaaacctggaactcaattcaacaacaaagggaacagtcgagatgaaggaggtttagaaaatggaatgaatcgggatcacttggtctttacaaatcctgtttcttcccatgactccaagaaagaagacacctcctcaccaaggaccagggactttctgtcttgcagaatgctttgtaggttggaagagaaagatttcactgataactatgtaaagatgaattgttatgtagaggaacataaagatactgaatataataaaattctacaagattagcattcaaatgggcattatgctgtagaaatcagattgttatgcaggaaatattcactctttccctctcttttgcatagaagcaatattttcccctgctctgttggtgttcagttcagccacacaacccctaacttaggaatctgagaagctactaagagataaaattaaacaacaatactataatagtaatccttatttaagagcttcttgcctataattcccagttactgtccggagtttaatatcttagcaggacacacatcaagtgtaattgacacaccatggaacaaaatttctcgacgtttgaaatttactagtatgttgctcaaggtttctcttcttcgggctaagaatccctaataaattaattacatagtaattatttgaggatgtactatgttccagatcctaaggtaataatttaacatagtacttgcccttatgaagcttatggtcttctattctaatatcaactaatactcatagttaaaatatttcccattcagatatctccaattactataaaaataccacagtcaacacactcctagatacttatgcatataaagtcatataagacatagtttctgccctcaaggaacttgttgactggttgaacagccaaagacagtttcttcatttatttcttttatcataaatttcccaaggtaattagctatgtggagtatatctggctagtataccctcctttctcagagttatagaagccatctacaatttggataaatactttgagaatgaattttaattacaatataatgtagtattcagcatttatgaaacatttaatattaatgtacagcctggatattgacatggaaaatttttgtgagacattcaaagcctgtttacttaaagcacaataattgttgctttattctgtttgctggagtggtttccgtgatcttcactgcccttttccctgcatgaggcctcccagtattcttgagactgttatgcagatgctaaattttgaggtatcagagaaacactctcagcaattcactctctctttcttactgttggctacacttgaggttagtgtggcttcctagtgtcaggtgccagaaggcacaacatcatgtgacctaccccctctccagcaaagtcagcacacacatggaaaccttcaaatatgcccactgggacggagaatgtttgttggcttctattcttcttcctcccgtaactattttgaattcctgacttcaccctcttcttattgagtacgcttacaggttctcaatccattcagttcttctatcttttcctctttctatattaacagattgctccatgttttgatatgactgttttttcatgagtcactgctcatggtgaatcgtcagctctgcaaggtagggagaggttggcaatgccaaggccatcggtcatcatttgtcaagcaaagtacgtgcattctgttaccttttcagacaggccttccctgaccaccagaactaagacagcgtcccagccacacctttctcacatgaccttgtttaagtcattgcctgtttcactatttggaatccccgtgtccatcaacttctttacttcttctctgtattccttcagctcccacctgtttcccacctctaattaaaatgtaaactctagggaagcagaagctctgccttagttgcctcattttccagcacactcccacctggcacacaatcagtaaagagtaactatttgatgaatacacagattttccaatttattaaacatattaaaccaggacattcttttctttacaacggttcataacctatcagtcattctaggcaaagtcctcattctcaaagtgcacttgtatcttaaacatctcattttctctgaaaataattgacagcaatcatttactcttaattacttactagatttggctgctcatcatcttatgccactttctttttaaaactatgaagtttgaacacctgaatttctctagcattctcaacatttgtttatacaatatagtaaatgcttggggggatatgagtgcaaggaggtcagatagagatatttgaaccgcaatattattcctgacgttcaggcttcagaggaaacctttaatttttaaccattttctcagtactttcaaaaaataaatattttatgtttactataataaatctcccttaaaaaagagtctagtgaccaaaactgatactaaagctaatttggctctaagacttaaacattactttgtaaaaacctctaaaagataattccattagaactctataagaatttttttaatggaagtcctctgcaatggggagacatttaggatgaactaaggactatgtgtttttttcttttttcttccctgctcccccatctcccatgaacactatttagtaaatttatcttataccatagccaaaggttttgcattttatatggctattgtatcacagttatagcaacaaatgctgctttcctatatcacaacattccagtacaattccatcacacagaagcaaacactacaaaaaactcttaaaagatcttatttttcagaataaccctataaatatacaaacttatatacaattgtaatttgccaatatctaataaataaatgtaaaagaatagatgtaccatcattagagcatttcatcccctgaagagagtaatatgttgttcagattagattacctgctgacgcatagctcccgcttgaggtagcaaggttttaaggaaatggtttctgcttgttaataatgacaccaactgggatgagagctaacatgttttgaaaggtttctatgcacccagctctctgctaagcactaggcatacatacttcacttaattattacaaatctgagggcaggaatttctatccctttatgtaagtaggagaggttagataattttcttgagacaacaagtggaaagcaaagccagaactgaaacccaggcagaaaagaagagatggggactagaaaaatgcccagcagaggcccatgagagccacagggagccaggaagaaaagccatgcctacatccaatgaaatattaacagaaacttcacctaacttcacaatcagaaaattgacaatggtacccccattttaaacaaattcagtcatcaaacgataaaaatccatgctgaaatcctaaagctgtgtatttaaacgagactaatttctatccatgaggccagcagtcttgaacattaacctgaatcagtctgagtcaatgacaacacataatggcaaatcaacatggttgcttgcatggaattcaggatcaattttgggaaactacttgttgatatcagatcttgaaaactcagttttctcttgttcagggtattataaccaactgaattgtcttctcaaaggacctcatgatttcttattaagtggaaataatgttttaagcattaatcacattctttcaaagattttccttaagtaaaaaagactctggaattaattgaaagatgaaagccagtggaagatacttttctctcatatcaattatctgtcatctaaaggcacttgactggtaactgatacaaagtagtcataaatatatgaagatgattaatctttaatttacactttaagaatttttaaatgtatttttaattaccttattacaggcaaactgaagctccatcaatgtgtttcttcaactatgatccctcattttgggagcccgtaaaatgctaatcttctccttacctcttcctatagtagaaggatttaatagtgtgctagtaaactaccatatatttaaattttagggtacttgaattgctttcttaaggaaagtagaaaaatgtgacaagtagaaaaatatttccagatacaataagaaacagtctaactccttaaatgtatgtgcagccaggagaaccataggatatataaaggcaagttagcagatattttgttttcctttttgtcttgaaagggaaacaaaattgcattaatgaagccaaggtggagacattgtgtcttgcataaagatgtctcaactttcagaatctttctgggaaagtgagcttccccacagtcatttagatatttattctagttttcttaaccttgaacttactccattagagtcacaaaatctaacaaagtaatctaaacagatttgttgcaaacaagtctttgacatgcaaaatggatttttgttttgccctacctaggtcttatgtttcactattattaaaaatgtcagtaatattttgcccactgggaacacatattttccttcaattttttcaatcttattcaaaaccccttattgaatattttacaagttacagcggatctttgttattgctttttcaaattacaacctctgaaccctatgttggtattttgctaaacggtttatgctcatgtagagttgtgaagcattattagaataaaaaatgagaaaaccattcttagataattataattttgcatttgaccttcagaataaaaaataatacagcttcatcaagggagcaagccatagccctccacagcccatgcacatcctcagcgcacagctgcccttttgttgtgcaccatatgatccacgaaatactttatcatcatttttgtctctccccttctcgtccctcctcctgtcccacatccatatagcattaagaaacctattaattagggtcacgtggagacaattcatttgctgaaagtctcctcttatcactttgccttaactgtgtgtttactatgaacttataaatttgtactgtgtgtcttcagaatgctaaggctgctgtaagaactgtcaaatttgcaactgagataaattaaggaggactcaagggaacaatgaaacaaaaaacttggcagaaggaaatgagtggaggaacacagagatgttagaaattttattttaaatatttgtggtttgtataatagtttttagaagaactgaaaagcattacatgagataagatatatatgtaccaataatattcatttgtgtgtgcttccttattcataaatttaaactcaaatatatattcatgcatatattcatatctatatctagatatttaaaaaagtattcacactaatacctgcaatttcgttccaacaccaaagcatttatttcagcttctggttttctacaacttggactttcttctctgacagagaggaacctagctgtcattcacaatacattcacttatgtgctcagctctgaaatatacaagtcattgaggaatgtctgacccataacattgtggaaaacaggctgactaataaagtcattattttaaaaacttttttgtcttcagtctgaggatatacagtaaaaacacagcgtccaaaaattaaaacttctttatataattaatttgaaatacagttagattcatgtatttctattcctatcccatttctcccaaatccttgctgattttattatttagtttttaaaatagagcatgattctaaaagccaaagctatgttttaaatgatgcacttagaaggagggttatatctcaatcctttccatctcaatcctctccctccattcatcccacttcctttccatctccaagtcctttccatccagtttccatacatgccctggaggtagtccatctcataaatttgtaatgtgtcctttctctttgtgcacaaatgagtagacacatttccccccccatatattttacacaaaaggtaacatatatagttgtcctttgcactttgcttttgcaatcagatgtacatccaggaagtaactccttgttagtttatggagagcttccttcttttttataaagctgcatagtacttcactggatttatttattatagtttattgaactacaccactatatataacattttaatgttttaattttttgccactatttacaagccatgctgcactgaataattgtgtgtttgtgtgtacatgtgtagaatgtgttttcttggtaaattcctaggagtggaatcagtagggaaaaaggtaaatgtgtatgtagctttgtatgatattgccaaatttccctctcagagtattgtataaatgcgtcttcccaccagaaatcgataaggtatgagaatcctcttcttcctatagtttggccaatagaacaacagaaggtatcgttatatctctctgtatctagataaataggtaattgatacaaatatgtatatatgtcaataatatccaaactaatggactaaaacaggttttatagttttattaataaagcaatgcattttagtggttgaattcagacaagaactagcaagtgaagaagaaatgtggtaaggctatctaatattgatcaaatcattcccacaactatttactttttcctaaacattagcctttatcagcctcttcctttctttcacacataccctatttcatctttttacaatattttaagatgtcataattttgtacgttaaaactgatcaattttaaggtaaaatttgatgagtctttatatatgtatatatttgtgtaagcataatcataaacactgtattgaatattcaaatctcctaaataaatttcctcatgcctcttggtagtcaattcaacatttctgtatccagtccttagggactagaaatcttattgctgtcattttattattttcttttgtagaatttggtataaattaaatcatactcatacataattcattcttttgtatatcccttctttcattaggaagaagcttttaggattcctctgtactattgcactgtggttttattccctttatgctcagttgaaatccattggataaatataccacaatgtgtttatctatttaccagctgatgaacatttgtgacatttctagcttttagctattgtaaatatctgctatgaatattctcatatcacttttgaatgtatgcttttatctgtctttggaaaatacttaggactgaaattaccatgtcacagaattagtgaatgttaagttttgtaggaaactactaaaaagctttccaaagtggctgtgtcattttgcatttctaccatcaaagtcggagagtttcagttgctacacatgttcatcaacacttgatattatatatatatatttttttcgagatggaatctcactctgtcacccaggctggagtgcagtggcgcaatcttggctcactgcgaactccatctcccaggttcacgccattctcctgcctcagcctcccgagtagctggaaaaatgagtagacacatttttcccccatatattttacacaaaaggtaacatatatagtagtcctttgcactttgcttttgtaatcagatattcatccaggaagtaactccttgttagtttatggagagcttccttctattttataaagctgcatagcacttcactggatttacaggcgcccgccaccacgcctggctaactttttgtattttcagtagagacagggtttcaccgtgttagccaggatggtctcgatcccctgacctcgtgatccgcccgcctcggcctcccaaagtgttgggattacaggcgtgagccaaagcgcccggcctataattttttttttttttaaagtagacattctagtgggtatgtacaagtaactcattgtggttttcatttgtatttctataatgactaatgatattgagtatcttgttatgcaataattttccaaatattttcaaatagtttaaaactatttgtccatttataaattgatgttttcaatttattgagctgtaagagttcatcatacatatgaatactagttctttatcaagtgggtgtttcctgaataatttttcccattctatggctttctttttcattttttgaagtagtttacaaacatttattttatgaagtacacataacctttttaaacctttgcctaaaacatggtcactaagactttctcctgttgttttcttctagaagttttatagatttagctcttaaatttcaatctatgatctattttgagttttttttttttaatttagtgtgagctaattattaaggtttccttctcacttaaaaaaatatgtatatccatttgttctagcgcaattcatttaaaagcctatcctttacccccattgctttagcatatttcctataagggctatatatacagatacctatatatgtatatattggtgtatatatatatgtatatgtatatattggtctatgtatatatacatatatacatatgtatatattggtctatttttgaatatacagtttacccttaaacattgtgggtttgaacttcaagggtccacttaaatgtggacttttttcaataaacctctcctgcaactctttccatccccccacccttctcctcctcagacttcttaacgtgaagaatgaaaatctttatgatgatccacttctacttaatgaataggagacacattttcttttcattgttattttctcaaaaatattttcttttctctagcttactttattataagattacagtacctaatacatataaaacatatgttaatgaactatgttatcagtaaggtttccagtcaacagtagtctactggtagttaatttttgggggagtcagaagttgtttgtggattatgactgcacggagatcagcacccctaacccttacattgctcaagggtgaattgtatattctgttatattatatatatatatatatcattataccaataccacatagctctgattactatagctttatagctttgaaatcaaatactgaaagtccttcaactttgttctttttcagaagaattttattataataaccttttgtatttccacataaattttgaatgagcttgtcagtgctacacaatgactgctgggactttgtgattgtgttggggaaaattgacactttaacaatgttaagtttttctgttcatgtcatggtatatctctccctgtggtggttaattttatgtcaattcgaccggaccatgcagtgcttagatatttggtcgaatattatttcaggtgtgtctgggaaaatgtttctgcatgaaattaatatttgaattgatagaccgaataaagcaagttgtcctctctacagtgtcttcccttatgcaatcagttaaaaacctacatagaacaaaaaggctgagcaagagagaacttgtgtttgattgccttcaagctgagacatccgatttttcctgcctttggacttatatggaaatatggaattttcctggatcttgatcctgctggcatttgggttgatactacatccttagctctcctcattctcaggcttttgaattcaggctagaactataccctcagctcccgggtctccagactgccaactgtagatctttggtcttgtcagcttccataatcatgtgagccaattgagccaatgctttatagtaatcgtttctcttcgtttatatgtgcatacacacacacacacacacacacacattcttttacataaatattcactatttatctgagaattattcactattacattccattttagttgcttctctgatttttttgattcatgttttatgattttcaggatacagattctacacaagttttgttagacttatacctaagaagtttctatttgtgaagtattctaagtggtatttgaaaaatttgaaaaatattttcccattactcatttttcatatgtaagatacaattgttttttaattattgatcttctattctgtgacttcgatgaattaacatactattccaagcagctgatttggagatttcataggattttctgcatgaacaattatgtcatctgagaataaaggtaggcttaacttcttttattttgaatgtagtgctttttatttctttcctggccttattgcacttagtatatcttcaacaaaatattgaataggaatggtaagaacaagcattcttgtcttgctttcaaccctggtaggagagcactttacctttcattattacgtatgatgttagctgcagatgttttaataaatgctctttattagattcagaaagtttcttcaattcttagtatgcagagattttttattatcaatgggtgttgaatattgccaaatactccttttgaatttattaagtgtatcatatgttcattgttgtcatttgttactgtggtgaattgtattaattaattttcaatttttaaactaagtttgcagtcatgggatatacttcaactgattatgatataatatttttatctgattcttaatatgatttactaatatatcatttaaaaatctttttgcatatatgttagtgaatgtattgatctttaattttattattatgcctttatttgatttgagcataagtgtaatgcatgacaattatggtgtttctaaaattatttttaccttgctttaagttgatactgacaagtatcatgattctgctggatcaaagtattctttatttttcctatcaggtatcagaactctcttttatctaaggccatattttcttctggctgggcattgctttctatctcagcaggcagtagacaagccaacttacagcccaggagccctgtgattggctgtcaccagggactaagcactatggcctaagggtccctcttcccagccccagcatctgtctttctgtgcacagagcccatttcctagtcaacatctagtttcttgctgaggtatttaatagatcagaagaagatagttgatgaaaaatttactataatttcaggcagcccaaataccttttgctcttaagaagtaaaattaaacttctttctttcctccgttttcctccccaagtctcctcccattccttcaatgtctcacttcacagagtaaaaacttcagagatagaaaaggctacaaaagcaatcagatttttgttctaacttagaactctgcaagttcatcatattgatgacagcagggaaagaagaggtgggttggttgccctgctgaaacattaatttcgattgaaaggagtagaaataccagcaatgtacaggcataacggctcattgccaagatcgaaatgacttttccacgcaattgataatatctcagatggtgcaccattaagagatggcaacctagtccacatataaattcagtatgtaatccaaatttctatctctatattgatagtgtatgtaccatgtctgaatctaaactcatacacagtacacctctcccctctcagggttgatcttaaggatctcaggggtcattcacatgacgaactcaattttttttttttctggataattcttgaacatctaagtatgtaataaacgttaaaatatatatcagaagagagatagccttttaatattatattttgcaagccactaacctattttattcaatggtcaaactgcatgtctccaacttcactcgtatttaaggacttttgcacctgcttttcacattttcccaaatatatttctcctgatcttcccatggcagagtctcttatgtcaatcaggtctcatctcaaatattccctctttagagagctttccctgatcacccaaccaaacatccctaacacacagcccctctctgtcaactgtattaaacttgattaaaataataatatctcaaattgtcttgctaaatgagatgttaatattgctatttaacaccatgacccaaaatgcatacatacacaatctagaccataaaaccctaagaaaagccatcttctctgtattacctaaggctcaattatgagaagctaaaacagtgcctggcacatagtagactcctaaaaaacaatcactgaatacatgtatgagtgggtcatctaataatcagattattagttatatagcaaaatgcattttctgttgattacagtaagccaagactccaatgggaaataaaaacagaaagaactaactagcacctgctcccatttgggagcctctgaatttccgtgacttcatggcacattgctggacttgtgtttctaccacccaaatgggccctttctcctatttgtggggctgtccagtatccacttagaagcattctaagtgcccaaaggaggtaattaagaccaagaaatccagagaagtgcgtatttattgtaagtgctatcatatgttgagttttctctttctgacacaatgctggatgcatttcatcctcactcatccaatttcccactttattcccgaggtaactgtcacttgcctaagttgacacagttagtaaaacaaggagccaggattaaatccacaatggaataactgctataacccctgatgttaaccactgttctctaacatgcattgatgagttggggtaaaagaacacccattagaggtagtgcagccggagtacacatcacattttcaaggaatgctatcctcagtttccaatttggaatctatttggtgtttatttttactttctcttctatcattttttattcttcttggcatgccatttattgcacacaagctatccccttaactttaataaaggataggccatttctcataatagtttcattaggtacatatttaataattgatttttttcatttttgagatcactttagaatataaagagatgcacagatagttcctagagttcctgtatatgttgtccagcttctcctaatgttactttcttacataaccagagtacagttatctaaactaagaaattgacactagtgtaatactattcactaagccatagactagaattctataaagctataaaactggaattaactagttttccaccaaaatgatttttctcggtttcaaaatataatcagtctaatcaaagactccaccttgcatttagctggcatattcccttagtttccaacctatgacaatttctcagtctttccttgtttttcatgattttgagattattaaagtcagatattttgtggtatgtccctcagattgggttggtctgaggttttctcatgattagactgatgatactcatcttagggcagaataccatagaggtgatgtgcttctttttgtgcattatatcaggcacatattgacattatgtatatatgtcttattgctggagctgtcaccctgagtacttggctaggtagtattcactataaaattagtgtctttccctttgttgttagtaaatatttattgcagagggcaatagtttgagatcatgcaaatatcctgtttcttcttaaactttagtcaactgaattttgtaattattggtagatgttgcctaaagcaattattactgtctttttctaatgataatttgtctatttccttcatttgttccacatgtattaattaaatttctctgcaagaataagttatttcttatctcctattcactgattcatttacttatatagtaagggtttcatgatatttattttactcttctgatttttatccaacaccgtcattatttattttgttatttaaattattctggctttggccattgagatctctttcaggtatttttcctgatttttcaagtgggtaaactatttaaaagttcatttcctacaaagaaaaattagaaagcagcttggagttgaggatctaggaaaacttgtgtggacctattgctgctgattggacatactgctgtgaaaacataaatggctctctttgggtctcagtttcttcatttgtaaaatgtggaagttggactacataatagtttattttcaaattctagtgttaaataattgtgaagtataactttgtaacattaattctagagtgtagaagactttcttacctgggagatgttggtggcaattaataatttctttttagggagcatgaaatggaaggaggaaaggggactgaagtcacatattctttgaaaacacagccacattttgcttcatccctttaatttttgtttgttcccaatttttagtttggatttcagattatgttaagagaattttattttttttaaaagttaacatttctctagatgcttttaaaatgtaattggttctcaacacagtaaaagttatcacagctgcaaagtgagtttgtttagtagttttccaattttttgatgccaaggcctatctttatcccttcttatccacccccacattttcacatggtgtactctttcactgcattatgtttcagcttccatgtgccctgtgcaggggaccttcccccacctccctatgaaaaatggcattcctcttcaagtactgtcactttctcccccaatacaacttcctcttcctttatagttcttatcactagctgaagacgcagtctttgcttgttagttatttatgcagtgattgattctttgcccgactattctatctgcttcattttttctcatttaacaatttcgtacacttagcagtgtgattccctaccatccaagaatggtgaaaagtatggtatagggattaagggtataaggatcgtgttcttttttagctttcattacccctctcagtgcccttttctctgtgtctcttccaccctctctctaattgataaggggagaggtgttggtaataataataaagttcatttttctgaatgttaataaagacactgtgagtgaggattaatgaccttaataagtactgtcaatgatcttaataagtattgttaccttcttatttttattcagtaacagaataactgaatcaaaagaataaataagtgatttaaccaagcccactcagaaaataagagtactttcagtggaaagtcctgcaatgtctgtaatagtaatatcatttatatgtgtaaaggctttgtaacagtcctactagcaatgttagtaatgacaataaaacttaaaattttatagttacctatgatctaggttactgttttttagattttattgtagtaagacatttaatactcactgaaacccttaaaatagatttagcaattgtctattatgcagagatatttagacatattatcgaaactagttatcacgtaatctctgaaagtaagcagagctgtattttttaaaaattatctctatcagtgaagaagaatcatactgatgatataatgaagtcaaactcagagaaatgagtgaaagaggatggattacagctttaactgctgagttctaaaagtttaaaagatagttctaaaagccttctctcagaattatcaagagagtgttccctctctgcaaactaaccataagaccgagaaaaaataccagagtcatcaaaggaaaaacatctttgggaaagagtgggggaaggacattcatgccactggccacacccagggttgatacccagcaaggttcccagtctcaggtcagaaacatgcaaagcccccttaaggttctcaggcttagggaaagtagaaacagaccacatccaaggtcatttaccaaagaagcctccaattatttttgaattttttgatttttaaattttatgggtacattgtagctatatatgtttatgggatacatgaaatgtcttgatacatgcatccaatatatagtcatcacatcctggagaatggggtatccaccccctcaggcatttatcctttgtgttacaaacaattatcctcttttacttatctttaaatgtacagttaagtcattattgaccatagtcaccctgttgtgctatcaaatactagtgttactgagcactgtgagcatccttggtttttgtcttcttgaaataaagatttcagtcaagagatgcacagcaagggttaagtagcagagttgattgaaggaagatacagtacattccaagagaggagcagccagcttggctggaaaacagctcctggttggtgtggctagaaaaatagcaacagtagtgtttatttaaagagacagtacacttggaaaatgagtcagagtgggctggtagaaaagaatgagctagcagcagccagccctgggagattctctttattagaatcttacatgattattcatgaaggggcacgacagtgttgtgtgcaatcatgttttaggtggtacactcggatgtgcaggctctgtggttgtacatgctagtacacatatgacatgtatcactagtatttaaaatcttcaccctggggtgtgtgttttactattataacaagcaaaaggctactctggggtgagttattagaggagtgtgcatgcttggcagcagggaaagtccctaccatcgttatctctggatggggcctgataggtctcctttagggccagaggagcccaactataaggctagaagcagtcaatgaagccaatgtattttttgctgaccatcaatgggcagcactgactatcagtgggcagtgtctccaagtcttcttttcgcaggctcacttgcttgctcatttctggctattcacctatgctaacagtaggtcttattcattctacctattttttgtacctattaaccttccctacctccctcccagccccccaatacccttccctgcctctggtagccatccttttacgctctatgtccattagttcaattgttttgagttttagatccccaaaataagtgagaacatatgatatttgtctttctgtgcctgacttatttaaaataacttaatgatctccagtttcatccatgtcattgcaaatgaaaggatctcattcttcttttatggctgaattgtattccactgtgtatatgtaccacattttttaaaaatccattcttcggttgaaggacactaagattgcttccaattcttgactatcgtgaatagtgcttcaaaaaacatgggagtgcaggagtctcttctgcatattcatttcctttcttttgggtatatgcccagcagtgggattgctggatcttatgatagctatatttttagtgtttagaggagacttcaaactgttttcatagtggtggtactaattttcatttccaccagcagcgtaaaggattgccttttctccacatcaccaacatttgttattcctgtcttttaaatgtaagtcattttaattggggtgagataatatctcattgtaattttgatttgcatttatttgatgatcagtgatttttggcatgttttcataggccagtttgacctttgtatgtcttttattgagaaatgtctattcaaatcctttgctcattttttgatccaattgttagttttttttttttcctgtagttgtttgagctgtttccatatctgattatcaatcctttgtcagatggttagtttacgaatattttctcccattctgtgggccatctcttcactttgttgattgtttcctttgttgtgcagaacctgatatgatcccatttgtctatttttgctttggttgactgtgcttgtggtgtattgctagagaaatttttgcccagaacgatgtccaggagatttttctccaatgttttcttgtggtgatttcagagtttaaggacttagatttaagtctttgatgcatttttatttgatttttgtatacggtaagagacaggggtctagttttatttttctgcgtatggatattgggttttcccagcaccatttattgaagagactgtctttttccagtgtatgttcttggagcctttgttgaatatgagttcactgtaggtgcatggatttatttccgggttttctattctgtttcatttgtctgtgaatctgtttttatgcctgttaggagagatccagaacattatttgatgtgtggttgacagtcctcagccatgtgctgacccagctgccccacctcaaggtattcaggatactcatagcattttcctgtatttggaaaagtgacttttattagactccaaaatcttgccagtggaagacgaagcattttattggtgctcagttcctatccagctgcatctccatatgaaacctggtgtttgctgactgccaatgatttaaaaaaaacaaaaaaaactatgaatgaaatgaaaacaaaaaagcacaacaaataacaacaattaaccaccacaacaaaatcctaagatagagttagaaccctctgattctatccttttctcttcaaaaaaatcattggtttcctatccgatttgcttcatttggaaaaaaaatatataatcctgtcttttctgaatatttagataaggaaggaaggagaaagcattcccaaaaatatatggtgtttgatcttgtttcatgggtgatatggttagaccttgtgtccccacccaaatcttatctttaattgtaaaccccacatgtcaagggagagaagcgactggattttgtgggcagtttccctcatgttgttctcatggtagcgagtgaattctcacagatctcatggttttataaatggtactttttcctgtactctcacataattctttctcccgtaaccctgtgaaaaggtgccttccaccagaaagaggtgctttctgaggcctccccaggcatgtagaactatgagtcaattatacctcttttcttataaattatccagtctccaacagttctttatagcagtgggagaatggaataatacagtaaattggtacccaggtagtgaggcacgactataaaggtatctgaaaatgtgtaagtaactttggaactgagtaatgggcagagattggaacagtttggaagactcagaagaatacagaaagatgtgggaaagtttggaagttcctagagacttgttgaatggtttccatcaaaatgctgatagtgatatggacaatgaagcccagtctgagggagtctcagatggagatgaggaacttattggggactggagcaaaggtcactcttgctatgcttcagcaaagagactggaggcattttgccactgccctagagatctgtggaactctgaatttgagagagatgatctgaaattggaactcatgtttaaaagggaagcagagtataaaagtctggaaaatttgcagcctgaccatgtgatagaaaagaaaaaaccattttctgggaagaaattcaggtcagctgcaagaatttgcatgagtaaccaggagccaaatgttaattaccaagaccatgggaaaaaaatgtctccaaggcatgttagaagtcttcacagcagcccctcccatcatatgtcccaaggccttggagggaaaaacggttttgtgggccagatccagggccttgctgctttgtgcagtctccagacttggtgccctgcatcccagccatagaaaaaatgggccaacatacagctcaggcctttgcttcagagggtgcaagccccaaaccatggcagcttctatgtgatacagggcctgcaggtacacagaagtcaagaattgaggtttgggaacctccacctagatttcagatgtatggaaatgcctggatgtagcagccgaaacctgctgcaggggtcgaaccctcatggagaacctctgctaggccagtgcagaaagaaaatgtggggttgtagctcccatacagagtccccactggggcactgcctagcggagctgtgagaagagggccaccatcctccagaccccagaataatagattaccaacagcctgcacagtgttcctggaaaagctggagacattcaatgctaccctatgaaagcagtcaggagtggggctgaaccctgaaaagccacaggagcagagctgcccaagaccatgggagcctgtatcttgcatcaatgtgatctggatgtgagacatggagtcaaaggagattatttaggagctttaagatttaatgactgccccactggatttggacttgcatgggtcctgtagcccctttgttttagccaatttctcccatttggaatgggagcaatgcctgtgccccctttgtatcttaaaagtaactaacttgcttttgattttacaggctcataggcagaagggacatgttttgtctcagatgatactttggacttggacttttgggtgaattttgaaatgaattaagaatttggaggactgttgggaaggcatgattggttttgaaatgtgaaagaaagaagatttgggaggggccggggtggaataatatggttaggctttgtgtctccacccaaatctcatcttgaattgtaatccccacatgtaaagggagagcagcaattggatggtggaagtggtttccccatgttgttctcgtgatagtgagtgaattctcacaagatctgatagttttataaatggtagtttttcctgaactctcacacacttttctctcctgctgctctgtgaagaggtgacttctgccatgattttaagtttcctgagtcctccccagccacgcaaaactgtgagtcaattaaagctcttttcttataaattatccagtctcagttctttatagcaatgtgagaacagactaatacagggagtcagacatatgattgaggcaagagagaggcttttcaggagtagtaacatcaaattgtttgaaagtttgctgctttagaggatctgtctgtgattcagcatagttaaaactaagaatttatgtagaagatagtagaatatggggctagaaaagcagactagtgtcatattgtgaggagactcataagtctttctaaagaatttcagctttagcctgtgagagtcaagaagcccctgaaagattctaaataggtatacacatattcatctttgtatttcagcaaaatcacattgatgtcatcatgaaggatgggttggaaatggagcaaggctggaagcagggaaatttattggaaagcttttgtgggaattcaggcaaaaaaacgaagatattggtaactcctacagtgtacaaggggtagataaatttggaaaaggatatttaaaatgcaaatatgcaatgtgaaccaattagatgtgagaatcacaggaaagtttgtggttgtggactttgatgactatatctgacttatatgaccacagagttagtaatgtgattaagtgaagagggagggagttcaatgtggaaaaattgagagactatccagccagaactctagccttgactgtaggtgttaataacactaaattgagatgcccttcagaaatcagccttttcatcctaagtagcaacagcatgtgactgaatgtaatacagagaaaggggaacatgtcttattaagtgagatgaggaaatgccatagcagagaacatcagaaggaggtgaaaaattaggacagtgggaaaggagaagagaaaactacaactaacatgtgaggaaacttcacttcacatgaacctgtctatgaacaattagatcaggaaagctgttgccacaattcttggtatgtgctctgttcttttatgggtgaatgagttattggtgttccttaagtggaattgctattctgaagattcctgcatttaaaattagcagaatttgcagtggaataaaataagtttgtagtggctttgtaatgacatgtaaatcaggttttgacactactggaacccatttcaggcaattctttgtctcatctcaatttgaacacactgtcccaggatagagctgtgaggcagaagcttctagaatgagctatgagttgcttacaaaggcacccatgctagccaatgagcaccattaactctggatattatttgtaccccaatatgattcagtctcatggccaatgatatggtttggatctgtgtccccatccaaatctcatgtcaaattgtaatccccagtgttggaggaggggtctggtgggaggtgactgagtcatgggggtagagttctcatcaattatttagcaccattcccccttggtactgcatagtgagttctcacaagatctggttgtttaaaagtatgtggcaaccccctccccttttcccctgctccagccatgtgacatggctgctttctcttcaccttccaccatgattgtaagtttcctgaagtctccccagaatgagtagatgccaggaattgtgagccaattacaactcttttctttctaaattgcccagtcttagatatttctttaaggcaatgtgagaacgacctaatacatcagcattaaagaccattacggaaatccagctgccttagcagatgtcacaatttaagtctctctaaaaccttgaatcttttttggtctaagttatttggagagaagcaagcaaaaaaaatgccagaacaaaaagttactgtggggaaacaaatcattcttcataggagtctgcagtttttatggtgaaagtgaatgttaaaagcagatcacaataaattaagatgattgaaaggaaaataaatgatagccagaatccttgacactcagccacagttatgagtcttcagtaatcttgtgactttttgaaacagcctgacggtatagcagaaatagcaaggaattcaaacaactaccagagtagacaacacacagcagctgactcacccatatttaccttgttatttggttgttaaaactgagtgtgtggaaaagggatgttgctaatgaactgtgcaatgaccaaaggggaaaaagaaagaagaaaaaaaaggacataaaatatacaaagacaaggctgattgcacaattaaattgaaatatgtatttatttatcacccatcgtaacccagaacaaatgaagtgtgagactcctgtgatggctaggttataatttcagctctcagttccctttacaaacagtgaaaaaaacaggcagttgtgaaattcatagtactctcatggacgaaggctgtacatttcattacatctatgcccaaatggctatggtgtgatgataggaaaaatatcagtaatacattaaaggtatcttaatgcaaacatgccaatacagagacatcactaaagacatctgggaaagcacagcaataacctggcctgggtcatattaaattaagagctacatgggctgagtctaaaggaatgctttaatttaaacagcaactagggtcaaagttgtccacaaccagtttcctaagcaggtagttctgaccacagactaaagcacagcccataacttatggaaagaacaaaataactttgactggaccctgcacctgtgtactcagatggtaaccaacagcatgattctcaagcacacacaccagtgacacagtcatcacaaatttcagccattatcagagactcatcccatatctggagcaggaaaaaataataagctagtccaaagtgtctctggttattcacttctagctttattccattgtggtcagatgagataactgatatgatttctatttttaaaaaaattttgagacatgttttgtaggttaatatgtggtttattcttgagaatgtttcacttgctgaggagaagaatgtgtattctgtagctgttgaatgcaatgttctataaatgtctgttaggtccatttggtctatagagaagattaagcctgacatttgttgatgattttctgtctagatgatctgtccaatgctggaaatcattagtgattattatgtgcaactatataccaataaattggaaaacctggaagtaatggatacattcatatatacaaaacctataaagattaaaccataaaaatctagaactttaataaaccaataacaagtaatgagatagaaccagtaataaaatggctctcataaaaaaaaaaaaaaaggccgaggacctaatggcttccctactgaattctaccaaacatttaaagaaaaactaaaaccaatcatactcaaactattccaaaaaattgaggaggaggaagtactttcaaactcactttacgaagcctgatactaaccctgatactaagatcagacaaagacacaaaacacaaaagaaaactacaggccaatacctctgatgaacatagatgcaaaaatcctcaacaaaagactaacaaaatttaacaacacaccaaaaaaaatcattcaccatgatcaactggagctcatctcatggatgcaaggatggttcagtgtatgcaaaccaatcaacgtgatacatcgcgtcaatagaatgaagtacaaaaaccatatggtcagttcgatagatgccaaaaaaatttgataaaattcaatatcatttcatgataaaaactctcaacaaactggggaagtagaaacatacctcaacatgattaaagtcatatataacaaacccagtagctgacatcatactgaatggagagatctgaaagcttttcctttgagatctagaaaaaaataaggatgcacacctttaccacttttattcaacaaagtactggaaatcctagccagagaaattaaataagagaaggaaataaagggcatccaaattggaaaggaagtagtcaaattatccttgtttgcagatgacatgatcttatatttagaaaatttagggactccaccaaaaaaaagggctttcagatttccccattcagtacgatgtcagctattggatttgttatatatggcttttaccatgttgaggcttctactcacccaatttgttgagagtttttattataaaatgaagttgaattttaccgaatgttttttggcatctattcaaccataaatttagtaaagttgcagcataaaaaatcaacaaacaaaaatcaatagcatttctatatgccaacaacaagcaatctgaaaataaaccaagagaaagccatcccatttataatagctactaataaaataaaataaccagaaataaacttaactaaggaaatgaataacctctacaatgaaaactatcaaacattgataaaaaaattaaaggtgatagaaaaactgaaaatatattttttgtttatggatggaagaataaatattgttaaagtgttcatattggccaggtgcggtggctcacggctgtaattccagcactttgggaggctgaggcaggtggataaccaggtcaagagattgagaccatcttggccagcatggtaaaacccagtctctactaaaatacaaaaaattagccaggcttggtggcacatgcctgtaaatccagctacttgagaggctgaggcagcggaatcgcttggacccaggaggcggaggttgcagtgagctgagatcgcaccactgcactccagcctggggacagagcaagattccgtctcaaaaaaaaaaattcctattactcaaaacactctatagatttgttcaatctttatcaaaataccaattcttcacataaatagaaaaaaataactgtcaggcatgatagctcacacctgtaatctcagtattttcagaggctgagataagaagattattgaggccaagagttcaagaacagactgggcaagatagtgagaccccatctctacaaaaaatttaggtactagctgggtgtagtgacacacacctgtagtcctaggtactcaggggactgaggcaggagaatcacttgagcccaggaggttgaggctaaagtgagctatgattgtgttatttattgtactctagcctaagtaatagagcaaaacccatttttttaaaaaagaaggaaaagaaaaaatgatgttaacatttatataaaagcacaaatgacctagaatagccaaagcaattgtgaacaaaaagaataaaggtggaggcaccacattacctgacttcaaattatactataaagttatagtaaacaaaacagcatgatactggcttaagtacagacacataggacaatggaacagaatagagaactcagaaataaatccacatatttacagtcaactcattttgacaaaggtgccaagaacatacagtggtgaaaggatagtctcttcaagtatgatgctgggaaaacctgatatccatatttagaaaaatgaaagtagtctcctatctctcaccatatacaagaatcaaatcaaaatttattaagactgaaatctaagacctcaaactatgaaactgttccaagaaaactttggaagacacactccaggacattggtttgagcagagacttttgagtaatacctcaaaaacacaggcagcaaaagcaaaaatggaaaaataggatcacataaagctaaacagattctgcacagcaaagggaagagtcaacaaagtcaagagacaacccacagaataagagaaaatgtttgcaaactatccatctgacaaaaaggcttaataatcagaatatttaaagagctcaaacaactcaatagaaaaataccaatttaaaaatagtctaaatagacattactgaaaggaagaaatacgaatatccaacagacatgtaaaaagatgctcaacattactaatcatcatagaaatgcaaataaaaactacaataagatatcagctcaccccagttaaaatggcttttatccaaaacaggcaataactgatatggtttggctgtgtccccacccaaatctcatcttgaattgtagcttccataattcccacattgtgggaggaacccagtgggagatacttgaatcatggggcagtttcccctatactgttctcggggtagtgaataagtaagtctcatgagatctgatggttttgtacggggaaacccctttcaactggttctcattttctctcttgcctgctgccatgtaagacgtgcctttcaccttccaccatgattgtgaggcctccccagccatgtggaactgtgagtacattaagcctctttttctttataaattacccagtctcaggtatgtctttatcagcagcgtgaaaactgactaatataataacaaatgctggcaaggatgtggagaatggggaacccttgtacatggttggttggaatataaattagtacaacctctatggataatagtttgaaggtccctcaaaaaactaaaagtaaaactatgataagatccagtcatcccagtgctggttatatctacaaaagagaggaaatcagtattccaaagagatgtctgtactcccatgtttattgcaaaaggattcaaaatagctgagatatggaatcaacctaagtgtccatcaatgaatgaatcgagtttttatatgtggtaagtatacacaatagaatactattcagccataaagagaataaaatcctgtcatttgcaacaacatgagtggaactcaaggttattacattaaatgaagaaagccaggcacagaaagacaaatattacatgttctcactcatatgtaggagctaaaagaaaaattgaacttatgaagattagagtagtatgatggctatcagaatatggaaagggtctggcaaggcattaggtatggaaggataaagatggaatggttaatgggtacaaaaattgccatagaaagaatatgaaataagatctagtgtttgttcgcacaatagggtgactatagttaacaataatttattgtatgtttcaaaatagctgagtagaattggaatttccttaacacaaagaaataataaatgtttgaggtgatggatacaccaattaccttgaattgatcattacacattgtatacttatatcaacatatcacatgtacccataaatatgtgcaactctgatgtatctataattaaaagtaattttttataaaaattgaaagaaaaaataatgagcaaattcaataatcatactttcatcagtcaaggctaatcttacaattttagggagattttctgctttaactaatgacactagtgtcactagtaaagtatgtttatatttctaaacttttgttattgtttcatactttgtttattaatcatgaatcaacttagggttttttccatatttaatttggaatagaatttaaaagagttatggttcacaacagaagtaaaggcagtttcataactcaacctgttaatatccttttgatccttaatttatcaagttattaaaagttcttctctgctatagacaatatccaaggtgtcatcttaacattttttcaaatccatgtttaataatgagaacaatctctccttaaatcaaagttgttgaaggaaatttaaattgcctatgcataaaatggaaaggtaaagtacatcagtggagagcagcttgtactccttttaaattgttattaagcaaatgcagttagtatttttagcattccaggcaatttacacacctgagcacaatttattacctttctttatgcatctttaggaacaaggtttcctacagccatcactgtttgacctaatcaatggattcatatgtttctgcattgtcctgtcactttagctttgtttctacaaatgagtttcttttcatgggaaggagaaaaaaaatcacttcagtttaatcctagcagaggcacagtgctgggggtcgcagaggtcctgattaacagaaagcctcattcctgaagatcctgtagactggatcccaccaggcttcccatattggtattgttggtataccttttggggggaagtgtctcatctgctctcattccaatcagggcaaggttgttgaagtgtagtgctaactgaattctagctttcaagcatgcaagaggagagtcaaaatcaccaggctgtgggactttgctgagacttcagccatcaactcctcagcctctctctctcactctttccctctcactccactcaccactaacaggacccccaataatgtgcagataaatatctatagcaacattcctggggatgttgtgatcctaggaatatgtgttcaagcctgtacttggtctcaaaagttccatgctggactacataaaaaaattgtttgttattgtcatgatacaaatgaatttttataaacacagaaaacaaacttgaacatggaaaattgcccttctgtgtatccttttttacttctccctttatcctgtcagcatagtgtccacacaagtcagagccctagattgtaactcagcttccctgttttcattccccttcatgaatgtttcagtatttacatttctgcttaatatgctaagatggatagcactgcctcttgacagatactaatataggctccccagttgctgagatgtttgctctctcctctaatttctctgtaatacctaaagttcattttcactgcccatatccttctagcatgctcatttttcaaatatctatctttcaatataatattgtcaaggtaacagcatttacccaaacgaatgatttgattagcgcacagaaggatgtcttaatggccgcacgtgctcagttaaatttcctccagctttgcagcttgtcaccctggtcctcttgtctattcaccgactgagaaaatgcagagaaaagggaaataatttagaatttttttttaaaactatcagttggcattacaagatacctcagggacttcttcaagactcttatttctctgaccactacttcaatttaccacagcaggtcaattcagatagaaggtgacctacttggaacaagaacataagtcctagctcagatcacagacaattttcctaaaatctaactctgtgaacatgagcagatatcaacaaaatctattagcaatgaatctcaagctcaatgtaagtacctcattttttttagacaacttatgtagtcctggaccttgacagagattcactgaaacacgtagttgaaggagatatgagtgggagacgctcttggagtcaagatttcaatcggcaccaagtcctttatacatggacaaccaccagaggctggctgtaactgcagcaggtgtttactgagtgcttacaagttgtgcacactgtgctaagtgctatgtggttgctatcttaatctctcaacaaccagtggaagaggaaactaaggcttagggaaactgaggatcttgccgaaggtgacatcacagggaaatcaaggagactggtttcaaatgcagttaacataactttcagccattgtgcataagtggagcctatgctgtgggtataggcatttccccacaaaatatatccgggggaaatgtgtagacagagaaagaggaagagggaaactattcaaagattcaaacagggcaaagcactcctttactaccactttctttgattctagaaggtactaagacctgactctgttgttcccttacttagagcacttcaaaaatgctccttatattgtaaacacattgctgttttgggtgccatgttagtgcttaaaaaatatgaattaactattcatcatggcccctaaacactggtcaaataatttagtagccctaaaagcaatgaaagaaaccatcattgcttccaaacctcccagaaactgggctgtggtggtctgggtgagatggcatcttggtctttgctgtgacacatttaagagtggttatcaggagaaattttaaactgatcctcatactttggttttataagttaaaatcacaatgagatgcagatattatctgtttcaaggaactttcccttctctttctcatcccaacccacagctcagaagccacaggtaattccaggcttcttattttttttgttagctttcataataaggaatctataaagatggaaagtgttaagaaatccagaatttaacacaacttttaaattaaagtaaatcaaaatcaattaaagatgcctctcagttataggctattttattttaggtgtttataattttcctaaacattctaatgactcaacattattttgtatcttgccaacacgaatgtgcatattggcataaatataaaaaatgagtgaatgtaacacaggagttcaataacaaaggtaaagagagagaaagcatgaaagtgtgaggtcaggcacagacatggacggagacaaatgtagacagatgaatatcacatgcttgcttgattttcttccctcttgtcctactttcctacctcctaggggagttttgtttttgctgatttggtttgttcttttcctgcacatactttataattaatcactttcccaagcatcctcatcttggtgtctgctccttgacccctactccaaaataataatccttttccagatatcttttactccctatctcattcattgattttcctgacagtgattctttaatattccaaatgaactacttgcactgaagttcttgtctaggcacacttacatgtaacccaactaagaaatatgtgacaaacaaactgagataactgtctccaagctggtgtgccattttctgtaattcatcaatattcatgcttacgttctccaacgacaattccttttaatgatttagatggtggttcctgactcactgactccaaatctcacaagcgtgatggcagaaccccacatttacttggttagaattggtaaaatcaagaatatccttttaacttgatgtttgggctactttatgaaatatttgttttcttatttagatttcattctagtttatatgacatcaattcttacttgaaaacatccacctgtaactgaaatgattgaagtttgatgaaaaacatattgactggctgaggaaactatatgacaattatatattgctatagagaaatgagacaagtccaatagccacatcttgagaacccactatgtgccaatagctgaacccttcctgtggacacatctaagactcgttggcacatactgggattttgatcattacacgagggctaacgtatcttgaggcaggagcagctagctctctcttccctttgacagagttgtgtatttatagctgggttcattggctcacacctgtaatcctaccactaagagttgttattcttttcattattattattatcttatcaatctgttttaagcatttattttaaaatggtaaactgttttaatttattaacaaccattataacaaactcagaaattttattttctacctctcttcatttcatgttcaggttccccagagatagccattgtttactcaataagctattttatcacataactatttaaaatggaatttctcttcataccatttgtccttccaagcttcaagacaagaaatgttgcattgggagacattgtctctttctcctcagcttgactaaattttagacatgtttgtttttgactatagactccgttctctctttttaaaaacgcttttagagcacttactttataaaacttgcaaatgtaaattcttagtctttgttcaaatctctttgagattttaaatcttctcccagaccctatgcagttttaaaaccaagaaatatctttctcaagggcttggtagccattcttctgaaatataatgattaaggaagacagggtcctgtttttcactctctgtaagaaggtaggaaactacctttgacaaacaccaattaacaaacacattgaccaaccttccctctaaagtcctccagcccttttctactagctcatcccactgcttaagaaccctcctaccttttgttttatcaaagttgtgcttagtctctcttctctactgaaatagtcataatcactccacaacctatgcatgtaataacatgagccacatgtaccatcacaatgtatcccataaatatatacgattattatttgttaagtaaaacataaatcttaaaaaagtaaaaataaacccttccttgcctgtttacctgtgtctggtgcatatttcccttcgactatatccacctttattttgttgtaataccttaaaccagtgaatgtagagggagagaggacacatcaatggtacacaggacagtgtctggaacaaacaaatgcactgtgtcaggtcacaatttcttccctggggcattgatggaacagctttaggcaaatatgacaagcaaaccctgtacagccctcccacccctcttatggtagttggctcctctctagcctgctcacaatccctatctggtcatggtccttttatttctttcttagttccatattctccctccctctcagactttttttctttatcctaatcggaatttagatttttcacatgaaggagaaaattatcaatcgtaactaggccaaaagaccatagagggtttggaatctcagttttgctttgaatcctgactctaccattttaataaggatgaccttaatgaacttattggatctttctaagcttgagttatatattttccaaaatgagaataatattacctagcttacatgaccactgtgagagaagtgtaaggtatttaaagcagccaaaggatactgaacaaacaaaataactgaaacacaagtgtgaaataaataagttaccttcccctataatgaaaaccagttgttgaaaagaaacaaagaagaaacattgaaagacagcaacaacttcagttattataacaccaatctcggccattcaaatactgtctctccttcccagcagtgacactgatttgctgtgaaaatcttccattttttgattgttggtttactcgagaaaatcctcttctgtctagtaatggacgttagtagtcattaatgggctctactctcaacagggtacaagaagaagttaatttatgcctgtggcgggttctgggattgtcctactaaagagatccaagatgctttcaaatgaaaagcaacaaagaacagaagttaaggtcccagatttcttccagaaaagcagacaactcctaccctcaagctaggcttgcaagaattcttttttgtcgggatcttagaagtttaatattttatgagggagctattgatattgatgttgaggacatggtaggactttacttctccctcaaaggataattagctgtatccatcacagtttcacaggtagggataattcactgcaccactactgcgccactgtgatatcttcatgctgggctataaatgattacttcagcatgcatttagtcatttggaaatttaaatatctactgtagactctgagactgctctaaaatcaaattccagaaaagagcagtaaagagaataaaaaaagatgaatttttgctatagttcctctagaaagggttaatcttaggggagcataaaagaatgttttccaaaacagactggctgtcggatagtagataaataattactttcagtcacatactagaggtttttttttttctctctctcttcatcttcaggctcctgtattttctctgcacaatgttgtgtgcctcatagagtgtgacacagagtcatctgctctcagagcccagatgctctgaaggtaaactctgtgcgcccagtgcctgggctcatagacaaataacagcctagggacagtcctgcagctatcccgttcccagagtgcccagatgacatttgtacttgaccaaagttctagaaaaaaacttttgctgtctccaagtatcctgaagtagagccaagacttctcagtagttgagtagttgaaggaaacttggcttattctactttccataaatgccagtatatagaaattaattaactaatcatctagacaggcttacaaaattgtggtatactttacatgttcacagtttacaaataatacttttacacatacacacacatcaaaaatcgaaatacaattgtcctattcaaaagataatttcagaaccaatacaaaatatcatcttaccattcagcattgacagtgtgctttagtaatgacatataagcttaaaattgaataatgaacattttaaaatcaaattcaattaagctatcactgcaattaaatgtgtatttttatttggatttataacaatcctaaaataatttgagattctttagatgacactttgccccataagaagctttggaaatattatctgactccttaaaataactgttaccattttaaagaacaattatttgatttagctctgggcccccaacaataaaaccttaactctttatgcatatgaatcattagctttctcttatctgtctcggtactgctatcatctgccaattatacatcacaaatatgtcattgttaaaacagacctaacaattacacagaaaatagacttcattttcagaaggcatcattctcactactcttctaagagatttatacatatgagtcttgaccctcaatttagtgcaggtctgatgggcaaaaatatgcagttccatgtccatggtgacccaattacaatatgttgtgtattttaaatgcttgactgggatgtgaaaagaatgaattatgttctataataaatagcataagctctaaagctagaaaaacacaaattcaaatccctagaacaaattacttaacgtatctaggccactgctggattagaatagtgtaataataacatattattttaggttttctttaagatttatatataaagtactagtaaaataccaagtatacaatcctattaatacataatgagattacagtcaaattgtgatttttcagaggttgcttaatagcagttaaaatgaaacaattgttattaatagtcactgtatttacagaaacacaaaatattagaaattaattaaactatttctagattggatgacaactcttctttgaaatatgacattcagtctaagatcagcagatccctgtattacctcatgcagcaagtgttactttggggaaaatatacctgtaaaatcagcatagttaatgatcagattgtgatgtacaacatgtcatgttccagacattggataaggatgacaacttggtatagtcttttgggggagataatgactgttagagtgagggagaaggaattattgactaaaacaagatgccctgagtagcagactgctagctattcagggaaaatccttaaaaaaaaattctgggtacaaagctagactgcatttcccatatctgcttgcagtaggtgcgaccatgtgacttagttctagccaataaacaaaagcagaaagccccacttttagatttgattaatagacatacccccatgattctctccatgttctttctgctatgccatgaccaaacgtacatgaagattatactgcaagggatagagagatcacatgatgaaagcttctgaattcctgaatcaccacaacgaggaaagttatcagctgaccagaaacacatgccttggactattatgtaagcaaaatacataaataataactcttctgctgtggttgtgccactttccaagttaagatctctttgttgctattgttggcctgcattaaaaatacagccgagtgttgtgcttggccatttagaccacccactagactgcagacacctgagagaaacttgaggggtgctttgttatagcagccctaagaaacaacatattttataacaaaagatatttaaaacatcagttctggtggctagcagttcaaaatcaagatgttggctaggccatgcccctgtgaaaactctaggagaatccttacttacttcttcccaggaagctttggtatcccttggcttgagccttcctataagtccaatctctgttcattgtcaatggtgttcttcctgtgtttctgtgtttacatggtcatcttcatataagaatacaattcatattggattaagggctcactttgttccaggatgacattatcttaactcattacatctgcaacgaccctttttccaaatcaggtcacattctaagacactaggagttagggcttcaacttaacatttgtgtgtgtgtatgtgtgtgtctgtgtgtgtgagtgtgtgtgttacaatttagtctataatagttagtattaagaattagtaaaacatacttttgtatcattatctcacaaggtgtcccaaatggctcttctctatactctttccgaatgttaagacccaatgccaggtctctctcgttcagcagatttctctaatgctctaaaacacaaaatttgctcccttctaggaaatccggtgttattgaaaatctaaacctttagcctttgttgccattggtggctagtgataccatgtcaagattagcacagaaaagcataaccactgtaatcactgggatacacggatcacacatacacacacacacactcacatgcacacacacatatggtttaaaattagctattgatcttaagtagtggtgggagcttattaaacagtctttttgaggtggccatttctggggcaggtattagaaactaaaatctaaaggggcaggtagacaaaagttgaatggtgcaaacaatggcaaagtggaatctgcaaggttgttctggtacccatggtaaacaggaactggggtcagtctctcattgcctctaagcttccaccttctatgacacaggtgtactggaggagaaagtgatgcatttcatcatgaaactaaatatctacttgacccagaaactgaaaagttgaaggcgggcatccaatagcggtcgttgatctacagccctatatcaaccaggtgggataacaggtgaccgacgccatactcgagcttcaaaagtacctgtgtactactctcagccgtctgaatctaaatacaaaaggtgactcctggttctctttgtcttcccaatctattacaagatttctcctgtactctgccacatgtacaacaaatatccagaaaagagaattctggaaaccacagttcaagcctaattaagttgatgtaatacaaatctaccacgctaatgatcttttaatgatttaaagtacagctgctttctttctttgttgatttattatttaattgaatgaatactcattactcacattatttctttaataatctgtaatatgtatgaattcagctggaattaataagacatggtcccttgagtcatacaacttctagtccatcaaagaaacagatgtacaatcatataactagcacacaatttaattatgttgttaataaatgcttttataatggtatatacaaagtggtatagaagcttagagaaaacggtgaccaacactgtcctgaggtaataaggaaagtttcacaaggaaaatatttttgtttgcctgcattgatacaaaagagtcatcttcaagctctgagattctttcctcagcttggtgaattctgttgtcaatatttctaattatgaaattcctatagtgaacttttcatttccagaagttcagtttggttcttttttaaaatggctgtgtcatctttcaacgtttagatcattgtgtcctcttcattggattcagtttcaaccttcttctgtatcttgttgagcttgcttgtcatccagattccgaattttatgtctcacgtttcagccatttcaacgtggtaagaactattgctaaagagcttgtatgatcacttggagataagaagacactctggcttttagagttgccaaagttcttgtatgggttttttcttatctgtgaggacagatgatcctttatcctttgatgttactgtcctttggatatggctttttgcttttatgttctttttttgcccttgagttttgactgtggtacgagataagcatagtcaaatggctttgtttctggttgctttcacagacccaaggctcatcttggcactcctgggttatgtgctctaacacgggggtgccgggacaaggcccacagctttgttcccttgaggttgaaaactggctattgtgggggagcaccaatgtgctcccagaccactggcaacagcactctgctgagggttgtggatgaaagtgctctggtagggtggcaatgaggtcataggtgaaagtgctccagtgggtcatcagcaaaattgcttcagtgaggcagcgggggtcaccagtgaaagttgtataatggtggccactggcaaaagcactctgggagggcagctgaggctgcactgtgagccagtgtggccagacagggactcagagaagctggtgacagggggatgtgcagattagacgtgctctggtcctgcaagaaacagccctgctctgtccatgtccaccagtgaacaaaggccagaactatctggaggagtatggagagccttgatgggcgcctatagctgtgttccactgcagctgtccccgtgccaaaccacctgggctccaggtggatttgagctctgtctgtctgctctctgggccatttccctgccaactcaaatgtctgtgggggttatgggggctcctgcagctaggattctggaagtccatggtgggaagggaccactctgcatttatttcactcagctcttctttaggagccattcaagcctagagattttgttttgttttgttttagctctgaaagtcttttgtgctgggaaacccctcagtcctgggcaaacctgaatgtttaagaacattcttccttctctgagtgaaaaacctaaattgtattctttaaggaaatttttacaaaaaggattatatattctaaagatccttgctccatggggaaaagggcacctttttaagatgcaaataaaatcagctttttgttttggagactttctcgactactttcactgagaattgaagctgccttatttggtgtctccagaatcccagacctggccaagggaagagcgccctctatgagtagagctatgcctatgcaggccataaagctaaagtagacctgtccaagtatagctttttctactgtgagcattcttttttttttttttttttttgtattatgacttcatttactttgtaatataatttttagataccaattggcatttttcctgggaacataatttggtgactcagccaagtgtaaatgtaaaaaagtgttaatgtgttaggaatcaacttttttttttttctgcagaagattcaagtaacacgactccttagcttactcatttagcactatccattgtcttcacccaaagttctcctatttgtgggtcattatggaggtcgttatccacagactttctctgtgaatatccaaagatgctttatgcaagctacaaaatcacagtaaaggataagctgtttgggaaatagagggagactttaaaccacagtggtgcttacaactcaggctgagggttcccgcatatggttgtgcatctggctttgaggctggcagagttggaatctagtctgcggtctcctcatcaacacagccccgatggagttgtacctggccagaggcggcatctttctctaattcagataaaggtactacatggcattatatagactagaccaggccctggaccttttgttaagtttgctatataattctaacttgcaatgtataatttaggatgatttttggttacaaatagggtagcagacaaattaacaaaaacgtgaacttttttactcagaaagggaatttgctggaataacaatagaacttaccaacagttttgtaactggacttcagaaatattagaaccatcaagatgctatcctctttttattgtgttagccttgttcttctatcttacctcagaacagctttctcctcatggccaaaacacaactgccaagagctgcctagttttatgtctcacagatttagtcccagggagagagtgatcatattgtttttcctctggaagacactcattgccccagcttgggtcaagtacccaatcgaacttagctggaatgaagtcccatgaaaatgttatacctctagaaacaatatagatggagtagaggctggaggagctgtctccttggacaaagagaaatacctgtcccagaatgtgatctgaatgtcaatctgaacaattaagtgtcatctcaactatgtaaaaaaggtaaggccgtgaattaatcacagatttgaatttcattccctgcaaagcaaagtacaaaaaaataagtcaaagatacatacccaccctaagccctcaaaagtttcacccctcaattctaacttggatacttcttacattttatcctgtttaaattctgctcgctccaaggctcaatttcctttagtaagacttccccagtgtcatattcttcattgacttttctcttctgtccatttctgaggtactgatagcttaattcacacattacctctcttgatcatgcattgagccaattattaatacatgactattaattagcaacaatcacctaccttctattttctgcatggtgaaccagtgctaggtgtactctctgtaaacatgtttaagaatggattctgggagactataacttggcattgcttttgcaaagaagattggctagactcacagtaagtctaacagatgagtgccagggaaacttactgtattactcagagttctccggagaaacagaaccagtagaagataaataaatagatagatagataatagtgagaattggttcactcaattatggaggctaagaagtcccatgatatgccatctacaagcttgagagccagggaagttcatggtataactcagtctgagtccaaaggtctgagatcctgggaagctactgtaataagtcccagagcataagctggagaacctggagttctgatggccaagggcaggacaaaatggatgtctcagctccagaagagaggatgaaccctcttttcctcaccctttttgttctatgtgggccttcaatggattggataatgcccaccctccagccccccaacagtggtgaagtcagatcttctttactcagtctactgacttaaatgttaatcttttctgaaaatactcttacagacctacccagaatcagtttcaccaactatctggatattccttaacccagccaagttgatacctaaaattaaccaccacactattttggactcactgaagtatatgctatggaatgacctcaggctggaagctgagacacaggtgtgggtaacataagacatacgtctctgcccctcccccaccataaattgctataaatgagtggactgaaaagaccattattctgtctcttcaattttctacttatggtaactttttaggtaaagaggaagttcagaaaacttttagaaggggtactttttgtaatttctagaaggcagaggtgtttgtgtttcaacatacatttccagatgtgatgcaagtcagtgaatgtgattagaataccagctcactaatttgaagtaattaaatggaaatcaatttaaattggtggaaaaacacattttgagccatatttaaaaggcacaataactagaatttgacaaacaaaatgttacaggaaaatgctccacagagagaactttgtttagggaactcttcatgaaggcttgcattagcatatttattgttagggtgtcaacaatgttcccagagtaatggaaaacaatattttctctgaagtaaaataatgcattcttttatacttgttacattatttgcatttaatttaacctctaaatggcttattcttttgtgtagtattgtactttgcagttcaaaagcatcttctcatttataccttgcatgatctatcaggtaaataaagtagaattgctagacttcctcgagcaagaatgtgaggcttaaagataatttatgaatttcctgagactgaagacgtgtgagtcatgtgatgggatcagaaagcaatagactccagttcattctgatacatcaagtaaccatggatctgaattacaccaatattaagacattgaagtctaaatacattgcatttttctttagaggcaaatgttgatatacccataggaaaactgcaggtttaaaaataatccatcagccaggtgcggtgactcatgcatataatcccagcactttgggaggctgaggcgggcggatcacaaggtcagaagttcgagaccagactggccaacatagtgaaaccccatctctactaaaaatacaaaaactagcctggcatggtggcgtgtgcctgttgttccagctactcaggaggctgaggcaggagaatcacttgaacctgagaggcagaggttgtggtgagccaagatcgcaccactgcactccagcctgggcaacagagcgagactctgtcttaaaaaataataataattcatcaaatacaaaactctcatcactcctagaataattcctcaagttgttagggacaatgtgtaggaggcatgataggcttggaggaaaaacagtccctccctgctgattctggctgaactaaattgtgctctaaattttatcacatccttttttgttgaccgataacatctgactgataacggggtccccacataaatctcatctcaaactataatgcctacatgttgatggagggaccccgtggcaggtgattgcatcataggggaagttttctacatgctgttctcatgatagtgagtgagtttttacaagatctgatggttttataaggggctctttcctcttggtgctctctcttttgctcacttacatgggtaagacatgcctgcttccccttcctccatgattgtaagtttctgaggcctctccagccatgcagaactgtgagtaaattaaacttgttttctttataaattacccagtttttggctgttctttagagcagtgagtaaacaaactaatacattgacatattacaattggaaaataataatgtatctgggtcaagttaaatatatgtaatcaaatacatatgtgtgtgtctttgtgtgtatatattacatataagtttgtatatataatcatatcacatattatgtatagtgtcatatatgtaaaatatactatttgcattataaatacacagtcacttatatttacttaaatacattaatgatatttttttccttctccatctaatgaaagcagataattggacttaatgatattttgaggttgcattcagtatcctctatcttttctctctgtctgtactcctccggcagagatgtgtttatagcggaaattggatttactgtttgcataaaccaatatctttagctggtggctgtgcaggtccaattaactcctctaacaatacaactgaaatgaggttattggattatgttggtaggcaattaaagttgattggatcaaatactccttgtaaacttatttaaaattaagaaaatatatctaaaaatactgcatagaatgctgagacatcttggagaaaattggaagatttattcatttatcttatatgaggcaatgcagcatatggcccctaatttatgctgagatttttttcaatttttttttggagatttaattgacaaatatcatatatattaaaggtgtacaatataacgatttgatatacatatacattgtgtaataatttccacaatcaaattaacacatccatcaccactcgcgttttatcttaaatacccacaacttatttatcttatatatgaaagtttgtaccttttgaccaacttccccccaatccccctacctcctagccctagtggttgcttttcaactctctgcttctgtaggtttgacttttttagagtccacatataagtgagatcatacaatatttatcttttggtctctggcttacttcatttagcaaaatgtcttccaggttcatccatgttgttgcaaatggcaagattttcttacattttatggctgaataacattttgtgtgtgtgtatgtgtgtgtgcatatcacatattccttaccaattcatccatcaatcatagctgaataatattccctgtgtgtgtgtctaggtatgtctgtgtgtgtgtttatatctcacattttctttatccattcatccatctgttatggttgaataatattctgtgtgtgtgtgtgtgtgtgtgagagagagagagagagagaattggtgtgtatatatctcacatcttctttatccattcatccaacacttaaattgtttcaacatctgcatcttatctcttgtgactgatgtttcaatgaacatgagagtggagatatctttttgagatactaatttatttccttggggtacatacccagaagtagaatggctgaatcatatgataattttatttttaatatttaggaacctctatatgcttttcataatgactatatcaatttacgctcctaccaacagtgtacaaacattcccttctcttcacaacctcaccaatacttgttatatcttgtctttttgatactagccatcctaataagtgtgaggtgatgatcgattattgttttgctttgtatttctctcatgattagtgattttgaacatctcttcatatactcattgtggatttgtacgttttctttggaaaaatgtctattccactcctttgcccatttaaaatctgatttttattattattattttttgctattgagttctgttaatcacttacatattttttggattttaactccttatcagatatatgattaggcaaatattctttcccattccacaggttgacattttaatttgttgcttgtttcctttgctgtgcagaagctttttagtttgacacaattcaaattattattttttaaattttgttgcctgtacttttggtatcatatccaaaaaaactattggcaaaattagtgtcacaaaataaaggccatatatgataagctgacagcatactaaatgggaaaaagctaaaagcttttcctctaagatcaggaagaagacaaggatgtttacttttgccatttttatataacacagttctggaagtcctagtcagagagataaggcaagaaaaaaaaatcattcaaattgcaaaggaagaaattaaatgtctccatttacagacaacataatcttatatatagaaaatactaaagactccattaaaagtctgttagaaatactaaacaaattcagtaaagttgtagaatacaaactcaatatacatttaaaaatcagggttttctttacacttacaatgagctatccaaaaatgaaatttttggccagatacatggcatatgcctctaatcccagcactttgaattttagattttttttttctaatcagtgaagaatgatggtggtattttgatggaaattgtgttgaaattgtagattttttttggcagtatggtcattttcgcaatattaattctacccatccatgagcatgggatgtgtttctatttttttatgtcatgtattatttctttcagcaatgttttgtagttttcctggtagaggtctttcctctctttggtaaggtatattcccaagtattttatttttttgcagctattgaaaaaggggttgagttcttgatttgattctcagcttggtcactgttggtgtatagaaaagctactaattcttgtacattaattttgtatccagaaactttgctgaattcttttgtcagttctaggagctttctgtagtagtctttagatcatatcaaatagccaacagtgtttggaggccattgatttctttctcttgtctgattgctctggctagtacttccagtactatgttgaaaaggagtggtgagactgggcatccttgtcttgttccagttttcagagggaatgctttcaacttttccccattcagtattatgttcgttgtaagtttgtcatagatggcatttattatattgaggtatgtcccttgtatgatgattttgctgagagttttaatcataaaaggatgctggattttgtcaaatgctttttttgcttctattgagatgatcatatgatttttgttgttaattctgtttatgcagcatattacatttatttacttgcatatattaaaccatccctgcatgcctgatataaaacccacttgatcatggtggattatctttttgatatgtagttggatttggtttgctagtattttgttaaggattttagcatctatgttcatcagggatattggtctgtagttttccttttttgggtatgccctttcctggttttggtattagagtgatactggcttcataaaatgatttagggagggttcactctttctctatcttgtggaatactgtcaataggattggtaccaattcttctttgaatgtctggaggaattctgctgtgaatctgtctggttctggacttttgtgttgttgttggtaattttgtaattgtcatttcaatctcactgcttgttattggtctgttcagggcatctaattcttcctgatttaagctagaagcgttgtatagttgcaggaattgatcaatctcttctagagtttcaagtttggccacataaaggtgttcatagcagccttgaatgatcttttgtatttctgtagtgtcaggtgtagtatctcccatttcatttcttattgagcttatttggattttctttcttctttttcggttaatcttgccaatgatctatcaattttatttatcttttcaaagaaccagcattttgtttcatttatcttttgtatctttttttgtttcaattcatttagttctgctctgatcttggttatttcctttcttctgctgagtttgggtttggcttgttcttttttctctagttccttaaggtgtgaccttagattgactgtgctctttcagattttttgatgtaggtgtttagggctataaactttcctgttagcattgcccttgctgtgtcccataggttttgataggtgttgtcactgttgccgtttagttcaaagaatttttttaatttccatcctaatttcatttttgacccagtgatcattcaggagcaggttatttaatttccacatatttgcatggttttgaaggttcctttaggagttgatctccagttttattccactttggtctaagagagtgcttgatataatttcaattttcttaaattgattgaggttcattttgtggcctatcatgtggtctatcttggagaaagttctacgcactgttgaatagaatgtttattctgtggtttttggatggaatgttctgtatatatctgttaattccatttgtttcagggtatagcttaaattcattgtttttttattgaatttctgtcttgatgacctgtctagtgctgtcagtggagtattgaagtcccccgcattattctgttgctgtctatctcatttcttaggtctattagtaattgtttcataaattacagagctccagtgttaggtgcatatatttttaggattatgatatttttctgttggacaaggccttttatcattatatatgtccttctttgtctttttaaactgctgttgctttaaaatttgttttgtctgatataagaatagctactcctgctcaattttggtgttcattttcatgaaatgtagttttccacccttttacctcaagtttgtgagggtgttcatgtgttaggtgagtctcttgaaggcagtagatagctggttggtgaattcttatccattctgcagttctatatcttttaagtggagcatttaggccatttgcattcaatctcagtattgaaatgtgaggtaccattccattaatcatgtaatttgttgcctgtattcttgttttgtttttgttttttaaattgtatttttgtttcataggtcctgtgagatttatgttttaaagaggttctgttttgatgtgtttccaagatttgtttcaaaatttaggtctctaacttttggcaattcttgtagtggtggcttggtagtggtgagttctctcagaatttgcttgtcttaaaaagactatgtgaagctttctttcatatgtgaagcttactttcactggatacaaaatccttagctgataattgttttgtttgaagaggctaaagataggcccctgtcccttctagcctgtagggtttctgctgagaaatctaccattaatctgatagattttcctttataggttacctggtgcttttgtctcacagttcttctttccttcatcttaatttacataacctgatgataatgtgcctagatgattatgttattgtgatgaattccccaggtgttcgttgtgcttcttgtatttggatgtctaagtctctagcaaggctggggaagttttcctcaattattcccccaaatatgttttccaaactttcagatttctcttcttcctcaggaaagtagattattcttaggtttggttaacataatcccagatttcttggaggctttgttcacattttcttattttttttctttgtctttgttggattgtgttaattcgaagaccttgtctttaagctctgaatttctttcctctatttgttcaattctattgccgagactttccagagtcttttgcatttctataagtgtgtccattgtttcccaaagttttgattgttttctatttatgctatttccttgaatatttctcccttcacttcttgtgtcattttttggatttccttacattgggcctcagctttttgtggtgcctccttgattagcttaattactaacctcccgaattctttttcaggtaaatcggggtttcttcttggtgtgggtccattgctggtgagctagtgtgattttggggtggtgttaaagaaccttgttttgtcatattaccagagttgattttctgcttccttctcatttgtgtagattctgtcagacagaaggtctagggctgaaggctgttgttcagattcttttgtcccatgaggtgttcacttgatgtagtattctctccgttttcctatggatatggcttcctgagagctgagctatagtaattgttatctctcttttggatctagccacccagcaagtctaccaggctctgggctggtactgggggttgtcttcacagagttctgtgatgggaaccatctatgtgtctctcagccgtggataccagcaattgctccggtggaggtggcagggggtgaaatagactctgtgagggtccttagcttaggttgattaatgcactgtttttgcactggttggcctcctagcaggaagtggtggtttcaagagagcattagctgtggtagtatgaggaggaacaaatggtggacagtgccccagattgtccaagcttatatgcccttcatcttcagttatcagggtgggtagagaaggaccactggataggggcagggctaggagtgtgtgagttcagactcttcctgggtggatcttgctgcggctgctgttggggatgagaatgaggttcccaggccaatggatttatgttcctaggaggattatgactgtctctactgtgtcatgcaggctggcagggaagtgggggaaagctggcagtcacaggcctcacccagctcccatgcaatccaaagggagtctcactcccagcatgccccccaacccaacagcaccgagtctgtttccaggcagtggcaagcagggctgagaacttgccctagtctacctgcctcccagctgcaaaagcaaatctggcttttcttcttcccctgcctgtggagtctgcataccagattcacgtcctcgcctgagttctgccaggaggcttctaaatcagttcaaatttttacaaaattcagctggaaatttccttctccctatggcccttgcccactgcatcttgccaccctcctgaaggacccttgtgaggccaggcaaaaatgccttgctcggggatcctacacgctcccagggcttttcccgctgcttcctctacccctgtatttcacttggctctctaaattgattcagctgcaggtaaagtcaaaatcttctcccataatctaggccttcagtttccccagttggggtgcatatttgggggcagatgatctgcctttcccgcttccacagtttgggcactcacagtaattcggttgtctcccaggtcctacaggagcaatctactcccttcatggggtctggggtcctctcaggtttcctgatttattcctgcagtcatttgggagtgaaaattcacgatgcgagcctctacacgctgctatgtccatccaagtcggagctgcaatgcagtcctgcctcccatctgccatgatccccaaagctcactttaattgtgctgaagatatagaattaatcctctccctctgctgatataatattttgtaaacataaatgggtaaaatattcactgtgattaggtggatcatcaggagaaacacagagtaatctttaaggaaattgaagcatgtgtcaaagaccaaggaagtcagtgattctgacaacaacagcaaaaccaaatacctctgctctttgtttctaatctcttgctcttactagttttagctacacctcagtcttaatccaataataaaaatagaaaatcctccaacagtgtttctagattgttataattcctagttttatgagaaggaaattgaggttcaggaagattaaataagttatctaaggtcaaacagctagtaggttaaaaagatagaatttgagccacgttttacctagagattgcaaaatgcatgtctttccattcctgtggcctgaactaagaagtcagtcatctgttctataaaactgaggtagactttatctttgtgccttgcctatgcttaacccaacatctgctttattatttggtcctagacactagctaatttataaagaaaaaaaagtccaatcaatttctatgagccattctaaaagagacaggcacaacaggtgacagtagggttccttcagcttctcacctggtggtaggaataggcagaatggcacaaaggggtcactgagcagctggggatgccaaacccctgaacacctggctggtgtgtgatgggaagtaaggagactggtaagggcaatgggtgagtatggtctgtacccattaccaactgtaaatatgctaaccagcccaccacaccaaaggaagtcctggcctgtcccatccacagataaaataattgagatattctccaataccctcgaacacctggaacccatttatccaaatagcttggaaaatgcctggatcggggccagctgcgagagtaaacagtcagatgagtttagttgatcacactttcaggaaactctaacaaagctggagaccattttcctggaagttgtcttacttatgacatttattcgtccatgagtcccattaattcttcttctgggaaaaacaaagatgattataaagccagtatcatgaatgtgatcgctgtgtggaacgcttagctttgctgtcttgctcagacagtcttcaactccatccaggtttcacataaagaggactctgccagaaactgtggatgaatcaaagttcatctccattactagaacaagcacatctaacattagttctactcgttacaggctagcagagttaaaacaattttgtaaaaaataaagtattttaggtttcgctctgggacaagtttatttttacttttaattataaatgttcaataagtaatcttttctcaaccctctactcacataatattcataattctaaatgccccaaaactttttttctaatctacctcacctacaggtgcaggaaggatgtttagatacagaccatacaatgcagaggtatccattcctaatcttcctacacctcctggaaaaggtagaccgacttcaatgtttcatgtctaagacgttgaataacctgtagacagctacacatctatgaagcagcagttttcatgcgttagccatctatgtccagactctgttctaggaaactctacaaaatgctgcagtattgactcctcatttcagcctcttgaactgtataccaatattctcttccttttttaggatgactatattttatcccccaaatcaggaacttttgggaacaaaagcaagcactatggtcatctaaacaggatttgaagcctgattttgccacttacaagcaatggtttttgaaaagtctcatcttctgagatcctcaccataaaatgactttactttctcgaaatagtgaagatgaaatgagataattcatgttaattactcagtcctgtgccttccaaataagcactttaaaaatgcttgttattattattattatcaaaaattcttaaattctttaggccagaattcagaggatagcagggcactttgcaggagaagagcagagggaaacagcctggccttttctaagtatgaagaattggagggtgtctttgaaagtaggtaagttttacctgtctttttgtattttgtctgtagaaggaccacaaccaaaataaaatcacataattaatagtgaattgaaatatagacactgacacaaacacacaaacagaacactattcattataaacaatgcatttaagatatttctatattgaaatagagagctgcatcaatcttgttaactgttttgcagaattagactggaagcattttatttttttaaccatcctactttatggatgtccaaggttctggagaaaggttgtgggatagaatgtggtaagcatatcatttagaggaacaatatgaggctggagagaaaggaaaaaaagcagagcatttagggccatgtaggtcaaagtaagaaattgttattttatttaaaatgaagtatatagaaatctaaagcatttaagtggtatgtttatcaacactggaatttgctattgcagcattgtagttttgaacatcctcatacatgtagctttatacatattttaaaaatggttcagggtaataaaattgatagaagcagaaatatcagttcaaaacatttgcacattgaacatgttgatatgtattgccaaattccctaaaaatatgcctcactcccagcactagtatatgcgaaaatccacgtccccacttggctaattcttaattctatttgtagagatctgttaacctgttaaagccaaataatacaatggggttgcattttaagtgagattaagtcagtgaataacatacaaattacatataggcaaaactaccttacaaaatcataaaatatgatagatgttatttgagggtagttaactcttgatgataattcttatgtaccccgaaatgtaaaaaacactgaaccaaaaaaaaacccagcaaacaaaaggaaagtctatgccagtgtctaagaactcaaaaatcaatcattttcaagctgattgctgaatacctaggatgagagagtgatagataaggaattgtaaataaaatgttcaaatttgcccataaggttcacaccattctgctttaagactctacagtattgaaataagcagtcaaaagactgcctattattgagataattaataaaacaatatataaaagtacctaacatagatctggcacattgaaatgcaaaaattaaaaatcaaattttaaatatttaaattttgttctatgagactgacatttctttccagtgtcctttattgttttccacattggcaactcctcttgttataacaataacaaattattacccatgaattttggcattggtttcaagaccgttaaagtggcattggagggtgaataggtagaaatggggttttacatgctaagttataaagtcagaattaagtaaaacataaataggtttcaataccaatatagacaatgacttgtaatttaattgacaattatcctgattccttatgaggttaagaatttttgacttctgcattgctcatttctatttctatttttatgaattgattacttatattcttgaaaccaacttgtgtttaagttgtattgatttatagtagttcattgtgtttgctgtatgatgtctccatcagttatctattgtttaagctttgtttatatagtctccaagatatagaatggtttttagttgatagtcatatcattaaatccttcctttatgcctttaattgtatatatttacttaagaattacaatgctatcatcagagtgaatagacaacctacagaatgggagaaaatttttgcaatctatctgtctgacaaagggctaatatccagaatccacaagaaactcaaacaaatttacaagaaaaaaaaacaaacaaccccatcaaaaagtgggtgaagaatatgaacagacacttctcaaaagaagacatttacgggtccaaaaaaatatgaaaaaaagctcatcatcactgatcattagagaaatgcaaatcaaaaccacaatgagataacatctcatgccagttggattggtgatcattaaaaagtcaggaaacaacagatgttggagatgatgtggtgaaataggatcgcttttacactgttggtggcagtataaattatttcaaccattgtggaagacagtgtggcaattcctcaaggatctagaaccagagataccatttgacccagcaatcccattactgggtatataacccaaaggattataagtcattctactatagagacacacatacacgtatgttcactgcagcactgttcacaataacgaagacttggaaccaaccgaaatgcccatcaatgacagactgcataaggaaaatgtggcatatatacaccatggaatactatgcagctataaacgaggatgagctcatgtcctttgtagggacatggatgaagctggaaaccatcattctcagcaaactaacacaagaacagaaaaccaaacaccacatgtcctcactcataaatgggagttgaacaatgagaacacatggacaaagggagggaacgtcacacaccgaggcctgttgtggggtagggtgttatgggagggacagcattaggagaaatatctaatgtagatgacaggttgatgggtccagcaaaccaccatggcacgtgtacacctatgtaacaaacctgcacattctgcacatgtatcccagaacttaaagtataatacatttttaaaaaattaaatgaaattaaatattcagttaaaaaaaataattacaatgctttctacatccctcatcttgtatcatcttcataggaatctttgaggttccaattttatgaataagaaaatgagggtactctgaagttaactgctgtgtttaaggaagagtctaagttagaagatccaagatttaagcgttagaagatccaagtcttctaactataaaatcgctgttgactcctctagccatgaagtcatgaagtagtattgggagcaaggggaagtacctagccagctaaatgggcaagaaaaactttattgaagacctttgcaagaagaaaaagaaattgaactcaactatcctggtacaaatatgtacattattatttgtaaattacattttttaaaaggtgggaaggtttttaggcaactgagttagctagcagaaaagtcctggagagctttaagggggagcggctaatgtgattaggccagctgtgtttgctcattggtggatatcaaagttattctcccaccctctcgaagagactaggagatagcgatgctatctttataattacatttcaaaggatggctcccaggtactgagaaagacattcctggcttatagaagacttatatgtcaaaagggcaaataaataatttataattataagttttcttatgtaaacactctaagaaaagggaggtcagaggcctgtagtcaggaagaaatctgtctaaacttttctcaaagtgagggagaatataaggcaattttggccagtaaaagggatgaatatatttgcattttgagtactgttctagaaaatgacttattattaagtgtggttgttttaggattcttttctatgtgttcaagtgacagaaattcaattctaattagcttattatcttaatagttcagacccagagtggtacaggtgctccaatgatgacaccagaactggccttttattatacggccttttcatctatttatccagctaaaaatgtgcctttgttttttgactataagttacccagcacctgtttgcatgttaatttcatgctctcctgctagatgggctctctgcacatggtgccccacgcaagcaggctggtagtaaaagcaaatttgccatgacccatctcaggagctcactcagatgttcatttgccctagacagggcagatgtctcatccctccattacccatcctcccagctcttctctctggaagaaacatgattcttttgccacctgagcaaggactgcctcccctactcccaccaaaaaaatagggaaaaaagtgtttacacattaaaagtcttccttctaccccttgcaaattttgagccagtatcctaaagaattggttatgctacaggatgaattcactctggtgatctgggttagagagattttatgttttgttttatttttttgctcattcttcctagtcactaggattacagtgagtttccaaatgattaactgcaactgagagaaaaccacaaataagcactgccctgggagaaggccagtgggaagaacactggctggctgctgagataacaggtgctcctccagtgatctattcagccagccctttggaggtggtcagtcgccaggttttatttcagtgataaaagagaagtgaatctggatctatgatcaataattcatgctgcccattgggatttagcctccaatctgaaccttctttaaagggtaaactataaaccacactaaatatttagaaatgaaattttaggattatacatttataattgccaaagctggaaaaggccttatataggcctttattattttatgagggaggaacttaaggcccagtgtggttacatgtttggcctaagtttacatgaatctgaagaaataagaaagcagatctccattgctagcctctcttttagctttcctattgcctactcactcatttcaaaactcatttgatttttctctaaattccaaaagaaattaaaccttacaatgaagtttctcctttctttacataaatatacagatgttgtaagttttctttaaaatccatatataccactgattttctattatttgttcatctctaaaatccagagaatgcactaagaaactgaatcaagaaacctatggatttacacaattaatgcccaatgaatccacttttgtcagtgagtataacactgtaaagagaaagaggagttcgtcacacaaatgataaaacagaccccctcagttactcagaaacagatggatagagctaaacaaaaatctttcaagattacctaacgtgtaagtaatggagctagatttaaacttacgtttctctgttagagttcatgttctttgattcacatcacattaaaaggcaagaatttatttgttgtgcaaaatcaccttctgtgattcttacttaagaaggaatttgacagaatggtatcaatgaagttctcctaaatggagaaatggaaagaggtggtttttccagaacagtattaccaatttctggaaaatacacattttaaataatattttgtacttttggaaacagacagagaagtctaatgacttaggagaattaacaacaaaaatagtggtaggactagcctataagccagacatcttaccttcagggcctgaatactttccaccacattctgccgctaagagatggaaagagagaaggtctcatttattttgacattagtgatttattcgctaaataagccacattgtcttcctcatacaagatagtagatcataaaggtggacagttgttacacagccaaactctgacagccactggtgcaactcaggaatcatggtttcctcccacctgctctgtttctttgacccagagaaaatacaaaagggacagtagtgaaagaaaccccacactgggcaaggatcatgccctagaagttttctggtgggcctcatagtgggagctggaggcttggcttctttgagctattttttggatgaatggccaagaaagagaggattactgtgcattacttgtcccttttgagcacagatctacgtacttactgcaaatgtaacctctaaatggtatctgcaccttgcaaatcccaggaatgaattgtttattttggggtaaatatgagattaaacatttgtaaagagttttatggagttctgccatacctatcatctcattaaacctgtgcaagccccattgagttactatcctaatgttttatatgaagaatctgtgtggacttgaaatttgtccttatgttttcaatctgtttcttaccaatctgcttctctcttaatgacctttatttactcaaagttgcagaaatctgaagaaagcattcaggggccctaagtcttaatattccatatgcagatgctgggaatggctcttgctttatagatatactttcttccatgaggaggacacatcacagcggaaacatgtgctcctcttcttactgcagataagaggaatctgcatttggactgatgcttcatcaataagtttgtgttcttgactggtaacttgtgatctattatttctccatttggtgtggcagttgcccagctgcaatgacctctttgtgaaagtcctcaattaccctcctttattcttttcaaaaaattatttctactttaaccaattcacttcacgggctttcatttttaaacaggatgagttttctgttttagacaaggtattctgtgtacagtagagaaaaatgatagaagcaggagaccatgactctattaatgtgtccattaagtgtagcagcctttccatgcaactgtacagcctatacatgtgaaaactggcacctcagcccacactgcttcctctagagaactttgctgtgctttatttcattactgtttctcatttctatgattctaacactactggttcaccataattcttactagatttttttcttattgacaaaccaaagttgctcccagccctctggcttagtgaattcagagttccaaattcaatctgtagactacgtggatttttgtgtgtgtttattcttcattcttacccccttcttttcacaatttaagattcccttgaaaagaaaggatctttgtaactaacaccttacaatccagtatcccccaaatagagaaggagagtttgggccatttcttttccccactctggaatcatcaagttgtatgatttgtatagattatgttccttctatggatattcttctaaagaaacagcagataacatgtactgtcacacaggaagaaagatcagaaatccaaaattgaaatgggcatgagagagaataaaatcaaattccttctattttacaaataaataaattttgatgttaaccttaagattttagatcatggaatccattgagaatctgataaatctacagacaaatcagaagaaaatgtgtgtacacactcaattttcaggaatcttagagacatactaaagcccaattacccttgcataggccaagtttgaccaagactcagtataattggtgtttaaatcattaattttggtagtttgtatggaacacaaattagttgtcttatgtttatcttgcattcttcactagtcttttcaaccatattttattaatatgtttacataagctgtacacagaaaaaaaactggaaagaaatgtactggaacataagccaaatttaagatataaatatttttgactttctatagattatttttgagtttttataaatagttacatattaggttaaacaagatgttatgtttaaagttcatatataaccatatttttcaaccaggataaaaagttttgctcaacagaaattctattatttagtgtgtaaacaatcttcatttatgtcacagcaaaactgagaaaattgtaaatcaaaattcttaaccagatacatctgatggtgaaaaattatcaggttattttccatgttaaataaagtacaacctagaaagaaaaagcaggctctctacacttgaatgataaatgatcataaataagaaatgttataaatgtactgaatcatgaaataaagctattataattaatcatgaaaatacatcatatctgctgtagacagataaagaaaaaaatggtctcagcaaaattccaagctcaataaagagtttaaaaagaggctttaaaggtaagtgtttacaggtgacttcatgttctcctattaaataaaaaaaaaacctcttatttaattccacagtaaagatatataatagtgctccatcaggattgacagacttaggttaagtacttcaggaagtctctgcaggacaaataaatgagtatatatcaccatgtcagaaagttactgaataaaccagtgaatatgtttctcttatcatgttcaagataaagaggcagaaaatgctgagaactcaggaatttacagcaatggagaatttgtctgaagtagttcgtgagacagagtcaagatctgggttcattactggtaggtcagagtctgattatgaaaactcgtgtccaaacctgaggtctccacagaggacttggttgcttgtatgtgtatgtgtgttgcagagttggtgggtcagggggcggcatgtgttttcattactgaggctttttatcatcagagaaagtttgtcataatccttgatctgaacatgagtaaagggtaaattatccaggattaaaagcaaaacaataacgtgaaagaaggtaaattcaggaagcatatgtcatcaatttgaggttgggaagttacggaagaaaaagttctgttctcagctatagcatcaattcactgaatggcctttggggactcatagagttggaaggtggattacatgttgtacttgtgatgctttctattgtgagataatctcaactcataagaatttatgaaataaagaagtgggagggaggttaatggcttacaaagtgcaagtaaaaaaaaaaaaaattgtggaggtgggccatcagacacatctgaagccagaagtcggagtggtagtaatgtggctcattgcgggttctcactgctcagagaaaacaacattggtccattcgaaagaaaaaatagaaattttatattttatgtttttttaaaaagctatgatctcaggtgtgtcccagaatcaagtaggaacgatggatgggatgagtgaccttttaaatcccgcatagctctaagagtccgtgacagtctgtaagttttagaatatccagaatgttggttttttctactctatgaagttggttccatttcttaatagtaatattattattatgtcaagagagctgtttcagtttccctaaggtaaattattaagaggcagtagtaatctgttggataattgcataaggtttggcatcatagtgttctggattcagaatgtatcaagcattaatcagttatggaaattgacacaatttatttcactttccttagcgccagttacagaatttacaaaatgagaataatcatatttattacatcataatttttgaatattaaatgagctcatgaatatcaagtacttactacatacccacatatagaaggagctcaaaaactattactgctgttactattattattgttggttttgctgctgatgatattactattagtactacaatttctactgtagtaataatattggtatctcttttcacacagctattcatttaccactacagagggctcaatgcataataacaggagaatattacatattgcaagttctggcaacaatatttccaagactgatcactgcaccttcccttgaatgatggatactactaccctctgtcattgattgcatcacaatcctgtgtttttacaatacagtttatttggttctatccctttgtcaggtcattttttcatgcttagaggtaatttaagtcatgcaaagaaagaagtataacacaaaaaatgcctgtttgtctttaaaataactgtaccaaattttaaataccaatccccagagtgtcaataggaaagataaacaccacttacctagtactttcaatttttccatttgatctgaactgtaatcctgtgagatacctatgatttatatcacaactatataaataagacagctaaagctataaatggcacttctttccatttgaattctaagtgactggtagagccaaatgttgattgtgagctgttctttccactatagtctgtattgtgtaatccattaatctggtcagcaaataatttaccatattcacaattcaccacatctcactcaatttacatttaaagggtttggttagagccctcattggcttaacaatttctctctctttcctcttgtaagtatcttaagaacacaaaataatgccctagttgcatctatcaaggagctagatactactgaagaagagagaagagatatttctggtggtggaaagccaagggggattttagatttcaggaaccttgattgagaatgagttggaaaaataggagatccaggggattttccttaggtgagcacatgggtagtcctacagctcccttaatgatctagaattgaggccacaacattcgtatgacaaactgaagtagagtagaaaagagtagctactctcagattttcaaagttctatggcttataatgcgcaaatcaagctcaaatggaaagtcatgctttatacattctgatctctctctctctctctctctctctctctctctctgtgtgtgtgtgtgtgtgtgtatatatatacatatgttaggctataagagtagaataaatattggggcttagattcctccttcccttctatgatagtggtttattgatccttactgatcttcaaataggataaaatagaggttaagtttcaggaaaagacaaaagaaggatgcctaaagtttgataatgcgtagtagatactttctcaacatgatgagtctgtggattttctttagaattagggaatggctttcaagttttttttctaataaatatttccttctaattgggtacactctgggaatatttgatcgtttcaggatttagcatcttttctaagtggtttactgaagtaccactaatgtcccaaaatatacaaaatgcacacatatcctgcatcaaatctcttctcttacacatattttgtgcttctactaaggatcgtgcatctgtgttcacctttgaaatccaaatagcatggccttcaagagcatggtcatccttgccaagtgttagacactctttgttttctattatagcacctgtcctaagactttaaataagacctttctttttttttcaaattaccatggaagtgttaggaatttaagttttgatatacacaatttgtttctccaggtcacatctgcttggcatttaaaaatgagcacaacaaacaaaacagaatttctctggcttttacccctacatattgttgtggacactgcagcaacctctgaactccctaatttacatcgggagtctccttgtaaggatgatgttttgaatgggctgaccggatttgtccccacagggcagggaggtggaacatgggcacttttattgccatttttagctgatgatgttatctgtgtgataatacatatttccacaagccacatgggtgtggggagtgggtactgctgctctctagattgtaagcatagagggccctcctattgtctctatcatctggccccgcacacctgataaacttcaattctctccattcagaccatgaactccatgaacctgccatgtgaactacttaatgttcctccactgtgtcaaaatctctgtgggtctcacttctagctcgaattttcctttgcttccatttgctctctcattcttaataattcttgacttatgtccacagttatttccttccagagccttcccgggttctcctagacatgttctctgtatttttcccctcaggactcttgcttctactataaatgtctgcttaatggtttccatttctggatggtgagctcttgaagacagaatatggtgttaaacatcgttttattatctgtgttttgcacagtgcttaagatgcagtaagtatacaatgaatacttgctgcatgaataaattaataaatttctaactcaaattcattgtaatttctgattgcacataatgttttggccaaaaaacataattttagacttttaaattaactacaaatcctatcaaaactaaaagcagaaagaatagtaggggtttactaaaagtaaaaatcaaaacaaaacccggtgggaactcagagtgggaatgtagttaatccacttctgtaaatatagtactatagcacatatgtgagggggccaattatttactcactgactaggagaaattcagcaaaattatctgatggagccattcacctagtacaccctagggactattctatccagagaaaaatgatctgtgataagtgcaatttctatgtgttcaattgtttttttccttaagtgcatagtttcccaggctcctggcctttccagctcctgggggaatttctgataaagtgacaatgtggtcaacatatccatctaacctctttggagatacacaaatagaaattgtactggagtccacagctccatattctcatgagttgaagaagctgttgcagaaatgggtttataaatgtaaatactagagctgtcttagaatgtatctgaagcttctctcagccccataacttcgggtagcctgaaaaagtttcctatagaaagtgcaaagtgcttcccaatgtcaacctcttaaccacattgctctctcactcaatgataaagctggaaatctctcaacaaacctttttacttttgtattagcaatcacaaaatgcaagagttccctgaaagccacggcgggccaatcaatgctgagcaaaccacaacaggaatcctgtgggctcttggtggaaagtaaaaggctcattaaaaaccagtcattccaagataagaagaagatcagatcagaatttaaagataacatcttttcatggaaaactgatattattgttttgaaaagaaatataatactaataagtatactcatttaaaaaaaaagaagaaaggaagcttttccattaatgtaaaatctgatgaaagctaaaccatgtcattaaagtataaaagaggctgtggaatgcatgagacctctgagtaatgtgtggcattggtccatgtcatggcctgggaaacttcttggttcagtcttagccacccgtcagccacaaacaacaatctatagcttgttgcattggcagtataaggataagaaactatggcaattaattgaggagagacgtaagaagaaaataatttatatgggcagagagatccaatcttagtgattaaaacaataaataatagcaagaaattgctagtattttttgagattttactatctgctatctctgtgttaagcactttctatgtattagttcattttaattttgaagaagcaccgtttgcctttctcagttggccataaagatcacctctgtcttatgtagccctgagtgtgagctgagggagaggccctggtgcaactgatggatgacatgaaggtgagtgaactggttgtgcagcataattgggccctgtcccggatgtgacatttccatctcacaataaattgctactgggtcttcctttccaccatctcacaatgctccatttttaccaagacctagtaacatgctttttagaggagtgtacaaattcatgctgtggttggcacagccttgctccaggactctagaaaactctattgtgggtctccatttgaagctcgtgataaattccatgtggcatcttgtccatcctagaaactttcagtaacataagctctggatgatcatgtggtacaaatgacagggctacctgaactgcagcttgagcctgcttcacagctttctgtgctctgggcttccctcaaagccatcagccttgtgggtcacctggtacatgagctgttgcagttttcttaggagtgatgcttgctgcctccaaaacctggagagccctacaaggcgttttgcttcctgcatagttgaaagagatgtgagatataataatgtgttttttattttggagggaaagtcatagcctatcacaaatcattgacctaaatatttcattgatggaatgtacctcaaactttgtagagtttattcccatccttctggagcacatgtataataataaggtctcagatatactgctacttttggcacatacaatgtaataacataatatcatcaagacactgtacaatgtaaatttacttgtacaatgttcaagtaaaatgttctatggagggtcagatggtctagatctcttcagactatattacaaccgaaggtggggaagttacatagccctttggaaaggatataaattaatctactgttaacttttacatgaatgagaaaagtttatctgtgccctttctgataaggatagaaaaggatatattccctggagtaattgaggcacacatgtatcctgaatgtatgttaatctgctctagcaaagatactgccttaccactgcaaatggaattgaggctactatttggttgagtttgtggtagtccactaattttttcctggaataaacctaggttttacagggaccagattcttggcgtaaatgaagatgaaaaacaccactgcttaatcttttaaatcttttagggtggctctaatttatgccactccactctcaattttattggcactttctattttgactagaggagaaaattggcttaaaagactatcataggattttctactgtaattgttcttaccccactgtacaagcaacaaatgtggtgcttgggctgaattcaacagttctttttatgtttagatattcctacctccctagtgtctggataacagggtaaatcacaacatcccttcagggcaactgtgagagtgtcgtttctatatacacatgccacactgttgtggaatctttttcctggaggcctagcctttccttcatttgaagggttcaggatcaggaaactatcttgggtctagaaactaacgaattatgaatttttattgaggaagttgccctcagactcctaagtatttgcctttgttctatttgtatagaatagtaaatactattgttgatggacaatcctccttctcctagagatacagagctctgctaaccatcctcatgatctctacaggtcagattcctcttaccgcaactttagtcttagtgctcattatgataattcagcctgccttttctttggaaccttgaatgccactacttcattcctatgatttcagaggtctattatcacattgctattagtgaggccagttccatactgagatcttctggtgatactggtgcctctcttaccagcccattcacccttgctttggtaacataatgcccgccaacacctattgaagaatatagccatctggtggttattctggccttacttattatgttcactataacatatattctcctctaaatcatttgatccactcttctgccatctgctgctgcaattctttcagcagtgggtccagaaatccactttctgaagtgggtccatcactttcaacaaatggacccacccagcaatgtgttagacccatcctttctggtcctttacagggtgttaaatatgtaatcttttatgagtgctagcaaatcattaactatccctcaccagattttgtcttccaattccctcccctcctccagacgaaactctcagaatctagtactcccataagtacttttctggttcacattggaaagaaatgtctaggtttggaagttacaaggtacagcatcttttattctttaggaggtctagcgtcttcctggccatattgtgctgtaacttaatccttattattggactggtagtaaggagaaaaagtaggatcagattctggaaaacataagaagatgatatattttcttgcaagggagtgggcactggattattgtctagcagaggtggtagggtagcagggtgacactagcctttacctgtgagaaatgagccatttttactagtccagaggtttcattgtaatcagaaaatttaaaaaattaaatggtcattcctgatgttctcattctctgtctccaggtcctgccttattctaatctgtgtctttacctggtatagaaaacccagctagtttgaaatttcaaacttttctgaagctctgctacttttaagattaagggctacacctggtatgccagtttttctactctctggttacaggaaattttaatcactttaaatgttgtcaaagaggacttctggcattgatacctaccatttaattgtttattaaccatgctcagcctttcattttctttttgcagtcaccaaccactcctgcctgatgccactagcaatggcaaaagcaatattttttttctatattgtcatcaactaacctaatttaaatatatttgctgccctgtgctcagtcaatagtttcaattttggctttcaaacaaaatcattatatccttaaatatctagtaaaatatactatcctctctagggaaaatccaatgttaatccacgtgtcaaaatggaagagtgtgaaaatgtggctttttattgttattaaataatttcagatagcatatagaatcatttttatattttataggatggtttgtttctttcatataaaatgtctttcaggattgatccttaatgtcatcttcaaatctatcttctggtctcatttccacatatatttcagcatacatgattgttgccccatacttccttatctccgagtgaagggtcccctaaaatgcctgacctgtggtcctttactgtacatttttgtctgaaagcatgcctgagccaaggaatgcaagtctatcaagtactaagaccatgtataaatccactctgcattccacaaagcaaagcaaaatgtctggcctctagttagttctctacagagttggtaaatatctaggataaaaagtgcatcataaaaaaagagccagacagaaagttagatgcttctaggtgtgaagtagaaaattgtatacaaaagaaattgaaagttgtcaaagtattagggtgtgaacttttaggtatatatatatttttttccattttgtatttcttttaaggaatatgtaatgatatttgtttaaataaattaaagtaaaaaaattaagtaaactgcccaaagaggaaagatattaaacatcagtatctctgtaggggatccctccattccaggcagcagtgaagaaaaggagttgccccagcctcagtgattgagatctgcctttattaccagcccaagctaacttctcagggggatattttcaggtagggtgccagcaggcttaccttgttagcagtgttcctatgttcctggggcaaaaaatctatataaatatttttgtgatgttatcttgatactgttttcatgcaacactttatataacttacttccagagattatgagaattaaggcaatatttacaaggttcctaagttcattggacttaaggctcttaactgtataaaagaaactattattttccacattggacaaaagcaaaatcattttctccccatgtaatgtaaacttgtttcctgactatgtgaggcaggaatggaagcaatcactgttatttaaaacaaaaagaatcaacacgtttggcctgtgcacaggcatgaaacccttctgctaagataaaggcaggaaaacagctccaaaggaaacagcatgacaggagtgtagcttgggatctgtaaaattgggcttgagatttgactctaccaccaacaaactacatggtgctggtcaaactgcaagtctctctgacccttactttcccatcctaaaagctggtataataacaaggcagcaatcgtctctcccttgtctgtttcccaaggaagaagatggaagaataatcctggaaaaaagagactgaatggattggatggtcgaaagatatgaaatccactgaaatagccagacaaagttaaataatattaaatgaaaatgtgctacctgccagaattttatcataaatttaaaaatcaactaatttgattatgtcagtcacctatattttctctgttacaagccgtttacctatttctaattgcaaaagtagagactgtccttccgtaaaaaaaaacaagacctcaaacaacaactattattcaaaacagttaagtgctcacttaattttgtgatagtatttgtgaaatacattttatttcagttattttatgcttatgataacaatgtggaacaagaaaaatcatgagcacatatagagttgagtaaatagaaactttcagaggttctgtgttggtccattcttgaactataaggaaataatggagaagaatttgaatcaaggcccatctctcaaacctgggtttttaacttctctagtatatcatcctgaggacagtggagatttttacatattacttggctttgagaaactcgtcctaaaatgagaaatttgatgtggaaggcaaagcacaagctctgaagtcagaaacgcctgagtttgaataccagctacacaatttcaggagccacagaaaattgaccaaaacttatctgagcgccggtttcctccactgtaaaattagatggaaatactgtctttgaaaatttgcatatggtttataaactaatgtttagaaactaatatatggtttagaaagtagcacaatgcctggcccgtattcagtattttgcaaatggtaatattggtttcgctattattgcaaatagaattattttatttagtataagaataaatgataaaattgtcatggttgtatcccccagagttttgtacgtgacactcagatggatatatcaatccatattttcattcccgcagcataatgctatgaaagttcacgcagaaggggaagaatagctcaggcactactactgctaacagcattaatagcctacatgtatagcacttcctacatgccagtcattgttctaaaggctttataggcagttaagccacaccaactctatgaggtaggtgctatgatcacatcatccatgttgaggatgaaaacttgctgcaaagcaatattaaataacttacttaaggccacatagccaggaatggatggagccagaactcgaagataatttggttctagattctgggctctcaaccataactggttactgctgcagaactcctagggactgcaacagagataatacaagaaggaaagggtaatggtgtagtgacagttttgcatgaaattgatgatttttcttgcaagtaaaacaaaacaaagtcaaaaaaagagacacaaaaccaacagagaaccattgtagcatttctctgtcttccatttttaaagctctacactctttcctggtgagagtgtgtgtgtgtgtgtgtgtgtgcgtgtgcacgcatgtgtgtgtgtgtgaatgtgtgtgtgtgtgtgtgtgtggtgtagtagcagtagtagtaaaagaaaatacataaacacatttggccctggaagatttttccttagtgagaaataaattgtgcaaccatgtaactagcatacatagcactcttcaataatcaaagttccttacctacgtctaattctcatactatgtctttgaaaaaggtgatgatcatgccaattttcaaataaggaagccaaatcaccattagttttggcctataaatcaatctgttctctgactctaagctccacgacttttattttatagatacagtaggtatgtcctgctactatgtaccagactgttctaggcactcaacagatggagataaataagacacagcacagcttcagccttgagtgtctcctcacaagctagtggaaaatagagacaagaagatgtacaaccatacaatacagtataattctctaatttttgaaagagagctagaggggaagagtactggaatgagggtgagaagataaatcatcaataaagttctaaatacaaaaatgactatggttgtgtaaaggtatcagcctcgctgttacctagccatctccaagcatctgtgactgacacatttctacagaacaactgacttcattcctgggtatcagagtgcacagatcatgtgtctttattgatatctttttcttggcatataagccctaagtaaatgtttgaataaactcagttgtacccccatatactttccaatttgaatggtggtgctgtgaggcaaaagagagtttaaaacatgaagagatattttatttcctcttttaacgcctcatattcaacagcattaccatcacagtgtaccctttaaaccgctgcagcagcctgttgaattaaggagtgacaaaaacaagttttcctgtattcttcattaacaaacaattcaacaacacattcacagaattaggcaacgaatcatttgtttctaatgttcacagagggtagtaggctctatttctaacatgtgtagcactatcttgatgaagcttagccaactactcaattcccattgctgctacccttgatgtagtaaatacacagcagaatttttccccaaggagtgcacttaataaaacatatatcatcagttctgaggaaacatcatagtgagacccagtaactactgaaaaatctgcaacaagtctcgtcctgaccaagttgtgcaaatgagagagacagggatgggcaacctgggcaatgacagctatacagaatccacatatttagtatttaactatgggcacagtttttcatctataacaattcttcagaacacaaacacacatacatgaacacacacacacacacacacacacaaacacacacacacacacttcccaggagttaccagtggttgaaatttgattataattacctttcatgtctttcttcagttcctgattaccctgtgtgtagatgactttagcaatcaataagtggttaataatagacgattaagaggaaggaggaggataaagacaagacacttaatcctcagacaggataatcagtttctgtgtttctgtaaaatcaagaatcacctgtgcatatagtgatgctacagggatccatggaatgtggaaaattccaaagagctttggagtccaataagcctgggttaaaaccctagctaaattactttgtatagactctcagtacttcatctaatttgtctgtaaaatgcattgcagagatgttgagaactttgactggggccataaacatgatagttctagcttaacattttctactgcatcagtgaaaggaatgcaataaacagttgtctcttctgctctgctacctgttagtcattcaaccagtagtggggatggttttacactgaaaaatccactcttttaaccaatccaccagaatgataaacagatggctaagtggtatctcagcttcagaatttagttttcaaaatgtgcttacagtgtgctttatcatgtgaccaatgctctttttgaagaccctcaacactttgactgtctggaacatggagatatgtgttgagcttcttgaatcaccatgacaaaaggcaaatgtgaacaactagtgagaactaaagagttcagactcaattttggattgttaccagatgtccaaggaaagccaactgctttcagcacaggttacatctgcttaattagcagtgaaaagcatctttagatgaccacagaggaattaaatagctgcagataaatgaccaaaatgagctcaacgatgctatatcaaacagaggggaacagaacacaatctagtaacatgactgcaagtagaattgcagattaataactttgtgttttacaagttaatggggcacatacagcaccagactggaagtaaatgaatgacaggacatagtgcatatcctggcacttcaataaataaataattttaacactaattgcaattaaattgcctttctttaatatgatcctataattgcacaataccttgttcagtgcctgactctttcctaaatgggctacatataaaagaagttgatttagctaaaatggtcataaatgtaccctcgtacttttcttctattgggctagtgactgctgggcataataactatatccaatgggattgttattgtttgtttgtacaaacacaagaggaaaaatagcattacagtgaattggataaatctgaacccctcttgcactaaaagcagcaccaccttttttctgactcattcctctttctgggatgataaccgttgccaagtgttaaagaaatgttttggttatccagttttgctttttgtctaccttctccttagaattaggtagacaactctctggtcagaaacgctactgaacctgtgaacttggctctgactttgtgtaaaccatccgcaggctaatgcttcccctttgggatcctcgtcttcctatgtgtatttaggtctcttgtagtgctattctcaccacatgtattcattagcctgtttatgtgggtttctgagtccaggaaaaggaccttatttgtatggtgaatgctctaaaaatattgactgtctggattaaaaaaagaaaaattgaagaatgtcaaattcaaaaaaaaaaaaaagttaatgtgcatgtatgtcctcaaccaatgaatacttatttagcatccgtcttgtggaagaatctctatataattccacctgccaagctaagcatcagaagctgtatctgtccagacagttttttaatctaactagtattaatacaaagagatcatctgcttaagaattatatcttaaatgtaagatgtaatttctcctttcaaaaaattaaacaatcactttgcaaaaaaggaacataatattaaatttaaccaacaaacaaaaccttactattagatgctgcactgaattaaatattaagatgttactccttaccagagccctaagcaaaaatcttctattattatcctatttcactgatgaggaaatggaggcatagattagaaaacatcatcacttgtttctctgcaggcaagtgatggaccaagtttaaaccttaaccaaatggttccagagcttgtgtgtatcacaacctcaccatatgactctcaaaaaataaaagttaagaatttaaaggagggaagtcattgatagtcaagaattagagagaccagagaaagtttcaaagcgagatgaactaaaccattaaacaaagggaagatttataagggcagaaaggagcagatgaaggggctctatcagagtgagaaaaataagcatagatgtgcaaatgaatacgaggtgacaggaggaaaaggcataggtaagctgtagtgagcgacaaggccagacagaaaactgtagaagactttgactgccaactcaaaaatcttcagaggtttttgccacccaagcaccccagacagacagtgctgtttaccaatgttttgataccttagctccacaggataatgtctgcttcttcaagaaagcaacaattgcagaggaataaaggactcagatcacaccccatgctacctgcctgacaatgaagaatcctgtaagggtcacaaaaggcctataggaatgtgctaatctgaaaaaagtcactctctccagataaacacatgccttattaagcagatggtatctctgtactagttagataaagaaagtgttgaggctgatatagttactgatagccagcttggctaatgcgacaaaggctggatttcagtgtccactcagttcctcaccaggcttttgcatactgccaagtttgaccaacattgtataccacagacttgatcacaatgcaaattttttgattcttctgattttcaaatgtttttttaattacaaagattgtttatatatgcatatattcaaagtattcttttattctgttcaagaaactgagaagctattgatgtttagtagaacaataatcagttataaaataatctttaactaagtaattctatctatggaaatgcaatttgagaaactttttttttttttgagacagagtttcactcttgttgaccaggctggagtacaatggcaccatctcagctcactgcaacctccacctgtcgggttcaagtgattcccctgcctcagcctcctgagtagctgagattacaggcacccaccaccacacccagctaatttttgaatttttagtcaagacagtgttttttcatgttgcccaggctggtctaaaactcctgtcctcaggtgatccacacaccttggcctgcaaaagtgctgggattacaggcatgagccaccatgcccggccctgagaaacttttagaatcaactttacaaagttatacacaaagatgttcaccatgatataatttacactaaaataatattggaaaaaataaggcaattgcattcatgtgaataatacagtagccattaaaatagtgtgtttgtaattctgtatgggaaatgcttatataacattaacattatgaaaaggattaaattgtatgcagaacttgccagcgaaccatgtttatttcaaataaattttttaaataccaagaataaagttggtttaacggtgaaataatttttaaaatcttcgtagacttttaaatttccagaatcttctacaatgacatgttatatgtattatttttaaaaatcccaaagaaattcacttcaatatacacatgctttctggcatttgtgctagcagctagactggacaaaggaaagagatagcacatgttatttactttgaaagggctcacaatttagtgaaagacaagaaatagaaacatagttaaggcacaagaaaatctgaagagcaagtgggtttgattgtgctagaaaataagtaaatatataaatatttaaccttggcaattgcagagggagaaataatttttttaggagatttagcagataaaaggagattgacaaaggaaaacatagttatcaccctgttggaaaataagagaaaaatgccagcttatcccatgtcactgtaaatacaaataagaataatttccaggttgaaattcaacagttactactccagtaagattaaataagatggaggaagatagattggaggaaaaacagagatatcctttgaatgttctttactcaagaaattttggagtggttctaataaatttatgattttattattcatcaataagtctcactttgagaattctgttacagttgatctgtgaattaaacttttagaaatactttatcgtctcctgctgcctactattatttcctaaattatgattttgtttacattctagttctcaaagtaactatgttattatgggaaaaaaaatctctttcctttatttggtcttaagaaagtctaatgagcatggtcagcgaaccaagcacataatgactccttgtttggggttgatttgtgtacgcaaagtgatatgttgaagtcttaacccccagtacctcagaatgcaaccttacttggaaatagggtctttgcagatgtcctcaagttaagttgagatcattaggtgggctctaatctaatatgacccatggtcttataggaaagggaaagtcagattgacagacacatacaaaagagaatgcagagacacaaggcaaacagcctgtgcaaatggaggcaaaggtttaactgatgtattcaccaaccaaggatgcccaggattgcaagctatcagcagaaaccaggagagaggcaaggcctgttcttcctcaacaatgtcagaatgattcagccctgcctacacattgatttcagatggtcagcctccaggattgtgagaaaatacacgcatgctgtattaagctaaccagtttgtgacattttattaaggcagcattagtgatagaggcagaaggcagacaaatgcctaggcagataggggcaggtccccagtgaaacccgaatatcaagttggaaactgtctcaggtaaatccttggactgcattgagaacatgctttcccatttggtgcacttttctctgattgatccccatcctttacctattttaaatatacctaccctttcctaattgggtttctacactgttgtcaccacctttgagtggtgtcttcacttgtactgtttttgcatactcacaaaccaatcagtacacgctccctatgctgagcccataaaagccccaggctcagccatattggggaactttcctgtcttcaggtaggagaaccacccccctgcatcccttctttttgctgagagctttccttttgcttaataaatgctactccactcactcaatccttgatggccacatacctaattcttcttggtcatgagacaagaacctgaacttagctgagctaaggagcaaaaatcctgcatcatttttgtggctagtatggagatcagaggaatggtaagtaaaatgtggacctaaaaatcctctttcacttttgttttcaaggcttctcatcctcagaccttttttctgaaaacacatggagcactgggtctctgctagccaattaagaatgaatggcacacctgtagagactgctacccaccccctattaccatcaagggttgggaatgttggccctgttccaatcctgtgtgtgtgtgtgtgtgtgtgtgtgtgtgtgtgtgtgtgttagacagtttccccagctggagtgcaatggcatgatcccagctcactgcaacctctgcctccagggttcaagtgattttcctgcctcaggctcccaagtagctgggattacaagcacatgccaccatgcccagctaacttgtagttttagtaaagacaggtttcatcatgttggccaggctggtcttgaactcctgacctcaggtgattcacccgcctcagcctcccaaggtgctggaattaaaggcgtgagcaactgtacctggccccaatccagtgttcttttatgtcattttccctcttcctttcagggctgttatggcacctacctttttttaacgatattggggatgttattgcaaactgccaagatattactagatagaatgagcctttggcccaggcatcagatatgcaattcagaaccatgcaatttctgtctgtttttataggcatccccaacccctaacttactggcctcaggcagcacgagatggatgggtgagtggtagctccctgctgctaccccatcccctcccagctggggctcatggccatgtctgcttcatgcacacactgcatacaatagccatgcggggctagaatgagctgcagctgccacccgggccacaaggtggtttcaggggctaaggacccagtgtgtctggctggctagtttttcctgttcgctgtcccttcctgcctcgtgcccacggagtatttcctcctatggctgaaccaggaagagggtacaaacaattatgagttttccaccatgttggaggaacccatttgaaaaaagccggaggcttttgttccttcagccatcttcctcaccctgcactaaagctgtcttttttttttcccttttctccaccatgtcaggagttaacacatagccctgtgaatacagacagcttttctatatgagaggttattttttccttttgaaaggcatcttgcaaagccaggaccccaattcacaggactgctttttctctcccttgtttcaggagggccacctgggacttaatgagtccatgaaccattctgaggcacatttttgtcccaaagtcaattacaagctttgggttgaagtcctagcaaggaaaactggatccagaggccagatgacaatggaagtcaaaaggcacagtgcaggtgagcatgactaattcctgccgattagccacctcatcccatctcatggacagagaacgtgctagcatccatggcataggtaaggtttagggaactcaaaagttaccaacagcaggaagaataggcagcacgtgggtgaatgtggataattcccacccctatgcctccctgttaacatgggtgaaagccacagtggcacccatgggtggaaccctgccaaggtcgctgggactcagggatataaggacagaagaaagggggacacttcttctttctctccctcacatacccagttattgactgggaagagaaagaaactaggaacaccttgttcccttctttctggatgggtaaccaataactttcagtctgtatttcactcaaatgcctcctgaatcattgtgattcctttggggaaaagaaaagccttatttctcctttgtcctcatctgtcctcaatttgcaaatgggtaattgtatcccgtaccatggaacactacccttggacacatcccccaaactgagaaaagttaatttccccaaaccttaaactgcttggcttaaaattgaactcgggggaagggagcccagaagcatgacatgctggcaaaagagtaaaagttcttaccagtcagacatctggtctccctctcactgaacacacctgttgaatgaatgataaaatcactgtttatatcctatgtaaagttttgattaatgggaaaaatttctgaggctagtcttcagctgtagccaatctggtgcacattgtgtgtctttctgtatggttatgtcatgaagaggggtacttaagatagaatgggggcctaggaccccataagcccactgttcaagccagcctgccaaactggtcattaaaaaactttgctgcaggtctccatcttgttttatgtccttggaagcttgatcctctaatcacatggcagcactttcttttgatatccactttttttacaatgttggcccaggttcaatcctggcttagggaatgactgctttctggttaatacctgtgtgacctttgccatttgctgattcccttcctctccgtgaacaacttctagcttcctttttaaaaatattccttcttctgagctacctttacaaatctagattttgtaaaaactgcttatcacctttttgaaaatatcttctacactcatggttaactcataaccttagtcgaggcttgttggtttcacctgtgacattacttttggtaaagttcaaaagctggaaacattggccagttgacataactaaagtcaggtaacaaggagtttaaagggattttcttaaaaagcaatcagcttaattaaagtgaatatccaagctataggtatatttaaaaggcctttatgtttttctcttcctggatcttgtttttgtggaaaagatttttttctctgtctactgaattgcctttctccattttgtcttgccactcttaatgcatgcatgagaggccctaagataacttctgatggactgggagactcctggagaaaaacaaagaaggtgcacaaaaccaattttggggaaaacaaaaacttctctttgcctcatggaaccccaggaattaaaagcagatagatctctctcaaaatctgtttttgtcttccagctatatctgcttattaggctctattaaaccacatgctttcctagccctgtttcttggagggcttcaccctgcagccaataattcaattaggagattgacagatgaaaaatcttacaactattggatcttcttctgtctttctgtgtatttatacgtgtggtgtgtgtgatgtttataaagaagagctctaattaattggtctagagaaaaataagtatttagatcaaatatttttgaaggaaaaataaaagctataacaccttttagttcatgtgactttaatgtttgagaaatacaaacatttttaaagataattggtaaaatacagatgtcttcaaaatgtaaatatgtgttctaaattaggggtggtcaaatactcggtttgcgaaatgttttaaggatacagactgcttctttggcttttgagaactgttcaacttgcctgatttacaatttgataaggcctggggacatacggaattaactacattcttaaatatgctggaaagagacagacttcatttgtgcctagtacataattaaaataacttagcaggttttacactaaagttaaaaattgctaagagttcccattataacatgtaattgagactgctgaaaataaatttacatgcaaagcgtgtaagaaaagtaaaatgtgtttgtagtgaaagattataagaaggcatgggaatgtaaatttttgcctagtttagagggttaaaggattgttttgaattagataagataaagctgaaacttgaaataaattatggaaggtttgtaaaaattagtcttacaaaataaattgtatgtgtgaacatattgactaacttcaaaaatgcattatatggttttgccataaattgaacatcagaataaaagcacaacaaggttgtattagggtactgatctactctttaacaaacatttttaaagggttatacaaagtttatgagaatctcacctcgtggacaaactggttaagattgggtagaattatctataaagtttcgttttaaaaaattgggttgacattagtagtagactaatgaaagggtgatatttggctttctccccattgattttcatgtaataataaaggataaggaaagattttggtttgccttgcaaatatactaccaaaaaaaaaaagaagaaaacaagagatagactagttggaaaactaagtcctccctcttaatgagtaaaggtttttgccttgtttaaacatgtttgagtcattattttggctaaaataaataacttatagtaatctggaattctagttcataatatcaagtgatttgaacctctaacatatttaatgggcttccaaaaatcaaacttcagcttcaaaaattgtctttcctgacccctgagttttggatgatgcagagggcccctggagcatctaagagtgaggtaaccagaattatttcacatgtttagtcatgtgggattgccaaaataacaataatatttgaccttcttcaggttacattttagtgagtaatgttaatatatgttccaaaattatataggagttctaaaattctaatgttcgagtatatgctatcaatcataattaaggttactaggttcagttaatgtaaaccacggaaataaccaaatttctttgtcaatcatgttttctattgtaactaccctggaccttttgtcattcacagacaattattgtcttgtttgatccttttcaaaatgtggtttataaacaggtataggacttttacaggtgttctcaaatgcaggtttctgataaccttggagattgtgacattggaaaaacctaccagactcatgaagagttgatatattcatgaatatcaagcagaacaagagttaacagaatggactgaactaacggaaaactgaagtaatctttttaacctttttgtttaaaacgttgctaatccttgttttgtttatcagtgtcaaggaaacttattttgagttttttacagtctttaataattgagtaaggtatattactgtgaataaaatttggagcatatttgtttctttctgtctggcttctccagaatttggaaactatctatgagtattcctaacttacagaaatatagttttttgcatcagtgcagtaagaatccattttcttttgcaacaggagacaattggaaaaactgattgttttatcaaggctttgactaaaattatatgtttccctttaagtaatcaagcttgacttgcagagctaattaaacccccttaggaaaactggcctcatactttgtctacacagtccctgtacagggttcctaacctgtgatgagtacagaatgtcactttctgacaagaccaggagccccatgttcttgggacctcaagaagagagagatttacccaactcatagttatttgagggtacaaactcatggctgggctaagctttaaaaggtctctctgagattccttgtgttacagagttccatcaaagccaatttaaaagcctatatgaaaaataattattcttgctgcactttatgcaaataatcaggccaattgtaagactaaggtttattttgcagaaaacttagtcctatcattatttgtttttgagaaataaaatgaggactggagaaagaaagattatgtttcaaaacttatcatacacttgtcattaaattctaatcttatcagttgtttttaaatttttacctacattttaggctaaccctgcttattcctgtgaaccaacggtgatctccagctgtagctctgaagaaacaaaagggatgggccatcaaactccaaatggtcatgcaactggaacattggacgatggctaccttttactggggaccctgagataggcctgcctatctgactgctgtttttgcaaaacagcgccccctgtcagcagggggcagttaagatcagtcttcatccctatgctaacagcacttagatgtacctcttcagagaggaaaatgatagagacaggaggcagacaaatgcctaggcagataggggcaggtccccagtgaaacccaacctttaagctgaaaacagtccagggtaaatcatcagaccagattgagaacccaccttcctgtttggcatgctgtcctctgattgatccccatactttgcctattttacatatacctaccctttcctaattggttttctacactgtcatgccaacctttgaatggtgtctttgctttgaccattttttgcatactcacaaaccaatcaccacacactccctattctgaacccataaaaagtcccatgctcagccatattggggaactttcctgtcttcaggcagaagaacagcccccttgcattccctctgtttgctgagagctttcctttcacttagtaaattctactccattcactctttgatgtctgcatgcctaattcttcctggtcatgacacaagaacccagacctagctgagctaaggagcaaaaatcctgcatcactagtatctgatacactcctcaaggaagctgaaaaataatttatttaaataactttccaaatggaagtcatcaggagcatccaggagaactctgcctatggtattcctcagaaggttctctaccatggcttagatggcattgagggccttggaaccttcataaaagccttatcccaggttgcttggctaaatgacacttcagttaacctgctgcttcccctcagaactgtcagagattttttcaaacaaagacccaaaaggaggtaagtagacttcccctcctttttaatgcacaatgatacacattaattttatcagaaaatgggagaatgtgggttttggcagtgagccacaggccttgtgggctgcagagtttcccctttgcggaggttttacagagtctgttttcttagtttgttgtacttacaatgtcagtgtccagctgctctgactaattgaggcatccggcttcagatggcccaggatcatttgtgcttaggtgtacatcttattttgtcagcgtgattcacttccactcccagacctggccataggaaattagcttgctcccaaatgaagatgaaatcaatagctatttcaggtcccagggttttagttaacaagatattttattaaattacggtggtatatgatggagatgttctcagttcttatcaattatgaatgacctcctttttgagaaaacaagatgtgtcttctggagccagagatcagccagccacattgctgtgtctgcagctactggcatcctgagttagcagacaagcagacttggctttcatgatccatgctctaatctaattcaattaacaatccactgctctcattctgaataactgaggaaggtagatctctgcagagtagatcttggccttcacaaaggcctacagaaatttccacttaatcccagcatcctgggagaaagcagggcatgaattctacagggctagctaaagcatggggactaactgggtattctggatgaacaaagatttaaaccatgttagatcaacattattattcctaataatggcagtgatggtatgctaatagctgaaattctggaggtctttctgcccaaggccctgggataagtgtatgtctcacttagtcttcattatgacctatgaattggaaagtatcaccgtctctatgatttttggacttagggttgaagatactgagtctcagaatggaaaagtgatttcccaaaggccaaatggctatttattgtcagtgctagaatttaaggccagatctgtccaattcagaagctcatagtctcacccattgtgatctagtcctctaacacttcttctaacaccccaggttaatggggttctgaggaacctgtgctggaggacctgagttccaacagctatttttttgatatttggtgtctatgatctcattgaaagcctctgtttgatttcagattgttacgtgtaaagggggagatggagcagggtgagaaatgtctgactggaccaccaacagataaaagcacacatatgggaagaggaagtccagatttcatggcatgtcataaggtactagagcaaagcagtaggtttcatttgttattttgttttgtagatttttttttaaaaagatcctctagaaaattcaagatttatcatagtggactaagggagaatattttgtttgtttgtttatttgttttcagtatcagccactctcagtgatcagatatagtattaaacaacaattataaaagaataagatctgttcagtcctctgtgggatagtatagagcaagccttaacaatcccatttgcaactgaagaaattgaggctagaatgctaagcaaactgcctaaggtcaagcaactgtttttaatcagcagagctacccatggttcttgtgtctgcagttccagatgcttctttcttgtagctcagcagcaaagaaagagaccccaaggataaggtgctggggaaaggtcttttcctacatgcagagtatatgggacagaccagagttgaacattcaagctgtggccctaaatcattcttatttgctctattttgtatatggaacagtttgaactgtgtattgttcagctcactttcctgggaaggagcatggagtaatcagacagaataaagggtactccattgttttgctggccagtaatgatagagagctctggtagagtctgcttttaatagaggcaatgtaataggcaaggctttttgtattggtaaatgtcagatgccaggctttctctaggggtgaagcagggtggggtaagtggaatgttgagatgtcagtgcacagggatcttttttgcttatgaggtcaccataagtgatgcaaattaccagaaaatccagtggctgtatgatcacatattctgcttctaacagtggcagttgtttcataataaactcattataaagacaacagttcccatcattgccagttgattagaaaaacaactctgattattttttgtttcaaatttttgggaggtgaatcttaagctaagcagaaggaaacaatctagtatttgagagctggactcatgttgcaactagtctagtgttatgaaaaactcatatatgtggtttctgcatataagaagcttacaatctaaaagaggaaaggagtcttagacctttgtaacaactggagaaacagggaggtggtttgctagaaaatgcaatcagaattggatgataaaaaccttcctttgtcactaacaagtatattatggtacataaatatataggcttcacagccagattcaagtgagtttgcattccattttgaccactttttagctgtgctcccctatgtgtatttattaattctgaaaattaattttattacctgtaaaataaagattattaactgactaataggatttttgtgaggagaacattagacaatgcagataatttttaggttggatgatttatgtgcaaatttaattctgtcaatattgcaacttaaatacacatataataaagagaaattaatatatatttttcttactaagtattctaaaactcatagtttagtcagaataagagggggaactatgttaaagatatgttaaagaaaaaaatcaattcaattcagagtgttgttaataggaccaattatatctcaatgggcattatgagaaatgatttgcacttactcttacaactcattttttaatgtgatgcctgacaatataacatcctaactactgaatcggaagtagattgacatggaaatataatccatccttgtctttcaaatgatcagctaacaaacaaacaacagttgatggatctgtattgcagagtacataattcaaaattgcatttaaaaagcctttcctaatttcatgtacatagcgagtacagtttgctattaaatttatgtgtttcatcctgttaaatactcctctgctgaatttttctcactcatttctctgagaacacagttcatcttcaggcttgtcaggtgctctttccccaggtcctgatggacattaaatctgtcagggagaggcatattaaatttgactacatgtttaaacagtggcagcctgaagctcttgagtcacagtggcactgaaggtgacatattatccctcatgtgccattttatactggaagctctcatagctgtttggtccccaccattccaattagaaatgagtgggatgacatttgcagtttctgtttctctttaaggggtccatcttctaaagcagaaaagtgacataaacctcggggtacattgccaactgttcaggcacacagtgctccttttccaccttacttttccgttggggtgggaataaaggaacccagaattatgtgattgcacatctccagggcaaggggacactcattctgacagctacaaagcatgcctttagaaattactaagagttggtttaaaaactgtcatccaaggaacaaggcagagatgtttgttcccaaagttgacagcttctatctggtgatcctgaagagttctaatgtggtcgaatccagcacagctttcctctaataccctctgttttgcaattaaagtcatgcaaactcattgaatgacagtattttagcaaactgaactgtataaacaagggattgttttccatccttctagcaaacagtattgacacatcaactctgataaaaataaaagagattgtggtttttgtgaaatatacttgactgaaagttcctagcacagtacttggtactaaataggtgttctgtaaaaggatccccctctgtcttcatatagggcactctgcgtccttcctttctgagattctgaagacccttttagtgactgacagagacttccttcctcagcagaagttaaggttcaggaaatacctttctacttaatagtcaggcaaatgaccaccttaaataggaaggaaacattattgctttgttaatgctgagggaatcccggttaactttctatcaaacttatgtggacttctagcttagtatcacccaattgtcccctataacaagatattctatcttagagtaggatggttaggctgagatggtcattttgctctctttaccagctctatcatgtaggacaagctaactagcctctgagctgcagtgtttttgtgttttttaaatttttaattaaaaaatgttttttgttgagatgaggtttccctgtgtatctcaggttggtctcaaactcctaggctcaagcaagcctctccttctccagccttccaaagtgctgggatttcaggtgtgagccaccatccctggctgtgtttttgtgttttattgttatatttttcatgtgaaatagggatcaacatccttggtaaggtaaggtgaggattaagtgctggcataagtaaaggcacaataaatgataatttgacttaaaatattgtaatagttaattttatgtgtcaactggactgggctatgggatggccaggtatgtgattaaacatttctagtgtgtctgtgagggtattgctggaagagattaacatttaaacctgtagacgacataaaacagatcaccctccctcatgtgggaaggcttcattcaatcctgtgaagaggtaaatagaataagagcctgagtaaggaagaattctccctctgcctgactctcttcaagtgggaatattggttttctcctgatttcagacagactcagactgcaatttacatcatcagctctcctgcttctcaggcctttggactagtcttagaactataccactgactctcctgcatctatacttctcagcctccaaaatcgcctgagccaatttaaatttatcttctactgatttcttgtctttggcgaactctgcctaacacaaatattatgacttaaaatacatttatttaaggtaaacattttactttctccacacagccttactattaagtcaaaacaccactaaaatatgctatcatgagttatcagttggtcattataaatattataatggattactttgccaaatgagaggaccccatggtggccatcaatgagggggtagaggaaggagtaacccacaatattttggaatgtcctgtgacaaacttttgcttgtgtaaaatgaaaaaaaaaattgtgccaaattttgcagaatttcccaagtctcaaaatatctctattcattaaggagaaatctatacagtgactgatactttattacaaatttgtatgaaaataaaaaatatctgagcctatcatatgcaaataagaagagaaaatccaacattattagctgaatagcaaaaagtcacaaaactggaggctctagtcatcattattgaaaggaaaaaaagataaagaaaaacaaaataaaaaattagccagttctctgtctttgagtttctctaactaagaatatttgagtttgaagaggtttctcaataagtccattaaatataaaaatcccactaattatattatttccccagatttgagtttcaagagattttagtcgaataggaatgggcatagtagctggaagtaaggcttagaatcaatttctggtttcaagtagcaaatttaggactgcctaagtctgtgattctagccaaagctttttcgtccttgaagcttcagttttctcatctgtgaaatgtgaaaaataatagccctaaccttataggattgtataagaagtaaatgagatagtgcaagtatatttatgtagccaaattttgatgtatggtaagaactgaagaaatattatcaatattatttctaatcaatcaaacaggaagtagacattacaggcatgaccatacagaagatattgctcacaaaatcagcatcgacatcaagtagattctattatcattattctagataaattaaccagcagtcaagtattgggcaaaagagcttggatgcttgatgaagaaagattaagtgtgctcagaagcattgagaagctatgaaaataaaaccgaagaaaatatagccagaaacaaaggccttccagggaagaagcttcctaaatagaagccctctcaatgagccaaagaatatccaagggaaaatgacattctctagtaacagaagatactaattctagggtttctgcactaaacagaatatctaggattttagtacttgtgtcctcagcaggaaaggcaagtgcttcatggctaaacacagccctggaacaggaaactgcatactttcatgagcactgattttgctaatccgatataagaaaatcatatacatgtggcaaataggagtatgcacactgtcccttaagatccaaataagtgtttgaaaaaactcttagaaccttcaaattatgcaaaacactgcaaaaatgctaaatgcttctaacactcaccactaatgataatgcgatttcttgctgaagctcttccttaggtattttatgttctctattgagaaaatatcattatttttacttacaatgtttatggagaaatactgacctaaattaacaccaaaagaaaataattattaaaagcaaggacatctttccctctatatttttaaagtagctagtctcccaatgtggacctattgaggaactatgtctcccaataccaatgcactgtgtaattctctttacctggaatttggccaggcttatcacttgcttttgaccaataatatattgcagaaaaggcatcttgtgacttcgagcctaaatcataagatatttttcagctggtgtcttggtgtttcaaaatgtttatctatatagcttataggtaggaagtacaaatactccgaaaatgccatgctctgaggaagctcaagctggtcacatggagatgttacgtgaagaaagagagatggccaactagtcaacaattgttccaccccttccaaatgaggtgccaaacatgtgagggaagaagctacctttgtttttcataccatcagtgtctttagctaactccaacttcaacatgtgacaccctgcctatgaactgtcttgctgatcccagccaactcacagttggtaaattacataacatcttcttgtcttagttttctgttctctaaaatgaagataatagtagtacttactcttacgcttagtagaataatttattattaaaaataaatactaccattaaaaaggaaataaagaagaaatagagaaataaaagtgaaaaaaaggatataaaactaccctgaaatcactacttttttagtactaagacaagacatgttgcaatgaatccttcttggagttaaggagtttactaaaggagtcttttcttgttttctgaacttcatggaaaatatcattagcaagaaaactgtaaatttgagaaaacccaacagcctccttctgggagccaatgccacagagaccattagaggagtgacaagcaatttttgttaaggtctgtatgtgtgcatgtgcatatgcttgtgtatctctgtgtgtatgcatgcgtatgttcaaagaaaatgagtttttccagagatagacataaagggattccagagctcatcctctccagcaaatagaatctacagcagaatgctttggtatgtgttagggaattaaaggcataattatggaggggagctgtaggaaaaagtgtggttacagcgaaatagaataataaaggttaaatgattatcattagtcagtgtcactgcacatttccttagatctataaggagaaacagttccgccccagcctctgtctactgttatcaattctcactggccttagacaattagttttaagggtagcacctctcattatttggggtctagagaaaaacataatgaaatgaccacactttttcatcaagtcagtgcttctcataaacttaaaacaatcaacatgttttgtcttatcatagtgggagaacacagcagtcacatgctgcagaatatataaggtagttgtaaattttgttaggtatatcaggatactgccaaaagtaaaacaggatactattacaaatttctttataacctgctccaaaaacttggactgttccctgcaagcaggatggatggatcccttaaggataagacgaccagctgaagcagggagttaacatggttagagctgctcctcacgggaatctataacacaaagaagcaagtatgtcttttccattggttaaacatcttcttgtgtaatataataaagagaatataagtaaaatcaatatatattaacaccaagaagcaggaatatctggcaaaaatcttcaagcaatttctctatacagaaaagttttaaattcccatgataaaggaaactaaagtgcagcaaaatgttatttcaccacaagagaagagttacaatttctaaactgtctagggccccacagtacggcaactcctagtctgatatgactccagtctactatcagaatgacttgggtggaagaagaggtagaacttcagccacaacagaataggtagcttcagttgttacctgaagaaaccttgaagaaaacttcttctgtcccctgatatctcccttattatcttactgtggggtctgcattttctgccttcagttgctgatttgaggaatgggccctattaaaattcaatagtgttgcttggaaaggttgatgttttgtgttttggaataagtacttggaaaggagtcaagaaactgagtcctagcaccaggcttgtcaggacaatctaagtatcactgaacatttttgagcctcagtgctctgtcctttttaaaagtttggtataaagataaatgagagaaaatattagaagaaaacatacaacagaacccccaaatttttaaaatagtaaatattatatatgtatatacacacacatatatatacacacatatacatatatatatatatatatatatatttatggttacaatagtataatatggttatactatccacagttttcaatgtgtaatttggacattggctcagataagtacacgaagtaaacgggtcatatttctatgaccttagctgaatttcttaacctttctgagactcaattcctatatatttaaagtggagttaataactcaaattaccttttaggtttattaatggaattatgagacagcctgtagagtttggcctgtcatttggcttaacaaagtcatttaataaatgtcagaggaaaaaggtttttttttatttttgtttttcttttttttttaagagaaaagttttcatgaaaatagaggtctgtggaagcacagtaatgggccatttcttgcgcagggagggcatgaatgggattcagttctggagagccagggcaaccctccaaggacatgataaatactctaaaaggaaatggcagaaaaagcaggctctcttctgtcagatttgtaactaagccatccctgccaacctcatttacacaaaggtttaacgtcatgctaagcattgtgtgcaaaatgtgatgtatcacagttccattgtggttaataatgtgggctttggatgctctgctaggaacgtgctgagtgaccatggctagttacttagagcctctttgtgcctatttctgtgtcttccagaatgaaaaaggactttatttgtgtgtgatgtgtgcttcccacaagacctgttaccaggagtaagctcttaataaatggtaactgctatgattactatttttcttgtcctcacagagtttacattagagatggagggacaaagctaacctacacaaaataaagacccaagagtagaataaataattaaagtacaaaattatttattgattttatacataaatatttactgagcagctactgtaaatcaggcggtgtgctgatagctgggagtagtgtgatgaattcactatctatgctgtctgtcacataaaatttacattcaggtgatgctgataactcaaagattcttcagtccctgttacagatgagccttatagtttcctacaacaacacacatgcacacatgcatctgtttatctatctattatctatttattatctacctatctaatctatcatctatatatcaaaaaagggaggattgttgctgaaagcaatattttttccctaaaataatccatatctcaaataagcagaaatatttatgaaggtgattattagctctagttcatcccttttctagttaatgtaatttatgaaacttgtatatcactgaagacaagcagctgaagcaaggactaatgctgcagcactcccacttaatgctaagatttaaaatatcaaggccacactctggtatccatgaggcttaatatgcctccatggatatacaacagcacaagtgactagtatggattcctacctttgtgatggatgtcaaacctgtgcctataacttggaggcctccctctctgaccaagcacctgctatagatgatacgaccctaagggcttgagaggaaggaaaaacaaatcactctttcccctactactttttggctacttacactgctgtctcccttccctgatttttaaaatcttgtttaaggattggataaaaggtgatatctgcttcgcaatttcttccagccctaccccttgcgtggtggtgagaaaactaacaggtaaatgcttttattattacttgactgagactagaaaccaataacaatgaaatgcgtaattttaagggtataaccaaataactacttctccagagagtcaaaagagatggaggttgatatttgatattatcagacaatttttatttatttttattttatttttaacttttaagttcaggggtactcgtgtgggtttgttacataggtaaacttgtgtcatgggggttagttgtacagattatttcatcatccaggtattaagcctagtactcattagttatttttcttgatcctctctatcctcccaccctccatcttctgatagactccaatgtgtgttgttaccctctatgtgtccatgtgttctcatcatttagctcccacttaataagtgagaacatgtagtatttagctttctgttcgtctgttagtttgctaaggataatacacaatagcaaagacatggaatcaacctaaatgcctgtcaatggtaggcaatatttatttactttaaggacatttattatataattaacagatcttttgaaataaagtcacgagatatctgccattccttttagagattgaaagaaaagtattccattctgcaaagccctgaaaatagtccaccattcaaagtcagcctcaaagcctattgtcatgactataacattttcttcatcatcatcatcatcatccttttcctcctcctcatcgtcattatctttctcctcaattgattaaacctctttgctatagaatccaatccattttgaattctgttgatggggactggatcatctctagtatagtggacacttatcctgaagaaagaaacaggaccctgtggcccaggctgaactctggatgaacttcatctccaagagggttgcagaatccccttctagctcctagccttctcagaccttggggcagcagagaaagaaagtcagcactaaaggctgtgtttagacaagatgccaccactctaaacaagagttttacacaacagactgttgtcttaaaaaggttacgttatctaaagagacattgcattttggtagataagaggactattttcattgtcagaatatatctgatgagaaaaacccagagaagctttggaagtgggagaacaacatccattcatcagtcttcttatacctgttaagctagtagcttcaaaaatgctgtcctttattttcaaagatgacttctcattgtatatattttcccatttacagacaattaaattgacattcagagacattaaggacttgtccaaggccacaaagccaataactagcagacaaataattcaaagtcaggtctgactcctgtcctaatgttctttccaccctaccatgtgcctccaaagacttgcatactggctctagctctgactgaatagcgacagacaccattttattcaggacacaatttttctctagaatctctgttccgtgaataaaagcaatgattgggctaatggagtgccaagatttcttcacgcaatgaggtcttcaccatttggcccaaagtttcagtgctgtgagtgctcaacaggaaggaagttaagctcaacctacgcagggccccaaactatcacccattatgaaaattagaactgccctcagaacttttaaccccataagaaatgctgaggaaatgtacataagcctactataagcttggctggatcaagttgggctggtgacaccagacaacaggatgtattgaggacatggagatttttctgaaaacacaaggagcctatgagattgtcctatccttcaatcctgatgttttagatacccttcagcctgggaatagaagaattgctcaggaggtatttagatatctgtattcatttaagacaatttaaggcactgtcctttggcataagcaagaacctgtaggctcaaagagtcataacaccaactatgagccatgtagataagtcactcaacctggttaggcttcagtttcctcgtctgagtgcctgctcttctcatttcgatgtacaggagtctagtgataaacatgaacgtatctcaacatgcaagctttgggtgaaaaattacaaaggaaaatatgaccaaattgaagaataaataagaatggttaaatggttgcttgctttgataatttaagcttgctcggagtaatattctcactatatctgtatctatatactttcctatgtttatgtggatatcatctacatcatatttatctggacaaagaacgagaaagagagaaaccatattttttgagagttattttacatgtgtttataattcttactttgaccctaaaacacaaatcagaatcaactgaaatgcttatttaaaaagctgattttcaaccagatctattgaattggtgtcctgagtcaaaggaatatgcaacttaaataattacccatgtgattcttacatgggtaaaaatctatgattctgattctagatgtcccacagagctcactttgggaaatgttacagcactacctactttacatgctgtccttagaaaatcagggaatatcaacatttggtctggcaaaagcagttcataagtctatgtctatagaatcaggaaaagcctagcagctcagaacattccctttggtgtagtcagcaataccagagttcttaagccctgagactttctattgagacaatacaaaatttagtggtaaggcagcatgaactctggaattggacagtctaagactgaatgccaggtttaacagtaattttctgggtgaccatggaagtgagacttacctgcttcatctgtaaaataggttaataagccaatccaactctgtgtttttatgaatacatgaaatatattaagatgcttgatgtagtgtttggcacagaacttgagaaatgttagccagctaggaaaaccaggcttttatgtcatatatttattcctggtcacatctgaagaacatgccaatgtaaataaggataattatcttagaagaacaaataaaagtatatcagttatttttgcattaaaaagatgcacagtggcttaagcaaaaaatgatttcttagttatcataatgttgtagactttttttttttttttttttgagatggagttttgctcttgttgcccagcctggagtgcaatggcaggatctcggctcactgcaacctctgcctcctgggttcaagtgattctcctgcctcagcctccctggtagtgggattacaagtatgtccactatataaggctaatttttgtatttttagtagagacgtggtttcgccatgttggccaggctggtctcgaactcctgacctcaggtaatccacctgcctcgacctcccaaagtgctgggattataggcgtgagccatggcacccagacgactgttgttttttttttttttttttttccaaccaacttttgtggatgaagtcaactgatggcttaactggaactggagagtccaagtagcctgacatttatatctagctattggggctggctgttagctggggcagctcagctttccttcttttcttccactagattaaataaatagggcttgtttgcagtagggtgatctcaggggttcaaaagccaagaggaaaccctatagataggtcccttaaggtctaagctgcagaacacagaatcactttcaccacattctgtattgattaaagcaaataacaagacgagtccagattttagggtatgataaatgtacttcaattctggtgggagaagtgacaatgtccattacaaaatgacacagatataagggaccaatgctccattaagatcattaatataaatatctataataaacatcagtcaaattgaaaatatagctgtaaataggtgagggaaccataatctcatagtctaatgtagacctaatctaggaaaaatatttttttcatggaatgtatgcatgtgcctctgactccctttactgccaatatactaaacatatttatgagagtgacctggtgctttcattatcaacatgattcagattgttctgtatcagaagattcacaaccaggagatgagaggtggattctcctccccatcccttcctagctgcctcttcctccttcttctcatcatcactgtatatcagacccaggtgtaagcattttaaatttttaaatttaaattattaattatttgttattgccctattttgctgatacgcaactgagacttcaaatactgttcatgtgtacagaggcaaactaaagaggcaacttcttaatctttgctgctgctgcttattatcagtgtttactctacttattcggtgtcttttgccagagcacagtgaagggaaaacctatgacactgcatgcatgtacagattgagctttggtcggtgactagtgatgccttctctgatcccttctgccaggagagctggacattaggggtggtccatgatgatagtcatctctacatcattaagcatatctcagtttgtcattgtcaaagccctactaagagcacattatgctttaggagaacaatgaattttgcctgataataaagaacaggaattagatatattctcccagagacataaaaggattaatgatattaagtaggccccaaaatgcatagatgtacatgttcttcagttattcctttgtagttttatgttgaattgtgaattggagccacactacatgtaccattcaggtctctgcttaacatagtcttctcatgagcaactttctatatttaatggttgagtatatatttacatggtttaaatatgtgaaaatatgtatataaaaatcttaaaactgtatggagaacagactcagttttttccttgttcacttagattctactctcttcttcatagaaaaccaaccacttttatctgtttcttagacatctttttttgttgttttttacaaaaatataaacaaatataaattgttactacatctttttctaaacaaaatttgcctgccatgtctattattcccagtttttatttagatatatctattacagctccttcattatgtccatgggtccatggaaagcttcctcattcattttgcagatgcttgaaattctaacaaagagattaattataattcatttaaccagccctttgttaatggataatgtgattttgttgttttaattatgtggctattacaagcaatgctgtcattgaattccttgtgtgtatacagacagacatataatttcacataagtgaaattaaatcaattttaaaaatttttatttatatttttcatttttgtgggaatatagtaggtttatatattaatgggtttcaagagatgttttgatacaggcatgcaatgtgaaataagcatatcatggagaatgcggtatcaatccactcaaggatttatccttaagagttacaaacaatccagtaaagcccttcgagtcatgttaaaatgtaccatcaagttattattgactgtagtcatcctgttgtgctaggtcttattcattctttctatattttgtacctattaaccatccccacctcaccccacccccaccatcacacccaactacctttagcccggcctatggtaaccatctttctactctccatgtccatgagttcaattgttttcaattttagatcccacaaataagtgagaaggtgtgatgtttgtctttctgtgcctggcttatttcacttaaacgtaatgatctccagttccagtcatgttgttgcatctgactggattttgttatttcttatggctgaatagtactccattgtgtatatgtaccacattttctttattcattcatctgttggcagacacttaggttgcttccaaatcctagctattgtaaatagtgctgcaataaacatgggagagcagttacctcttagatatactgatttccttacttttgggtatatacccagcagtaggattgctggatcttatggtagctctatttttaatttgttgaggaacctccaaactgttctctatagtggttgtaataatttacattcccaccaacagtgtccaagagtttcctttcctccacatcctcactagcatttgttattgcctgtctttcggatataagcaattttaacttgggtgagattatctcattgtagttttgatttgcatttctctgatgataagtgatgttgagcactgtttcctatgcctgtttgccatttgtttgccttcttttgagaaatgtccattaaatcttttggcatattttgatcggattattcatttttttcctatagagttgttggagctccatatatgttccgatttttaatcccttgtcagataggtagtttgcaaatattttctcccattctgtgggttgtctctttaccttgttgattgtattctttgctgctgtgcagaagctttttaacttgatgtaatcccatttgcctatttttgctttgcttccccatgcttggtgcttgtcgggtattgctcaataaatctttgttcagacaaatgttctggagattttctgctctgcaatgttttcttgaaggagtttcatagtttgaggtcttagatttaagtccttaatccattttgtttgatttttgtgtatggtgagaaataggggtccagtttcattcttctgcatatggatttacagtttcccagaacaatttattgaagagactgtcttttccccagtgtatactcttggcaccttgtgaaaaatgagttcagtgtaagtgtatagatttatttctggcttctctattctgttccattggtctatgtgtctgtttttatgccagtgccatgctttttgattactatagctatgtagtataatttgaagtcaggtaatatgattctttcagttttgttctttttggttagaatacctcgggctatactgggtcgtttgtggttccatataaattttagaattttccttatttctgtgaagaatgtctttggtattttgatagggattgcattgaatctttactttttttggtagtatgaacattttaacaatattgattcttctaattcaagaatatggaatatttttccattttttggtgtcatattcaatctctctcatcagtgttctgtatttttcatcatagagaactttcacttctttggttaatttccagctttttaattttatgtgtgctgattgtaattgagattagttttttatttctttttcacattgttctctgttggcgtatagaaacgctactgctttttgtatgttgattttgtatcctgcaattgtgctgaatttgtttatcagttctaatagttttgtagtggagtctttaggttttctcaaacataagataatatcgtatgcaaacaagaatttggcttcttcctttccaattttgatgctctttatagctttctcttatgattgttctagctacaacttccagtattatgttaaataacagtagtgacagtgggcatacttgttctgttccagatcttacaggaaacgccttcagttttttctggttcaatatgatgctagctgttggtctgtcgtatatggctttattatgttgagttatgttccttctatctccagttttttaagagtttttatcatgaagggatattatatcataccttttcagcatcaattgaaataatatggtttttatctttcattctatttatatgacttattacactgattgatttgtgtatattgaaccatcctggcatcacagggataaatccccttctatcataatgttatctttctaatatattgttgagcttggtttggtattttgttgagaatttatgcatcaatattcatcagagatattggcctgtagttttctttttttgatttttttttttatatcgggctaatacattgtctgctttttggtatcagagtaatacaaacctcatagaatgagtttgaaattattccctcctcctccattttttgggggtagattgagtagaattggtattagtccttctttaaatgtttggtagaattcagcagtgaaacatcaagtccttggctttttttattttttactgggagagtttattacaactgtggtctcattacttgttattagtccgtttaggttttgaatttctttctggttcaatcttgataggttgtacttctatagacatttgcccttttcttctaaattttccatttttttggcatatagttgctcatagcagccattaatgatcattcgaatttctgcagtaacagttataatatcttttcatttctgattttatgtatttggatcttctctctttttttcttagtctcgctaaaggtttgttaattttgtttaatttaaaaaaaaaacaactttttgtttcattgatcttgtgtattgatttcttcatttcagtttttctactcagatctttattatttctctaatttggggtttgttttgctcttgcttttctagttctttaggatgcattattagattgtttatttgcaattattcctcttttttgctgtgggcatttatagctataaatttcctcttagtaacggttttgctgtattccataggttttagtatattgtgtttccattatgatttgtttcaagaagtttttcaattttcttcttaatttcttcatagacccactggtcattcaggagcatattgtttaatttccatgtatgtgtatagtttccataatttctcttgttattggtttacagttttattccattgtggtcagagatgtttgatattatttcagtgttttaaaaatcctttaagacttgtctggggacctaataaatggtgtgtacttgggaataatccatgtgctggggaaaggaatgtgtattctgcagctcttggatctgtatgctctgtaaatttgttagatccatttggtctacagtgcagtttaagtctggtatctgtttgttgattttctgtttggactattggcatgatactcaaagtggggtgtcgaagtctccagctattattgtattgggacctatctctctcttttgctctaataatatttcctttatatatctgggtgttccaatgttggatgcaaatatatttaaatttgttatattttcttgctgaattgacccctttatcattatacagtgaccttatttgtctcttcttataggtcttgtctttaaatctattttgtctgatataggtatagcaactcctgctcttttttggtttgcattggcatgggatatcttttttttccacctctttatgttcagtttatatgtgtctttataggtaaaatgtgtatcttgtaggcaacaggtcaacggatcttgtttttttttttatcaattcagtcagttcatgcattttgattgaagagtttagttcatttttattcagtttttattattgataagtaaggacttattcctgccattttatttgttttctagttgctttgtggtcttagcttccttctttctttccttctggtgtcttctagtgaaggtcattttctctggggatatgacttagtttcttgttttttattttttgtgtatctattgttttttggttttaggttaccatgaggcttgcaaatacaatcttataacctattattttaacctgataacaagttaacactatttgtataaacagacacacaagcaagcaaaaagaaaactagtaaaaactctatgccttaactttgtcccctggctttttaactttttgttgtttctatttatatcttactgtactgactatgtctttagaagttgtagttatttttgattggcttatgtttagtctttctacttagaatgagagtaccttacatgccacatttaaagtggtgtgatcttctgtgtttttctgtgtacttattattaccagcgagttttgtaccttcaggtgattacttcttgttcattagtatcgttttctttctggttgaaatactccctttagcatttcttgtaggacaaatatggtattgatgaaaacccttagcttttgcttgtctggtttgaaggatatattcactggatatactattctaaggtaaaagttttctgtttgtttgtttttccttcagcactttatatatgtcatgccactctctcctggcttacaatgttttcaatgaaaagcctgctgccagatatactggagctccattttattaatatgttatttttttatattctcttactgcttttaggattcattctttatcactgacctttgggagtttgattattaaaagccttcaggtagtcttctttggcttaaatctgcttggtgttctataaccttcttgtaattggatattgatgtctttctctagatttgagaagttctctgttattctcccttttagtaaactttctacccctatctctttctctacctgctgtgtaaggtcaatagctcttagatttgcccatttgaggatattttctagatcctgtaggtgtgcttcatctttctttattgtttttttgtctcctctgactgtgtattttcaaatagtctgtctttaatctcactaattgtttcttctacttgatccactctgcttttaaaggactttgatgcattcttcagtatgccaattgcatttttcatctccagaatttccctttgattccttttaattatatcaatctctttaccattatataatgcccttctttgtctcttttgattattattggtttaaagtctgttttatcagagactaggattgtaactcctgctttttttgctttccatttgcttggtaaatcttcctccatccatttattttgagcctatgtgtgtctttgtatgtgagatgggtctcctgaatacagcacactgatgagtcttgactctttatgcaatttgccagtctgtgtcttttaaatgggggcatttagcctgtttacagttaaggctagtattgttatgtgtgaatttgatcctgtcattatgatgctacctggtcattttgtccattagttgatgcagttacttcatagtgttgatgatctttacagtttggtatgtttttgcagtggctggtactggttgttcttttccatgtttagtgcttccttcaggagctcttgtaaggcaggcttggtggcgacagaatctctcagcattgcttgtctgtaaaggattttatttctccttcacttatgaagcttagtttggctggatatgaaattctgggttgaaaattcttttccttaagaatgtcgaatattggcccccactctcttctggcttgtaaggtttctgctgagagatctgctgttagtctgatgggcttccctttgtgggtaacctgatctttctctctggctgcccttaacattttttccttcatttcaaccttggtgaatctgacgattatgtgtcttgggactgctcttcttgaggaacatcttcgtggttttctctgtatttcctgaatttgaatgttggcctgtcttgctaggttggggaagttctcctggataatatcctgaagagtgttttccaacttgattccattctccccatcagtttcagatataccagtcaaatgtagatttggtcttttcacatagtcccatatttcttggaggctttgctcatttcttttcactcttttttctctaatcttgtcttcttgctttatttcattgagttgatcttcaatctctgatatcctttcttctgcttgatcgattcagctattgatacttgtgtatgcttcacgaagttctcacgctttgttgaatttatctgatagaatctgaatctattctctgtgatatcttaaactttttgagtttcctcaactcatcgattttgaattatcagacagaaaggtcacatatctctgttttttcaggattgatccatgttggcttatttagttaagttggtgagatctcgttttcctggatgatgttgatgctagtacatgttcttcagtgtttgggcattgaagagttaggtatttattgtagtctttactgcctaggcttatttgtaactctctttcttaggaaggctttccagatatttgaaaatattttcatcttgtaatctaagttgtatctgctttagggtttatcccaaggccagtaacactgtggctcttgcagacttgtataggtactgccttgatggtcttggacaagatctgggagaattctctggattactaggcaaagactcttattatctccccttactttctccctaaatacatagagtctctgtatataactgagccacctaaacctggaggtggagtgacagaagcccccctgtgaccaccagtgccataattgtgcttgttcagacctgaagtcaggatagtgctgtgtcttacccaagaccttttataaccactccctggctactgcctatgttagctcaaggccctgggactctacaatcagcagttgcaaaaccagccgggcccatgtcctttccttcaggggagcaaggtcccccaggccctgagtgagtccagaagtgacatctggaagtcagggattagagtcaaaaacctaagaagtctatctggtgttctattagtttgtggctgatttgctctcaaaccacaagatacagtccttcacactcttctctccctttcccaaaggcagaagagcctcaccccatagccgctgtcaccctatgccatgaggagtactggaagactaaccgtgatgttcccttaaggtccaaagtcttcttaaggcccaaggtctcttaagtcagcttgtggtgaatgctgcctggcctgggactcacccttcagggcagtgggctcccctctggtccagagcagttccagaaatgctgtccaaaagtcaagtcctggaatcggggaccccaagaccctgcttggtattctactgcctgtgggagttttggtacctaaggtacaagacaatgtctctttacttttccctctgcttttctgaagcagaagttttatcctatagccaccatagctggtaatgtgatgagtctcagctgaagccagcaagtctcagagactcactcaaggccttcaatgtagtgcctgagtattgatgctggttattcagggcccaagggcttttcagttagcaggtgatgaatgctgtcagaactcaaagtagtcaaggcagcaggttccctctggcccagggtgtgtctagaaattttgtctgggagctaggtcctggagtggggggcctcaggactatgaccagtgtcctattctgctgtggctatgatggtatcccaaattcaagacaaagtcctccccacacttcccactcctctcctcaagcagaagggagggatctcttttgcagccacaagctgtgcagcctggcaaagaagttaaaaaccttgaaaaaaagattagatgaatggctacctagaataaccaatgcagagaagtccttaaaggacctgatggagctgaaaaccatggcacaaaaactacgtgatgaatgcacaagccacagtagccgattcaatcaactggtagaaagagtatcagtgatggaagatcaaatgaatgaaatgaagcgagaagagaagtttagagaaaaaagaataaaaagaaacaaacaaaacctcccagaaatatgggactatgtgaaaagaccaaatctacgtctgattggtgtacctgaaagtgatggggagaatggaaccaagttggaaaacactgcaggatattatccaggagaacttccccagtctagaaaggcaggccaacattcaaattcaggaaatacagataacaccacaaagatattcctcaagaagagcaatcccaagacacgtaattatcagattgactaaggttgaaatgaaggaaaaaatgttaagggcagccagagagaaaggtagggttacccaaaaagggaagcccatcagactaacagtggatctctcagcagaaaccctacaagccagaagagagtgggggccaatattcaacattcttaaagaaaagaattttcaacccagaatttcatatccagccaaactaagcttcataagtgaaggagaaatacaatcctttacagacaagcaaacgctgagagattttttttttttcctggagctgaagccatgtcttatatttctgactcttttcatcaaactagcaaaagctcttgcacataattcatgctggtgaatgtttgtggtgattctcatcagctcccagaagctcagagctgtgatttccctgccctttgatctgaagaactgcaacagctgctattttcacggtaatttcctgtgactgcttctgttgatgtctggctgattttcactcctgtagcactttcaaagaaaacctgttgatatcctgcaaagctggacagctttattttgtttttctcctttctaaaagcagttcacagaacgacctggtgagattcctataatgggtgttctgctgtacagtttagatagcatctagggaggatattttgtattacaagcatcagaaaattaatattaaattggctaagcaaaattgggactacactgacttctacataagataatttcaggagtagaattcagcttcactcatgatccatggactcagtagtgatcatcagggacctcctgcgctgtttctctcacttctgttttcctgtgtgttggcttcacatgcatgaggtctcccacgtggccaccttattgccttattgccttaggacttctttgagtccagcagaatgagaaggcttctcttcaacagcatttccaaaatgtgctaacttggataaaggattattcctgaactataacagtggccagaaagtggcaaataccactgattcaaatcataatgacacaacagtggagagaatttcctgaaaaaatcaggcctttataactagaagtggggtggatattgtgaaagccaaaactgaaaatcacaacagttcatgaatgtatttttctcaaaagggagtctgtagatataataagatattcaatgttatcgaattcccttaaaatatctaggaactgttgacaaagagtcaaactctgtaaaatatttggagagatttattttgagcaaaatatgagtgaccatggcccataacacagcccgcaggagatcctgaggacaggtgcccaaggtggtcgggatgcagcttggttttatacagttttgggatgcatgaggcttcaatcagatgcatttaagaaatgcattggtttggtccagaaaggcaggacaacttgacgtgggggagcttccagcttataggtagattaaaacattttctggttgacaattggttgagtccatctaaagacctgggatcaaaagaaagggatgtctgggttaagataagaggttgtgaagaccagagttcttatttgcagaagaatccttcaggtaggtagcaggcttcagaaagaacaggttgtaacatgtttcttatcagacttaagatctgtgatgatattaatgctggaggggtataatgaggcatatctgacccccacttcccagcatggcctgaaccagtctcttgagttaaagtttaaaaatgccctgtctgagaaagtccattcagatatgcggggagcgggggggtgggggggcgggtgttacaattttaattttagtttacagaactgatacaaaccaatgctcctgtataatgtctgcaaatagatacaaaatggcagaaagctgaaataaaattatctcaggttctgtctaaaaaaactgttgagttatttcggtctctacatctataatattaaaactgaaatattaacactggatttatcagagtacattagacttctttcctcaaagaccccataattagcatttttagctcaatgtctgcctcacataagctatatgaaagcagagaccatgcattttctattcaaatgattggtcacttcctggtagcacacaataaggtattaataatatttgaaaataaatttaaatagataatacaagatctgaatagggataggaacaaaaagcaaataagatcagaattttatttaactaatagaaaagcagaccatgtactgaatagtttgtcagaatgtctggactgtaatttcagctcttctgttagctaatggcataatctcaaataattactgactttgctgaacccttttttttcttctgtaagatatggactatatctaaatgattcttcaaaactaaaatgtatgagtttgatatgggattgaccaaagtatgtcacttgaaatacaatgttttaattaatattaatgattaatgatcaatattctatatcaaaatttagatataaaatgattgctctaacttttatgagcatgcatatgaggtcctactcttgagaatatccattttatgcttttcccttcttgtttcccttctcctctttcatacattcagaatgaccggacatttgttctgtatgtatgttgacccaagttagcacattttggaaatgctgtggaagagaagccttctcaggatctacaccaatcctgagtgttctataatttagtcacattcctctgtaacctggccttgaattagtcatcctacctaattgtatccaccttttcatatcatataatttctagttattaataaaattccatgactttattttagaaaatagttataaacacttcttttctgacttaaatgctcagtccatgacatatgatgtaaatgataggaaacaaattccttgtgtagctttatcttaagaatatactcagcaaactaactcaggaacagaaaaccaaacactacatgttgtcacttattagtgggagctgaatgaggagatcacatggacacataggaaggaacaacacacactggagcctataggaaggtgggggattgggggatggagagcatcaggaagaatagctaatggatactgcacttaatacctaggtgatgggataatctgggcagcaaactaccacggcacacatttagctatgtaagaaacctgcacatcctgcgtatgtacctctgaacttaaataaaagttgaagaaataataataataataatcatagtcattccgactgctgtgagatggtatcattgtggtttgatttgtatttctctaataatcagtgatgttgagcttttctttttgagacagtctcgctctgtctcccactctagagtgcggtggtgcaatcttggcttactgcaacctctgcctcccgggttcaagtgattctcctgacttagcctcccaagtagttgggattacagacacaggcacctaccaccatgctcagctattttttttctatttttagtagagcagggtttcaccatgttggccaggctggttttgaactcctgacctcaagtgatctatccaccttggcctcccaaagtgctaggattacaggcgtgagccaccctgtcgggccttgagcttttttgtgtgtgtttcttggccacatgtatgtgtcttcttttgagaagtgtctgttcctgtcctttgcctggttattaattttttttataaatttgtttaagtaccttgtccaggcatcagccattcagtatttacccaatgaaagcaaatgtatttgcaaagtcttgtacagaatgtttatagaaacttcaattgtaatagtaaaaagctggaagcaacccaaatgtttaccatgaggtgaataaatagacaagtttttagatacccttacaataaaaacaacacaatactactccacaataaaggaatgaactattgatatattctacaacatgaatgaatctcaaaataattgtgcagagttacagaagtcagacaaaaaagagtttatacttaatgctttcttttatataaaagtctaaaagatccaaactaacttactgtgacagaaagcagatcaagtttgtctagagtggtttggtaagagtgggagaaagatattttaaggggaacagttgacgacttgggaagggtgactttgtttgctatattgcaacagtgatggttttcaggtttgtacatatatcaaaatgaattcacttacacttcttaaatgtctgcattttattgtatgtcatatagctcaatacaggtgataaaaagaaaacaaaacttttcagaaatacaaatggtgaaataattcatcaaaagcagaaccatactaccagaagtatagtacaatgaatctaatatatgtagaacaaagactccaagacatttgaaattctcattgatggtgagattttttggcatagagaataataatcttctctaaaagaagtatgcctaaaagctgagtttcactgataccatcattctacccttaccacccagactgaaaatgaaaatccttcttgacgatcaaagggaaatttgacatcctttatttatttaatgactacagataggcttaaattatgagcaagtttggaaatcaccattctagccatagccagtaaaagaagcctttcttgcttctatagcaaatgacagggatgaagggctgacccttgcaaataggtagtcatccacaacatgtatccaaaggtatgtaacaaacttagaagggtttcagacatgttctgatattcatggatatcaaatccagaagtgccaacatgattcctgtaaagacatgtttctctaagtttgaattactatccctctgggtaatatgttcatttgccacaagacgctagcatatggctgatgatgaaagaaaattcatcttcatgggagaagttgatcacaaaatcaggatggaatgtctaagaaccttgccaagtaggctaagattcagaaaccaaatgtgggaattcaagtctagtacaaaaaagccaagagagaaatgcccagtcctatggccagaaacaacatggcaggaagatgaggttgagaaggcagtaatgttatagacacatttatatccagatcacacaacagacataataggccaagcacagtggcttatgcctgtaatcccagcactttgggggaccaaggtgggaggattgtttaagccctggagttcaagaccagcatcggcaacatagggagaccctgtctctacaaaaaacaaaattaacccaggcatggcagtgcacgcctgtggtaccagctatttgggagggtaatagggacgattgcttttgctcaggaagtcaagactgcgctactgtactccagcctgggctacaaaaacccagtttcaaaatataaaataaaataactaaaaagtcattataaatcctgtgaattattcagcagccagaagtgctacttaaattccatggctcaggaatgtctctgaagttagttaggagtagagagatgtcaaaagccccattaactccagtcaaaaggagatgggagaagtgaaggttgcttcaatgttctttttgatcaaatggattaagctggtggagctatcctcggtccctccaaaccgagtgcctgctgcgagtcaggtgtatgatcctatgatttagttattttgctaactcaaattcatgatgttattatgatcaatattgcatgggaactaaaaaacagagaagtaatctatacaagtttacatagctaagacagtgacaaaaccatgattcaaagcagaaaagccaaatggtagaacatgcatatttagccactatgttataatggccccgctacttgttgggataactttggctgggggcaaggaagcatattagctcaccagccctaaattcactgccacctgactaaggacccttgatttctcgaagcacgagaagtattttctctagaactccaggagggtctttaaggtttagtaaatagcaagtactgcattttcctttgtacactagattgttatattgatagactagagataatagttttctagttactgaatttcagttgaaaccaaaaggaaaaacaaaacctctgtctatagcgcatgagattattattttcttcttaacacatacagaaaagaggcatggggtgagtagaaaattggaaaagtataaagaagtatataataccaaccattttaaaatgcagagaaatttacaaaattttattaaatggaatttatcatgtctattttgaaatgctgcaccaacctcttaactattaaaatctgcataatggtgttgctatattgtgatgagctgtatattttatccaatgaactattctcagttacagaaatttttgtttaactttattaagggttgtttttcattatatttcaaacaaattagactttgataaattattgagtgaaagctagatatgaatccagcaccccttgcacataaagcaagtatgattcaagtaaatgtatttttgacaaatgacttgcgccttcgtgatttaacaacatgatgtgaaatggccctataatagcatggtatcaggcctgttttgcatttgtttcctctatggcagactgagagaacagtggcagaaaatataatttatttccatgaggaaggtagagaaaaattgggtttgtgttaaattcacagtgtgtggctcaaacaacagagaaaaagaaaaagtaataaagaaatgtaaaatttgcttgaacctacaattatggaaattatctttgatctctgaagaaagaagatgcatcattagagctaactgagcttattaaaccataacacaaattgctttttttaatgcgacacactttaggaggctacactcagcttaaaggtaagggcaccactacagccttaagcaggcttttaaaatgtccttatttagaaactgctacagcaaaacagtttgcagttatttacttgagcaatgctatcaagagatacttagaattaccagaaactgatgaagaaactagatgcagggaggaagggagacaaagatatgaaggatggtttctacatttgttcaacataataaatatttagacctacacatttgtgatgctatgcaccaaccaggttatgggagtattgaccaagatctcagttttggatttgctgaaattgagttgctttttaaatattcaattatatatgttgaacaggaagtggaatatagtatactaacctggatatcataagtaagctgtgggataagctgaaaatagatacctgaaaggagttatctaaacttgatatcacttgagggtgtgtgtgtgtgtatatgtatacacacaaatacatatatgcatgtatgaatatgtatttctgtatgtatgcattttgagggatatatgctacaaaactccattttttaaaaatcacatagaaaacaactagaaaaggtggtagagtaacagcagtcagtgtggtggatgagagatcaggagagacagaagccaaaggaagtggaagtttcaggaagaaaggaatggtcaactatggccactgctactgaaatgtcaggtataatgagggtggcagctgaataatatgagattcaagtatgtaatggttattttgtttattttacataaaattgttttattgtatatataatatatattgtgtatatatgtatgtacatatgtatgtgtgtgtatatatatatatatgtatgtgtatatatatgtatgcatatatatcacatcatataatacagtgccacacaatataatttgattttggtaagaacacctaacgtgaggtcaacgctttttatgaatactgtatttaaatgaacaatattgttaactaaagggacaatattgtacagcagatctctagaacttctccatattgcagaattaagactttatatacattgattaataattcctcatttcaccctctagtcagcccctggcaacaatcaactgtactctgattctatgagtttgaataatttagatatctcatataagtggaatcatgctgtatttgtccttctgtgattggcttatttcacttagcataatgtactcaaggtttaaccatgttattatatattggaggagtttaagaataaatattattccacagtatttacataccatatttcctttatttattcatcgatggacatttaggttgtgaccacatcttcactattatgaataattctgcaatgaacactagagtgctaataactctttgacatcctgatttcaattattttgagtaaataattacccagaggtgggactgatgaattatatagtagctctagttttaatatttttgaggaaactatactgtttttcatagcagctatatccatttgcattcccaccaagggttcccttttctccttattctcaccaacaattattatcttttatcttcttgatagtagccattccagcaggtgtgaggtgatatcccattgtggttttgattttcatttccttgatcattagtgacacggagaatcttttgatatacctgttgcccatttttatgacctctttggaaatgtctgtttaagactttagcccattttataaatcacatcattcatatttttttggttttgctttgttttgtttttgctattaagttgtagaatttccatataatttggaaattaactttttatctgatacatggtacacaaacatatttttccatttcatacattgcctttttactctgttgattatttcctttgttttgcaaagctttttagtgtgatgtagtcccacttgtctatttttgcttctgttgcctactgttttggtgtcatatccataaaatcgttgctaaaaccaatatcataaacatgttccactatgttttcttctaggggatttacagtttcaggacatacatttaattctgtaatagattttgggttgatttttgtgtgtagtgtaaaagagggatccaatttcatttgtttgcgtgtggatacccagtagtcttaaatcaatttgttgaagaagctatccttttcccattgtgtactcttggcaccctgatcaaaaatcagttagctatatatagagagagattggtttctggactctctattatatttcattgagctatatagttgtctttatgccagcatcatacttttttaggtactgtagctttgtaatatatagatgctcctcaacttacagtggggttacatcccaagaaacccattgtaagttgaaaatatcctaagtcaaaaacacatttaatacatctaacctactgatatggtttggctctgtgttcctacctaaatttcatctcaaattatccccccgtgtcaaggtaggaacctggtgggaggtgattggattatggggtggttttcctcaagctgttctcgtgatagtgaatgagttctcacaagagctgatggttttataaatgtttgacagttccttcttcacacttgttctcttgtctgctgccatgtaagatgtgtctgcttcctcttctgccatgattgtcagtttcctgaagcctccctaaccatgcagaaccgtgagtcaattaaaccttcttttcttcataaggttacccaatcttgggcagctatttgtagcagtgtgaacatgaactaatacacccacaaatacacatagaaaacgaactaatacacctacattagtacactaatacacgaacacactatagcttagcctagcctacctgaaacatgcttagatcacttacgttagcctagagttgggaaaaatcatgtactaatattaaaagtgatttgccaccctggcgcagtggctcacgtctgtaatcccagcactttgggagcctgaggtgggtggatcatgaggtcaggagttcaagacgagcctggccaagattgtgaaatcccatctctactaaaaatacaaaaattagcctggtctggtggagaacacctgtaatcccagctacttgggaggctgaggcaggagaatagcttgaacccaggaggtggaagttgcagtgagccgagatcgtgccactgcaatccagcctgagcaacagagcaagactccatctcaaaattaaaaaaaaaaaaatgatttaccagtcccagctacaatattgcaatatagttatccttattatatgtagtggattggttctaggaccaaccccccaccatatataccaaactctgtgcatactcaggtcctgctattgaccctgtagaatctatgcatgtggaaagtatacagaagtttcatgtgtattttaaatctgcatttggttgaaaaacatccacatataaatgcacccacacgattcgaacctttgttgtttaaggatcaactcaatttgtatttgtctgtatatttacctttagcaatgagttttatatgttcttatgtagtcttgttgtggtttagcatgttttatttcaagttgaaaaacttccttcagcatttcttggtaaggcaagtctgataatgatctccctcaacttttatttgtctggaaaagtctcttcatttttgaaggacatttttgctgagtataatattcttggttgctagttgctctttttaattttgtgtttttaaatttgttttgttctttcatatctttcaatatattattacatttcttcctggcctgcaagtttctgttaaaaaaaattcatggatagtcttgtggagatgttctcgaaagtggcaagtgatttttttcttgctgctttcaaaattttttctttgtctatcagttttactgattctaatgtgtcttagtgtggatttctttgaattcatttagtttattatcttttgagtttcctagatttggatatccactttcttatccagatttgcaaatattttagccattatttctttgaatacactttccagccatttctccctttcttccttattttacttccatacacgcatattggtccacttaatggtgtcctataagtcctttaagctttcttcacttttttccctctttttccttttatttattttattaatcctcttcctcagctccatgatttttgtttggtactttaaaaatattactatctattttttgatattgtaaatactcacatattgttcttctaaccttgctgtcctcagcagttattttgaaatctctttcatataaactataataactccatttcatgagggtcaatttctagatatttattctgtgtctttgtttgggtcacatttccctgtgtcttcattttccttgactctctatgttggtgtctgcacataagacaaaacacccacctttcaagtctccaaagagtggacttttacaaaataagaccctcaccaattagcctggccagagattctgggggcctctccaaacttcatggtggttcagcttgctttctttgttgttagtggcctactgtggtctggagaatgctgcatttcattagttctccaagataagcaagaataaagaaaattccttaggaaagccccctcaaatttaaatttttggatactctgcccaaatcgctccctccccaaagagaagttagtatctggagttgagatattacctttttgctatggattcactagtggggaagggctgtggcggctagttgtgtactaggtccaactattaactctgttctcactgacccccaagtggctagattatgttgggtcctatcaacactctgagacagactagactgaagccagttctctgagtaaccctggaaatgtagggtaaaaggtacacagcccatctctttccctcctcatggagaagctggaagttaggttattttcttccattgagctgaaaggagcagctctagtgactgccagcttaaaccactgcctctgttctctcttaagtggctaggttatttcagatcccatcagtgctgcaagatgggctagacagaaggcactcctatggttagctcccagaaaagttaggtcattggatgcagtctactctttccttcctcaggaagaagctgagtgttggggggtttcctcctaattgtatggcactgtgccaaaggtaaggagtatagtaatatggtgtttaaattatccctactcccttcaatttgggtagttttgttctcatccagaatttaagagaactctggttctactagtttctagatttctcacaaagataatttgttcataaatttttgctgaataggtatgtttgtaggggaaaggagggtccaggccttcttatgctaccatcttgctgatgttccaagcaaaaagtggtttcagtatgtttaaatgctgtgttgcataaagagggaatgtttgaagaaatgagagaagtaggaaataaatgaaagcttggggttcttaagaagatgagaagaaacaggatgcagaacacaggcagagggattgttttattttataaaaggaatttatttatgtattattttcattgagatatattgtgcatgttatacacactgctattttataatttttccatggctattaaaccatcaacattatgtgaaacttgaatattttcatcagcagcaaaagaaaccaaccattaatggacatccactatactctcttactctattttctagtgaacacctatctactttctttttctatagatttgcttcttctgggtacttcatataaatgaaatctcactgtatctggttatttaaatcagtgcagtgttttaaagtgtcattcatattgtagcttgtaacattgcttcactcatttttaatcaggcagtataatatgccattatatgaatatatcattttttcatccattcagttgatggacatttttcttatgtttactatatgaaaaaaattcattattatgaataaggctgctgtggaaattgtttactggtatttgagtaagttttcaattatcttgttaatgtaaataggaatgaaattgatgggataatgattttatttttaactttctgaaggaatgccaaaatgtttttaaagtgcttggaccattttacatttgcacgtccaatgcaggagggttccaattttcccacattttttcaactcctattatccaccttttttatcatagccatcatagcagatgtgaagtggtatctcattgtgggtttgttttgaacttctctaaacattaatattacatttgcttattggatagtagtatatttatattggaaaaagtctatttaaattatttgttcaatttctaattatttatctttttgttgttcagttgtaagtgttctttatatatacttatacaactcttaataatggaatatgttctttgaaatgcatctttaggcaatttagtccctgtgaaaacatcgtagagtgtatttccaccaacttagtatagcctactacacatctaacgtttatgttatagcttattgtacctaggccgctaacctgtacaatatgttgcagtactgagtactgtaggcaattgtaaaacaatggttaagtatttgtgaatctaatcatctaaacattgaaaaggtacagtaaaatgtggttaaaaaaaggaaagatgaaaaattgtatacctctctatagtatttaccatgaagagagcttacaggactggaagttgcttgctctgggtaagtcagtgagtgtgtattgagtaaatgtgaagacataggacattattgtacaaaaatgtagactttataaacactgtgcttaggctacactgtgtttataaaactatttttctttcttcaataataaattaaccttagcttattgttacctttttatttataaatattaaaaaaacctttgtatcttttgcaataacacttagcttaaaacacattctgcagctgcataaaatgtttttctcatccttattctttaagcttttttctatgtttaatattcttatttaactttttaaactgtttttattaaaaactaaggcacaagcacggcattagccaaggcctacacaggaacaggattatcaatatcactgtatgtcttgtcccattggaagctcttcggggcaattacatgcatggagctgccatcttctataataacaatgccttcttctaaaatatcccctgaagaatattcctgaagctattttacagttaagttttttataagtagaatgagtgaactctaaaatcacaatagaaaatataatatagtgaatacataaatcagtaacagtcatttattatcattatcaaatatgatacactgtacatatatactgtacatatgtatgtgctatacttttatataactggcagcacagatttgtttacaccagcatcaccacatcatgtgagaaatgtattgtgctatgatgctatgatggctatgatatcatgaggcaattagaatttttcagctccattataatcttatgggatcatcattgtataggcattatatcattgaccaaaatgtcattaaacaatgcatgactataatcctgatgcctgatgcataacagacacatgatttgacaatattttctcttcttctgaggcttgtctttcactttcttggatgtccattttgaaggataaaatattttatttttgatggagtccaattcatctattttttggttgatttgtcaatttttttaaccttttcaaagaactgacttatttgtctttatttcctctattgtttttctattttttatttacttttgcttttataattactgtgttcttacttctggttgctttagattgctttttcttcttttttagtgtgtaactgaaaaagttaagatttaagtttagaatttttcattttagattttaattttttaaatataaacatttatagctataaatttcactgaatattctaaatttggatatactatgttttcattttcatttatctcaaagtactttctaattcctttgtgactggttctttaattatttaggagtaatatttaattccatgtatttgtgagaccctcaagttttcctctaatattgatttctaatttcattttctggttgtcagcaaacattttttgcataatttcaatcattttaaattttgccaaggcttgttttatggcctaaatatagtctactctggagaatgttccatgcatgtgtgctggagaagaatgtatatattatgttgttttgttttgttttgttttgttttttgatggctctagtgttctatatatgtccgtaaggtcaagctggtttacagagttgtttaagtcttctgtttccttcctaatcttctgtctgattgttctgaaaatgtcttttcaatttttaagatttcgctttcattttaaactagtttctcacagtgtgatatttctgataggcctggtatccattataacttctatagactatgccaatgatgttattacgaggattatggtatcatgatactaacaataaacagtattaatatcagctgctttttaatcatgccttacgataagagtttttaagataagagttttcttatgacaaataatgatgatggcaagggaaaattctaattctgaaactatgtccttgtatagtccgtgatatctataactggaaataatatttttttcttttttgagatggagtctcattttattgcccaggctggagagcagtggagtgatcttggctcactgcaacttctgcctgctgagttcaagcgattcccctgcctcagcctcccaagtagctgggactacaggtgcctgccaccacacccggccaattttttgtatttttagtggacactgggtttcaccgtgttagccaggatggtcctgatctcctgacctcgtgatctgcccgcctcgacctcccaaagtggtgggattacaggcatgagccacagcaccctgcctggaaatcggcttttaaaaaatagtcttaaaaagctctaaggaggggttggagaaacaactattaaatattagttttccttgaatagctgttgctgccactttaacaattggttggagtacagaattagcgcaatgacatccgctattaaacaatatcagcctaatattaatatgaagatacatatcagacacagcagacgactcttcttcagtttatttccctgataaacatggccaatgcttttcacatgttatataggagagaacagattacagtttgcagttatgattgccttcagctccagagagaaaagaagttactgtggcttaaaattgcatgtagccatctatacagtaaatggtcttatcactagattcaatgtatgacatgaattaaatgattcaaaacgcacttctaagagagagatggtaatgttttgcctttaatttttagtatttttttcagctaaaagatttttgctgtttttatgaaaaatatcattttgccttttagattcctctttgttcaaaataaaaaataaagatatctctctttccaaaatactttcatagaaaaggtgatggcccaaagctaaagaggagagggagtagtaagttcctgaaaactgaagagtgacttgacacctgcagtgtcctctggctaagtgactgggaggttagttacctgggcccatgaattgtgaattgtagcctaggagactccttcccaaggcactgtccaatagctctcttggagatgactaccactggcttccttgctggtctccatactcaatttttcataagattgcaggatcttttggtgaacttattggactcttgtcttatcttccccaagatcattttttttcgcccatcgtagatctttttatatgtatcatttttttcctccagtcatagatcttttcatatgtgtttgttctctggctgcacataccggggctaccatgcttcaattgccttcacaatcattcatagtcaagtgtctccactgagtggaagcctgacatagatggtcactggacctttaatatccctaaatatgactgaaaccccctgccctccccaaaactgcccaagacaggcacggggattttctttctgcctgcatgccccactatgccactttggtttctcatctgtctgctgctgctgctatagattttacacccccctccctcctcccaccataaacctgcttgctcatctctatccagggaaggctttattttagcaaaactgatagcagaaataaagaagagacaactttgacacatttttttttctctaccccatgactcccttctatccccaagctcttatctttacatcttctaaccctcaggccttctcacttcatttatttattccttcttttcttcatttattccataaacattcattaaacatgtcaatgtgcttggtatagaatggtgaatgagaaaaaaattcatgttctatcaagatttatattccagtcaggaaggcaggcaagaaataagtaactaagtaaatacataaatggcaacatttaaggtaataagtgcaatgaataaaaataaagtagggtaaatgaagggaggtaaccaggctggtggcaactgtggctacgtagtttagattagaataatcaggagagacctcacagagcacttctcatcaacccatagatcttatcctgctggattcccaaagcccctttcatcattcatcaagtggaagaatttgaagtaaaatggaagataagttcctagtattagaggtagaaacttgagattcattatccactaaatattgttctgcagtggggtagaggttttgtagcaattcatgccagctgcttatataacatccattatcttcttccataacagaataccactttttcttaaaaagtaacaaagatacaacaatgtatacatcataagtacacagtttaatgaatgaatgcatgatgaacacacttatttatccatctcctctcagactttcttttgtcttgtcctaatcatcattcactctgttcttgacaaagttacacttaatttttactttgaatacaattgatagtttttgcctcttctgaattttaaaagatatgatacattttgcattatttttgtctttggctatttttgcttaatattatattggtgagattttctcaagtggttacatatataggagatttactcatttttattgaaatatggtattctcttatgtgaatataaagacacttatttaggcattctaatttaaatgagcattttcatttttattccgatttgggagatacaatagtactactttgaacattcttgtacatgtcttctggttaaaaaggtgtatgtattctgtttttatatgtcagtaatgaaatgctggatcataatttatacatatgttcaatactgattgtactaatataaatgcttctgagcagtttatgagtttctgctggtctacatctttactagcatttggtattgacaaactttttaactgtagccatttcaagttgataatatttcatatagttattatccattttgatatcattaaagtgactattcaaatttcttatctatttttctattgcattttttttatttatcagaagttcttcatacattcttggaaagcaaagccttttgttgtttataaatacagaaaataccatttttttccatatatagagacgcctttaattctgctaatggtatccttaagtaaacataggatttgtggcacatgaactcttctgtatgtaggtatttatttcttgtactatttgctaacacaagtcacagctgtaggaaaaaataattctgagatgagaatttggtctattttttatacagattaatttcatattttatgactcaacaactaaaaatattagcctcaagtttttaatctcatccatactcctttcataactagacataatactacctaaatttactggttttgctcaaataagggctttataaaacattattattttctaataacattgttctctagcttagttcttatgaaatatgagtacctttttcttagggataaacacgtctattttattggaaatcctgtgaaagtgtgaagtcaaacttcagggtttgagattggtgacctgttcagaggattcttatcaacctgaatctcattctggggtgaatttttactacaggaaacaaaaatacttctttcatttagccaacagtgcaagaaacgtaaacattccaagagcaaaggaaaagcaaattaaaacaaacaaacaccagttcttttctatgctagggattatgtcataaaatcagaaagatctttaaaggtagatggtttccctcattttgaatttcagatgttttaggaaaattatcttttcacatttgggaacaatcctaaaaggaaacccctactacagtgtagataacccttatctgaagctactttctttatcttacagtttgtatgtgaacatctactaggattggaaaaatgtaatggagtcgagaagcaggaggcacagagaacaaactgtgatcagttcagtccagatcagtaaatgggcaacagtttaaaattgttgggttcagaggaagatcatttcaaatggaaccagaaataacttgaagttcaggaaagaaacaggacataaaatgatctgaaatctgtgcccatttgaagaggaatatggacaactcaagagttcagtaactaaaaccaggatagtactgtgatttggtaactacacttcttaaacacactgcagataggtttgtttagattacaggttggtgggaaattgagtagcatctgtggattagtggaagcccctttttgggatgaagccagcaatatcaatatttgtgcatgacaaactaatgtcctcagatatttctccttccacactgtaaaatatttaatagaaaaggtagctttggggtctcactactcctcactggcagacatgcatgcacatttgatctctgccctatagccccttttcctgtgcttctgtttctccccgtggggggaatggctctccctgaggtgcattctggggatgcaggtcaatccagttggccgttattgtccaaaggaagttgaaagaggccactaccaggaagaaaacattggagtctcctctgtataagatgcaacctcctagtttctgcttccagagaagactagtcacacgttcaatcctctctctgcctcattcacaatccttaggccttaatctcctgtgagcctttccccctgcggtgacctggaggcatgggctgtttgggattgccatttggcttcttgagcacttcggttctggggttctgtggtacagagaaaaggccttggacaagtccacctgtggtggtatcaccagaaagatgagtgatggcggtgtttctatagagccccatgaggccctctgccattgctgaattttgtgttgaacacagaaatgatgttaatatacattttgaaaaatccaaagttgcatttctcttggagaaagttaatcattgtaaacatttcaatgaaattatctttttcattgggtagatccaaatgtttccaagcataaaagaacagatgggtcaacactatgtttgtgaaaaggggaatctgggcagtcatggccaaggttaacaaaagagcaaagcatgtttggcttagtgttgactcacataattggaaagaaaagaaagatgatttagatatgtttaattctgaccatttctctgagacgataaacatgggtggtgataaggatgtatatttaccagaagtagagggaacagatgatgatccaatgatgattttaaaggccaaatctggagtaaggaatattgctgtcaccaggattgtgagaaaaagaagcaaattttctgcaagattccgtaattgagagaatttctgagttgatagctataatggtagaagctgtatttctcccctttaacccatttttcaacttgtttgttttttaaaggtcttcaccaagggttgaatgggacaactttatattgtgtaggataattttaaatcagttcaggcaataaccttacacataaacatttccattctatgagattgttgaggtcctaggcaattgatatcacagttgtaataaataaaaacattttttctaagtcttcttaacttcccaacatagatatgggcatgtagaaagttctcagcatatggaaagataaccaaattttagacttcagaaaatggacttaaaagttgtgaaacaaattacctgacactttaaactggcaacctattgttcctctagggtatccttcaggacttttccactacaattttagttttataaaaaaaatacaccttgttttacataagagtcacttatcagtgttgcagatacataataattaaaactaatgaatatcctaacttacatggttgtgaatcctgtacatttagtatggtttgacccttaagctttgacaactttgagcatggggtacaaagataaactatgttattgctggaaagtctgtatatttagaaccaaatttgtaatttcactattgatatggaaaatgagagatttaaaaggttgatacgatattgtatctttttcatctttctattaagcttacatcaaggctgaaacacctcagtttgttttcataacagtggagatatttattcatgtctacatttttataataaattattagaagaattaaaaaagcatccagtgttagaatatccctcttcttacacaaccacactttctccctcaatacatacactcaggtaaacttaacatgttctactttttaatcacggagcatattcgaacagaggtatccacaatatgcaattatcactatatctctaaatttaaaatttgacctttgtctttgtcagagaggggagaaaatgccacagttgaagaagcacagtgttctttattcttattcaaaaggcagggtcttcatttccattcctgagtacttttcccacttgaatattttctttattgttacagctaacagaagatggatccattttcagtaaatatggtgattctaattttcagtcctttagttttcacctgactctgttcattattattcctcttgtttaattctacctgaggctgctcctctaagggaacaattcacttagattctttagagtacaaacctataaatgctgtatttgcatagtttgggttgtcctaaatattctagctacttatctattaatgtttttctgtttattctcttagaatttgttaagctcagataaagtgagataaaagtgactctaagaaaactcaattgtttgtattttgactataaaatatatatttcaataaaaggtactgacactttatagatgtttttaataaaaataacttgggatgaagttagttgaatgtgaagccagaaagaaccacgtgttatcatttatgaattatgtttacatttccattgataattctcaagtgttataaatttaaactagattctttgttgttatttgtaacaacagcaaatgatgatcatttgaaattcacggttatactgcaggatctccacaagactaacttacctaaatacatatgtatttcatacaattattaagaacataaatatataaactatgactcatatttgctaaaagttctttcccactgtgaacattagtctttgtctattgtctttaagcaaaggtgataaaattgtccacagttaaagtggccattaggcaactctgtcattctgtgagcatcacagagtgtacttacacaaaagtagatggtataggctgggcgcggtggctcatgcctgtaatcccagccctttgggaggccaaggtgggcagataacctgagctgaaggctttgagatcagtctggccaccacagtgaaaccccgtctctactaaaaatacaaagattagccaggcttggtggcatgtgcctgtagtcccagctattcgggagtctgaggcagaagaattgcttgaacctggatggcggcggttgcagtgagccaagattgaggcattgcactccagcctgcgtgacagagtgagattccccacctccctcaaaagaacaacaacaacaaaaagatgtaatagcctactatactacccacctaggctatatggtatagcctattcctcctaggctataaatttatatatcatgtcactgcacttaatgctgtaggcaatagttacacaatggtgtttgtgtatctaaacatgaaaagttacaataaatagggtataaaatatttaaaatgatacccctgtatatgcaacccattacaatcttatggggtcaccatcacatatgcagtccatcattaactgcaatgtcatgttcccacggtttgccatggttactatgggactgaatgaagggggacaaatgcagaaatgaaaacttaaaagaaactgttttagagaaggggtctggggaagaagaagggctccctgcttctagtgagcaaaggcagcagccaccctgagcttctacagccctttgtatttattgggcagaaagagcagccaggaggaggtaatgattggtcagctgcttaactgatcatgggttcatattattgctaacaggcttcagatgtgcctaatcacaagcaatactgcacttggggcgtgactgccctcagcattccttctgggtggcagatgcagtttgtcagtttcccaacattctgcattcatgagaacagtctactatttactcatatagcttccagtgatacactgagttgatcactaacctcactcttttgccctgcaacatcatgtgacacataattataaattgataagtattaataagcagttttttaaaaaatctcagttttactgtataatagattgagtgttgatagagatataaaccacataaacaagagctctttggggtccccactgacgttaaagaatgaaggatttttcagtacaacaattgtgaaaataacagccttaaatgacagtccactgttgttattactagggcaggtggaagccactgccagttgagaactctgtgactgagaaacacatttgttccttgaaaccttggtttcatcatttgtggaattaggataataatggtgccgtaatattaagtaaatagtattacatctgtaaagtgcttactgaagtgcctgcacataaatagatattgatcattgctagagatcatttttgtcatcacataaatgagaatttattgaatgtccacttcatggctaacatgagactcctcttttggagatcaaagaagcacatgatgatgaaccaaatttccccaattaaatactcattgagacaatgaatagcaacacacacacattgctaagagaacaataacagaaaaacaagagaaaaataagttgaggcacatttagcacaagacaccttgtaattattctaggtgttcagagaagaaaaagcgaccagaaagaggttggagtaggcaacatttccctgcttttatggacttttgaaaacttctgaacttctcaaagaatgggagcaatgtgaatatcagagaggagatagaagggtattccaggaaaggtcatagtagaagcaaagaaatctccaagagaagtggctgctggagaagaataagagagacatcatataagggtaagggagttaaattaaagaaatagattgaaaaagtagggagaggagatttaatttgaagaggtgagttataggtaatttatgcaggatcttgcacaaaggaactatatgaggaaagttgtagttttcttgtttacagcagtgcccactctacaacttgtttacagccatgtactcagaacaatgtacgttactaaatgatttacatgcagtattgcttttaatcttatgatcacctcatgaagtgctgtcatgaacattgagatttcctccacaaatttattcaaattcttcctcttgatataccagctacatggttcgatggcattgactccctacttttaccacaccctgagagtggaccttgattgctctcacggcgtttgtttgatggttgtagggaattataggcactctccctttagttgaataaaggcaccttgcaatgattaggagagtcatgctgaggacaatgcagacacattgaatatggtaaagctaggaaaaatgcagagccatagttctgtgattgatgcctacattcacatttatcaactaatacagtcctttgtttaatctgagttgtattttctgtaacctgcaactaaaaatatcctgtctgatacaaatagatattttcatctattttaaagttgcagaaagtaaagcttagagagattacgttaattgcctaagacctctaagccagcaaatgtcagtgccacgaattgaacttggctgaatgtaacagaaaaaacaatgaatttttcatttaagaatgtttatctgtctagtaggacttcagctgagactggcaaatgcacagcaggctaacatgctaataagcacctgtgggttcagtcaagtgtcagcataatttgtgataatgggggagaagagaagagaaacctttgatacacacttccttcgccttacttgcaggcaccaaattgcttgagcaaataattttaccttcttttcctgtttcccctcctatactatgaagttactctccaatgatgacagatgacatgctaagagtaacacctaaataaacatgcaattcttttacacatgtttaatttaaaatggtaattatggtgatgattccagattttagaaagaaaaaaaaggaaaagtacagattatgtcactcctaatcatacatcagagaaaccaacatgatattccatttattttgtgattttgtggttttgcatgtgtgtggtttataattatggtagtgacatataaatgtacatattcatttctctatttgacactataaatgtgtgtctcttcacttagtatatttgaaaagaagattgtgagtgttgcatgatagtctgttctttggtgtagtaatatttaaacatattgaaatgtatttaaccatttctcaatatgtaatagattaattctaatttttttgaagtaaaaaaactgtgtgtgtaacaaatttttcttacacttaaacacagattagattcctacatgagtaaatatgtgctataactttttaaaggatttttttatataaaatgccaaattacattttagaaagtttgggccagtgtaaaatcatgtcaggagcgtaatagcccattttgcttcaccctaaccaatattgaaatttatcattcttttcattatttgttatttgcaaggtaaaaacaaaacaaaaaaaaaccaaacctaagaattcttgaattagttttacttaataaaccaaaagaattaaatttttgttttcattagtgtcacttatatgatttataaatcacacattttcctctggctttaatatgtaggtactttttgtttttttaaaaatgtctttaaatattaatattatcattaatttattcaaacattatttctggtttgctgtttgcttttaatttgtttatgcatttaagtgtgaacagtttctaaacccattcttagaaattgatcacaccatgctatttttctctttcttatttatttagtttttcaaatccacaaaaagaaatccatcaataactctgtgagatatttaaggatatagttcttttgtttggttaaggttacatttaacttttaaccatttgacatttaaattggtgttttgccagaaaatggcctactttttcataatcttcttcatccctattaaaggaaatagaatcgaaatgatgaagacacgaatgatttttggaaaaggtgataaacacattattcacttgttgacattcttctatcgacattagtcaggtattatctatatatgaatgaggtcttgtgtttaaggaatatgcacttcagtaggatatgatatacataactgattgtggtgcaaacaaacaaaaagttcacaaaagataattaaatactgtggtgtaacaagaaagaaaagagagaggaaggaaggaaggtcagtcagtcaggaagagggacaaataagaaaatactatagttgttgggagtagaatcacacagaaagtttcaaacagacagagggcatcccttaatttggccatggagaaggaaaagaaacaataggtagaggaatagttgaagttttgtaggctcagggatatcattaataagaatttatgaaacctatttggggaattttgagcagtcagttctactgcagtgacagaaagtagtgtacaacaggcacattatgactttagggcctcaatatggagagcctgttaatttaaggttcaagaatattctttttaaaatatatttttatcaaaatgcaagtaatgaattgttacaaaacatttttaagggagtggtaataagagggctctaaaagtaagaaaataatccggtagagaaatacggttttctaggatggagaagcctaaaagtacagagactactgtagataagtagtattgggtccctgagttaggacatgttcaggggaactgaaagtgaagctttaaatgaaagaaaaatgtggaggcaacaatctaaagaacttcaaaactgatagcacgtggagacagcaaatgagtcagagttgaacccaaatttgtcatatgaagcattgattagtcactggtttcaggaacttaatatgtgcttgaaatagcgcggctgcaacttaggatagagaccatggctacagatgtagatctgcaagtcattagtatagatatgttagagctggggaatagataacatttcctagaaatgctaaacaattttggaaaatacttaaggagcttaagttggaaaagaagtcagtggaaaaaaacagagaagccagtgaaaggtacaaaaggaatggacagggaagtaggggcacaacaaggcaaaggtttggtgcagcttggtgccaggaggtccagcaaaatgccatcaagaaagggcttttagaattggtctttgggaaaatatgtagagtattaatattaaagaagctggccagatgcagtggctcacgcctgtaatcccagcactttgggaggccaaggtgggtggatcacttgaggtcaggagttcgagactagcttggccaacaaggtgaaacccagtctccactaaaaatacaaaaattagctgggcgtggtggcatacacctgtagtcccagctacttgagaggctgaggaagaagaattgcttgaacccgggaggtggagtttgcagtgagccgagatcctgccactgcactccagcctggtgacagagcggaactccgttaaaaaagaaaaagaaaaaaaaaaaactaaattactatgcaaacacaagaatttcatggtggagggagaagaaatgtgagctattttaagctgtttttttgaaatttctatagcacagaaaagaaaaaaaggccaaaataacttacagatgcatccaattagaggaaatgtcccttaggaggagaaacaaatagtttgatgttaatgtttattttgttgttgctctccatttggcatggaaaactattaaaaatatagagatgagtatgaaaagaagctgtccaagaggccagtgaaagataggcaagaactaatcacacaagataaaaaggtggtagtagatgaaacataggtatttaaagacaaccaaaagaggcaacgctatattatataatattgacccaagaaagcatatgagatgttatttcgtgagcataaagggtccagaagtgaaactggagggtgaagaaaagtaggaaatatttgtaagagtaatcactgaaaataaatccaacattcaaaaagaaataaataaaaatatgtattggtagtaggaagaagcagactatgatgaaaaaatgtaaacttttaagtaggtacaaaaacagatctgtggatttacctagcaatataagaatgggttttattctttgcagctgagggatagatagagcatatatcctagatagatagatagatagataaatagatagatagatagacagacagatagatagacagatagcaagcatacatcatagatgctttatcatagataaagcatacatcaacaatctttatttcatgtatttgtttagtaacatttaatggtcatatatttagaacatattacacacttctactagataaggtgtgagtagagatataagaatacataggacacagttcaaactattgaataattgagagtttggaaggtatgagaggctaatatatggacatgcacagtgaaatatactgagtgcttggatgcagatatgctctgggattttcaggaagtttttccataggatcatgagctgtaagtcacaaagaatgagtagaaattacccagtgtgataggatggtctaggagtaaagaacattccatacaaatggaaacatgcagacaaagattcacagggctgaatgaggactgagaggagaactaaatagagcttcatatgtcttgaacacagtacactgttggacaattgatgatgggcagatgagactgatggatattcaagactcaaatggaaagacttggtttgacatactaaatatttgaacatgaagacaaaaggaatttattgaaggattttaaacaagtgaccaacatgacatatttaatatttcagaaagattactctgtgatgggttagtgaaaaaactggagaaggatataccatatgtgtttaacattaacacaagttaaaaaattattgcaatagtccaagtgaaatgtgataagggtaaacctaaatcaatgacagcaggaataaaaagggaaaagattacagatatgagagctatcaggcagtcagacttaatatgaatgatgactgactggataagaaaggtgagacatgggaggagtcattccattggaagaaactagtgataccatctgaaaataataaaagagaagtgaggagcatggagtatggaactagaggcattgttaatgcagcaatggaaaaagttgaaggagtctgtgattctaggtaggacatagacacacagttgaaatagcagaccttgggatatatgttagggcaaatgaaataaaaagataaatcagggaggccgaggtgggcagatcaggaggttaggagatcgagaccatcctggctaatatggttaaaccttgtctcactaaaaatagaaaatattagccaggtgtggtggcgggtgcctgtagtcccagctacttgggaggctgaggcaggagaatggtgtgaacccaggaggcggagcttgcagtgagcagagatcgtgccattgcactccagcctgggcaacagagcgagactgtctcaaaaaaaaaaaaaaaaaaaaaagagataaatccatggagctagaggtcaaggggggaacacaaaggcactgtataccaggaagtgaagaaagtagaaggctaaaatatctgattttcttactagatggtctatttttagcctttgcttctaggaccatccatatattaatgactccagctcttatgtcctctatcctggtttctctctaaacctccagcatcatgtttccaacgttcttttcttaatttctctatgacaattttcagcagacactttgaacttaacccatatcccaaactgatcttgtgtctatccaggaattatattgcaaatattcacaatcagtatggtacaagctcctactcattgcaataggtcttcaattaatcagaatgaacaatagcagtaaacaactggtgagccagaccagtgtatgccagctgaatatcaagttcttgcatttgcactttatgtcaatagctctaccatatggcagttttcagttattgtaaagacaaattgtcattcctgacaatacaaacacttggatagcaaaaaaaattaagtacttagttggttaaaatgaattcccattctatgggaatgtgctaggagctagaataactgttttttttgtttttgtttttttttttgttgtttttttttttgagatggagtcttgctctgtcacccaggctggagtgcagtggcacaatctcggctcactgcaagctccacctcctgggttcaggccattcttctgcctcagcctcccaagtagctgagactacaggcacctgccaccatgcccacctaattttttgtatttttaatagagatggggtgtcaccgtgttagccaggatggtctcgacctcctgacctcgtgatccgcccgccttggcctcccaaagtgctgggattacaggtgtcagccactgcgcccggccctaactgtggtatttttttaataatcagaagaaaatagagcatagttttaaagtgtatatcaaatttagatatataaggggcaaggatatatatttcaaaggagaaaaatgacaccttaatgttctaaaatagttgtcgattcagttttctttaattggtattcattattgatgatatctgtcattgagtagtaaaggtagattaaaatgacagcccacaaagagcaagaggaaaggctttcttgtgtcagataattctgaaactattttctatttaagatccaggatctaaaaactgagatctaaaaactgataattctccctatgacattgggctttaataatttcttcacatactaacttattaactttttgttccaactctagtcatggttttctcatatatcacagaaccattacaaacaagtaatagttgatttgctaagatattaaagtatgaagtaaagctttcctaattttcaacccacttagctttgttttatggaaaactcaagcctattacattttatttaatattcttagcctaaaatactttatagattttgtgcctgggtaaaacaaaagaaaaactgttttaagaaattcttcatttgacctcaaaataaactcaataataaattacaaaaatatgtcatttttggactaaagtcaacaatataataagcctggtttatccattggctttgagtcacagaaagtcccttgataatgtgtgacaaagtattaaactttaacaatcaaaacagagtttctgttgaggaatagaactttctcagtggacattatattgattttcattatttttacaggcagaaaagaaaaaaggaagatggtgattgctaatagtaagagttatactgacatgactatatataaaatattgtggaagaattctgccctttctactaagaatcccattaaatactctcattactttctttatcatgtagattatagtgatataaagaatgggtaatttgacagttttctaattatgcagtgtccttttttttttttttttttagagtttctcgctcagagttgcccaggctggaatgcagtggcgcgatctcagttcactgcaacctccaacccccgggttaagtgactctcatgccccagcctcccgtgggactacaggtgcatgccaccatgcccagctaattttttacttttagtagagatagagttttcctatgttgctcaggctggtcttgaactcctgagctcagatgatccgcccgcctaggtctcccaaagtgttcggattacaggcgtgagccaccgtgccccgccttgtcttgtaaattttaatagttaatttatgtttatttcatttattgagaagttagtggggtcttctgaatttggcatgcaccatccataattatctgctgttcctgggcacttatataaatgaggtgaatggtggcaatagtgacctaaagcaggaagtccagataaccatgctggagaagattctgttgtacaatgtaaatgaagctggcagaccatcaagtactaatgagcctagaactatttgcacaatattatggaaaggccctaaaactgagtgttctctactatgtagttgtaatgaaggaatttccacttctgtggccaaaacactaggaaaatctattagaatatacaaaacaaaggtcttcagaagttgaaccacatacagtacagtattgtgattcctaagataaaacatgagattagccatagggctgcccagtttacttcttggaggtagtttcctaactgcaatgcaggaaaggggaatccgaacagagccaggtggagtttttccatttagaaaatatgatttgagttcagggatcccaaagcggctcaaatatgtagagcaggctactgtagaggaatgaacttcttggaaagacagttgtggagatctgaaagtccccacttgaatccttaaatgcatattaaattgcaattgtgtgagaggaaacagccactagaatagagcagacaggacccttttcagcactcaaatagggctgggaatagtttatgtgtttaccaatcgtaggaacaagaactcataatacaagaacattaggtaaaaattatcagataagtgttggattaattgtgggaaaaagttagtctgaaattaaaagcattcttaactaacctgagaaaaaattaacagccagtcttggaaggaccaaactaatttcaagtagcttaactacacaccataacaaaatgaattgtatttaatggaatacaacagagcccagcactcagggtgcaaaaattttaaatacccagaatccaataaaaatttaaaggcatgaaaagacttagaacaatttaacactataattaaaaggaaataattcaataaaattgattcagaaatggcaaagatgataaaattaagtgacaacagtgagaaaaacagctactatacaaatgttccatatattcaagagagcagggggaaccataaacgtgataaagtagaaggaaaaagtttaaaagaagtccaaaataaaattacgtgtggagaaaagtaaataaacaactttaaaatatattaattgacatgacgaaaccctgtccctactaaaaatacaaaaatattagccgggcttggtggcaggtgcctgtagtcccagctacttaggaggctgagacaggacaagtgcttgaacctaggaggcagaggttatagtgagctgagatcatgccattacactccagtatgggtgacagagtgagactccatctcaaaaaatatgtatataaatataaaatatatttggatatatgatgtataattttatattgcaatatatttacaatataatatataattatatattatagtaatctcatattatagtaatctatactatattataatatataattacatatcatatttatatattgtatataggtatatattatgtattatatataatatataattatatattatatattacatataattataatatatgattatatatcatgttacatattataatatatattatgtattactattatatattatatatattttttttatttttatttttttaattatactttaagttttagggtacatgtgcacattgtgcaggttagttacatatgtatacatgtgccatgctggtgcgctgcacccactaacgtgtcatctagcattaggtatatctcccgatgctatccctcccccctcccccgaccccaccacagtccccagagtgtgatattccccttcctgtgtccatgtgatctcattgttcaattcccacctatgagtgagaatatgcggtgcttggtttttcgttcttgcgatagtttactgagaatgatggtttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacatgtgcatgtgtctttatagcagcatgatttatagtcatttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatgatatctcatagtggttttgatttgcatttctctgatggccagtgatgatgagcatttcttcatgtgttttttggctgcataaatgtcttcttttgagaagtgtctgttcatgtccttcgcccactttttgatggggttgtttgtttttttcttgtaaatgtgtttgagttcattgtagattctggatattagccctttgtcagatgagtaggttgcgaaaattttctcccatgttgtaggttgcctgttcactctgatggtagtttcttttgctgtgcagaagctctttagtttaattagatcccatttgtcaattttggcttttgttgccattgcttttggtgttttagacatgaagtccttgcccacgcctatgtcctgaatggtaatgcctaggttttcttctagggtttttatggttttaggtctaacgtttaaatctttaatccatcttgaattgatttttgtataaggtgtaaggaagggatccagtttcagctttctacatatggctagccagttttcccagcaccattcattaaatagggaatcctttccccattgcttgtttttctcaggtttgtcaaagatcagatagttgtagatatgcggcattatttctgaaggctctgttctgttccattgatctatatctctgtttttgtaccagtaccatgctgttttggttactgtagccttgtagtatggtttgaagtcaggtagtgtgatgcctccagctttgttcttttggcttaggattgacttggcgatgcgggctcttttttggttccatatgaactttaaagtagttttttccaattctgtgaagaaagtcattggtagcttgatggggatggcattgaatctgtaaattaccttgggcagtatgcccattttcacgatattgattcttcctacccatgagcatggaatattcttccatttgttagtgtcctcttttatttccttgagcagtggtttgtagttctccttgaagaggtccttcacatcccttgtaagttggattcctaggtgttttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacgatggggttttctagataaacaatcatgtcgtctgcaaacagggacaatttgacttcctcttttcctaattgaataccctttatttccttctcctgcctgattgccctggccagaacttccaacactatgttgaataggagcggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaaggtttgttgaattttgtcaaaggctttttctgcatctattgagataatcatgtggtttttgtcttaggctctgtttatatgctggattacatttattgatttgcgtatattgaaccagccttgcatcccagggatgaagcccatttgatcatggtggataagctttttgatgtgctgctggattcggtttgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaatggtaccagttcctccttgtacctctggtagaattcagctgtgaatccatctggtcctgggctctttctggttggtaaactattgattattgccacaatttcagagcctgttattggtctattcagagattcaacttcttcctggtttagtcttgggagagtgtatgtgtcgaggaatgtatccatttcttctagattttctagtttatttgcatagaggtgtttgtagtattctctgatggtagtttgtatttctgtgggatcggtggtgatatcccctttatcattttttattgcgtctatttgattcttctctctttttttctttattagtcttgctagcggtctatcaattttgttgatcctttcaaaaaaccagctcctggattcattgattttttgaagggttttttgtgtctctatttccttcagttctgctctgattttagttatttcttgccttctgctagcttttgaatatgtttgctcttgcttttctagttcttttaattgtgatgttagggtgtcaattttggatctttcctgctttctcttgtaggcatttagtgctataaatttccctctacacactgctttgaatgtgtcccagagattctggtatgtggtgtctttgttctcgttggtttcaaagaacatctttatttctgccttcatttcgttatgtacccagtagtcattcaggagcaggttgttcagtttccatgtagttgagcggctttgagtgagattcttaatcctgaattctagtttgattgcactgtggtctgagagatagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtccgcttggtgcagagctgagttcaattcctgggtatccttgttgactttctgtctcatggatctgtctaatgttgacagtggggtgttaaagtctcccattattaatgtgtgggagtctaagtctctttgtagctcactcaggacttgctttatgaatctgggtgctcctgtattgggtgcataaatatttaggatagttagctcctcttgttgaattgatccctttaccattatgtaatggccttctttgtctcttttgatctttgttggtttaaagtctgttttatcagagactaggattgcaacccctgcctttttttgttttccattggcttggtagatcttcctccatccttttattttgagcctatgtgtgtctctgcacgtgagatgggtttcctgaatacagcacactgatgggtcttgactctttatccaacttgccagtctgtgtcttttaattgcagaatttagtccatttatatttaaagttaatattgttatgtgtgaatttgatcctgtcattatgatgttagctggtgattttgctcgttagttgatgcagtttcttcctagtctcgatggtctttatattttggcatgattttgcagcggctggtaccggttgttcctttccatgtttagcgcttccttcaggagctcttttagggcaggcctggtggtgacaaaatctctcagcatttgcttgtctataaagtattttatttctccttcacttatgaagcttagtttggctggatatgaaattctgggttgaaaattcttttctttaagaatgttgaatattggcccccactctcttctggcttgtagggtttctgccaagagatccgctgttagtctgatgggctttcctttgagggtaaccagacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaacttggttccattctccacatcactttcaggtacaccaaccagacgtagatttggtcttttcacatagtcccatatttcttggaggctttgctcatttctttttattcttttttctctaaacttcccttctcgcttcatttcattcatttcatcttccattgctgataccctttcttccagttgatcgcatcggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttctctcagctcgtcaaaatcattctccatccagctttgttccgttgctgatgaggaactgcgttcctttggaggaggagaggcactctgcgttttagagtttccagtttttctgttctgttttttccccatctttgtggttttatctacttttggtctttgatgatggtgatgtacagatgggttttcggtgtagatgtcctttctggttgttagttttccttctaacagacaggaccctcagctgcaggtctgttggagtaccctgccctgtgaggtgtcagtgtgcccctgctggggggtgcctcctagttaggctgctcgggggtcaggggtcagggacccacttgaggaggcagtctgcccgttctcagatctccagctgcgtgctgggagaaccactgctctcttcaaagctgtcagacagggacacttaagtctgcagaggttactgctgtctttttgtttgtctgtgccctgcccccagaggtggagcctacagaggcaggcaggcctccttgagctgtggtgggctccacccagttcgagcttccgggctgctttgtttacctaagcaagcctgggcaatggcgggcgcccctcccccagcctcgttgccgccttgcagtttgatctcagactgctgtgctagcaatcagtgagatttccgtgggcgtaggaccctctgagccaggtgtgggatatagtctcgtggtgcgccgttttttaagccggtctgaaaagcgcaatatttgggtgagagtgacccgattttccaggtgcgtccgtcacccctttctttgactcggaaagggaactccctgaccccttgcgcttcccaggtgaggcaatgcctcgccctgcttcggctcgcgcacggtgggcgcacacactggcctgcgcccactgtctggcactccctagtgagatgaacccggtacctcagatggaaatgcagaaatcacctggcttctgcgtcgctcacgctaggagctgtagaccggagctgttcctattcctatatattatatttaatatattttaatatataatatattactgtaatataatttataatatatttaatatattataatgtattatgtaattatatattatattataatatattatgtaattatattataatatactatgtaattatattataatatattatgtaattatatattttataatatattatgtaattatatattttataatatattatgtaattatatattttataatatattatgtaattatatattttataatatattatgtaattatatattttataatatattacgtaattatatattttatcataattataatataatgtattatatatattataaatatattttatatatacgtattttctgagatggagtcttgctctgtcacccaggctggagtacagtggcatggtctcagctcactgcaaactctgactcctgggttttatttatttttatattatatatatatatgtatcttttatttattatattatattacatatccattatagataatgatatattatgatatataataaatatattttatgtttatgttttatatcttatatataataaatgtatataattattatatattataaataatatataattatatgtatttatataatatttaactatatactatgaacatataagaatatattctataatatatcacataagtatatattttcatatattttatatataaatatttctatattatatatttttaaaatatatatattttatgtataagaaatatatttatatagtattattatatacttgtatattatgtataatatataacatattataatatataataaacatatttatattagtatatatttatatatattatatatattaattgagagataacagaagatgaactatatagaggaaactgattcttcctgttttgttttatctaagttttccccagacaccaagggcaagtaaggaaatttttttttttaagaaattcacaatacaccagtagaaagtgtaaaattaattacagattaaaaatataaggaagtgatccaagcatcggtaaatcttgagacaacagcatgtgtcataatatacatgaaatagaggaaccagaaaattggggaatacagtaaaaacactcatagaaacaatggttattttgtgatgaacatgataaagcaggattggcacagtgctaactgcaggccaaattcagtgtgaagcctactgtgtatggctttttagctataaattaactttacacttttgttgggaagaaaatgtacacttttttatgtgtacagagacacgatgtggctacaaaacccaaaatagatactattttgtccattacacaaagagtttgctagtcactgtgattagctaatcactagtcactagtaccaatttaaaggataaaatgaaccacgaacaaaataaaaataaagaaaaacatgccaagaaaacttgtaatctaattgacaaaaattaataaaaataagaaactcttcagacagctagattaaaaatgaagaattatctgcagatgactaaacgtaagaaagatagaatttcttccaaaatgatttaaaccaagaagatatttgttaatatgctgatggaataacaaaacaaaataaaatatgtcaactgaacattttataccaggtggaaatgtcttttaaaaataaagaaacagtaacatttgtaaagaaaaaaaatagctggaagaatttgttgccagcaagtctgcactacaagaaatgttaaattaagttcttgacacagaagagaaataataacaggtgtaatttgaatctacacaaataacactggaatactaaatgcacagataaatataaaatatttttctcagtttattatcaacttcttaaaagattatggtaataacatgtgttgtaaatgtctaatgtatctgtgatagactggatgatatcacaaagtatggaaaacataaagagaagtagtctgtagatgtgtatagcttacattaccaagaaaaatgtataatatatttggctgcagactttgacaagttaaaactgtggtgtacttttgtacaccctagagtcagtactaaaagtttgtgtgtgttgtgtgtatacatatgtagatgagtgtgtaagtatgcacatgatatgaataagaaaacaaattgtggaggtaaaattaaataatttttgaaaaacaaacactatagtcaatacaacaaaaaactggaagagaaaggaaataagaatacatgggacaaactgcaaaatgtaaatataaccaatacttattgattaaaaaccaattaaatgtaaaaatcaccaatacaaaaaatgaaaaagaagctatcgcaacaaactttacacatactaaaaggacaataagggaatattacaaacacatgggtatctgtagcgtgacaaattatgtaaagtggcaaattatttgaaagccacaaactactaatgtttcttctaaaaacaattgaaatatttaatagtatgcaccatatttatatctgagggagagaaagaaagatattaaataaatgaaatttgtagttaaaagcctcccaacaaagaaaaccccagagctaaatggcttctcttgaaaataccaaccctattagaactcttccaaagaatgaaagagagaaaatattctaatttatttgatggggccaagttctacttaataccaaaccagacaaaaacattacaagaaaagaaaatcacacaccaatctccctcataaatataggaacacaaaccctcaacaaaatagtagcaaattttatctagcaatacattaaaaaaaatattatgacctagtcatatttatcctgaaaattcaaggttgatttaacatctaataaagatcaatgtgattctccatagcaacataataaaaaagaaaaatcaaccatctaaaaagatgatataaaacatttgaaaagagttaacatccatagtcatggtgaaaagcctcagcaaactaagatagcaggacatcacctctgattaataaaagacttctacacaatatctacagctatcatatttaattaacattcctgctgaatagtaatgaatatttgttcttgaagttggggaaaaacattaagtgtttaacatatttaattaatatatttaattgttaaacacttaatgtttttccccaacttcaggaagaaagaaaatatgttcacattttgctattcgatatgattcagcaggacttatcatctcaataatgcaagaaatatacataaaaattggtaagaaagaaatataattgtcttcagaataacgtgatggtgtagaaaatcccaaaggatctagcaaaaattctgtagagtgcagtaagaaacatattgtggctgtaagattaatgatcgccataaagcctgtttagatatctcactgggcctacactatgtgtcacttagcaacatcatgcaacctggcctgggaattacagggcctctataataatgggacctaaaaaccttggttatcctagagacaaggcttcctcaacatgaatgaaacttttatgagccttaaaacaaagcttacctttacaagaaaagattaacttctttttatgagagaaacacctggtaactgatctggcctaaatacaggtataagaaaggtggaagaatctttcaaactctaagaagagtcttctgactgaaaccctcctggtcaggaggtcatccgacccctgactgtacttggctcatgccacaggtctactcctagtatccatcttgtaggagcactgacaggataaactgcttaaacatcggacggtggctaagattcatctttgatgtgaattggacggaaggggaaaagtccatgaggaagctggttaaccagaatcactcaagagctctgagtgtggcaatagttatcagacctagaaagtcagtttagcaaggtcaaaaggcacaagtcaatggaaacaaatctgttgtatttctttatactagcaataacaattggacactaaaagttaaaaagaatcacttataatattacagaaattcatggaatacctaaataatatgaaatgcatgtatatctaagcaaatatgtgtaagatttatatgctgaaaaaaacactgattttaaaaatcaaatatggcctagataaacaaacccatattctgtgcttatgggctataaaaatcaatattattaagatattaattctcctgactctgataatgcaatcatgataaaaaaaaattactgcaggattttcgtaggtatcaaaaagccatttctaaattttatatggaaaggcaaagtatgtagaatagccaaaataattttgtaaaggaagaacaaagtcagggaacacaatttacttacaatctattctaactaagtgatttctaagatgcccctaatggtcgcaggagtgaagccgttgaaaacctaggggattctaagcaaggataatgattgacatggtaggactgcattatgtaggttgaagggccttattcactagaggtgcactgctaattttggattgtgagcatctgccttggccctagcctagttcactgcttacctgtgtccttctggacctcagtgctttcactctggcccatgagtcagtaacaggttgtcaggcactgcagacaccttgcagtttaccaatgaagctgtgcttatttgggcccttccttttggctttccacacacttctcttcctcagctggtagatttctactatcattcaaggcacagatcaaatatctcaaattattcttactttctttccatttaacacaaacttccccatcacgtctagcttctggtgagaccctgggactgaaactcagttgatcagtttcagtgcttcacagctatgaagcccagtggacccaaaagtgagaccaattgcaaaggttcccatcctccctgtgtgtcttaacactggatctacatacgttattagaaactaatggtgcatttcatgttctccaatttccctgtactaatggtctgctttaggagcaattcaggaaattagaaagaatcacaatgcagaatattctcattcctcaacagcttttatgttatcagggaaatttagctctacccttcaaagaaacaagataaaacaaaatctcagaggatctgagaatgtggttgtgtttgtgtgtgtgtgtgtgtgtgtgtgtgtgtgtacgcacacaattttttttctcatcttagtgtctgccaaatataaatacattcccaggttaccaggtccaagtttagatgcttaatcatttcctttttgcatgtaaaatgtcataacacattcataaacttgaaaaataaagtcccaaatttaaaaatgcaactttcaattttccccttaatgactttgctttttacttctatatacatctcattcagagtaggaaacaatggaatactgctcttttgtttgtttttttagatggtcagtacaagtgcttggatgtaataacaaatacactcttttggtaccaagaaatagctgttaatttatcaactctgcattatttattatgcttaataccagtgccatggaccttcatacctggaatttagtaaaacaatggaaaaaaggtatggattcaaatctgggaaatgcattatgtgctcagggctaagaaatagtaggatatgctattctaaacttacacataggacacaatgatctgttagcaggtaaaccaattaatcaccagattgcctcatttttactgatttttattcctatcactccaacctcttcatgagcatcatcttctattattcttgcatactttatgtcaatccattttttcacctttattctaacttcacatttatctttcagttagtgtagaaactagatttgtacttgtattaggttccagacactcttggagattttcaaacacggagagcctgaaaatttacttcaaagatctcacaacatggtggtagaactggacacaacacgtgcacattaaacaattgatggataatttacaaagcaactgtcaacaaaacaaaataaggcacttgaatacataagtatgccaattaattgtgactttgtgctattcttgttacattgttccatcatcatgttattccattcagagcataacgttttcaagtagtggggataatgatatcttgcagagacacatgtggcttatctcaataataattatgtcattgtttcttttattcgtacagtaaatgattattaaaacaaatccttaatgagttgaaactcatagtaattcatctccagtttcatctcacgcagagctctaaagattcatgaatagtgatgggctagagtttttaccatgcttagtgattccttcgatagaagatgttattttaatataagattactataatgaaccacctcctgagtatcaacagacattcacagactcacaggcacaggtaatgacggaaatgtaccataatgaatattttgtattagagtttaattaccaaggcaggaacttggtctttgatgattttttaatagaaggtagaatgtttttctaatttagcatttttcagttaaaaaagctcattaaccacaacattccatagtgtaaaagatcatccatgtgagataagggttaaagatatgagaactacatttttaataaaagccattgttagactgttacatttttccttgatgctgatgtttctctcacacaatagatggtgcctcatgccaatctgtcctaactgtgcggtagaatactaacccttattgcctcccccaaacataggaagacttggcatcactgtactttgtactagggctgttttggttgctgccaactttgagagatgaaattaatctaagaaaactgaagctgagtctagtgcctcaaggacgtagagaatttattactttgaatacaaatctctaggtccttgtgttaccagtggagggtcttgactaggagttctccgggtccttggcattttgaataaaggattgaacagaacgcacaaaggcagaggaatgaaatgcagcaatgaagcagcgaaagcagagatttatgaaaatgagagagcactctacagggtgggagtgggcccgagcaaggggctcaagggccgcactgcaaagttttctgggctttaagtacgccttgtgaggctcttatcccctactccttatctggatgaaggatttgtctgtgactaattaaaccctgaggggaattggcaccctatgcagataaagggatggtccctgcttggaccatggccaattgaaggcactctccctttccacctgagacatagtggaaggaggagggttgtagggagagtagcctttgatcctttgttacttggagtggggagatgggggttttccttctgctttagctttaggaagtttgtgttaattggcttaagttctctgcctccagaccctaatctcctgcctcacttgagatttgacattatgacccacaggaaagtgatctaaccctctccacaaggaaagtctcaatgccctggactattggatatctgtctgtctgtctgtctgtctgtctgtctatctatctatctatctatctatctatctcctgtatctgattctgtggaaaaaaatgatattgtatatagaaaggagatgaagcatgagttagttacaagataaaataaaggaagaggaggatgaacagaagaatggaaataaagtgggagcaaaaggagaaaatgcttagcaggagcagatgttagttactaaagtgtcagcaaagtacagtcagggatctttgctgcatgaactctgctttcattcattcttcagaaaaaatttacaggaaactcaaggtattagaatttcattaaggatgactttctttctatttcatttcttccttcattgatgctattaatgttatcattaaattgaaaataaaatatatttccaccctattagacttgttttaatgtttcctagacacagtctttgaatatttgatgataagaaataaataagtgctatctggagagattttcctcaaaatgaagaaaatggcaggggtatatttataattatgaagacatgcccaatataatttaaatatccaagagaggtataattttataattctatatgatgaggagttattagaaataattatccctttaataatcactagttattttatggagatggattgagaaatttatctggaggatttgctttaaaatggccagattcaaagcagctataaaatgatttttggaggctagttgcaattggagctcattcaaccagtccatttccattataatgagatttgtttttaagtaaggtggggaggaaaaggacctgttaccataagtcacctgatccagcaattgcctattgttcaatggtgcattattatctatggtaaagcctaaagggttttggtgagactgctttgaagtagatatctaaggaggcacaatgatctcagtgtcccttctctccacccaatcttatatttagcttattttctgcctacctactcattttccattgaagaataaaaagaaatgtgtttgttaagtgactagacaaggaacagaattgactcatagatggtagttgaaggtacacaaagatttttgagctttaactcagttagcaaattagggatttttccaaagaggagctggcaaaataaagtacagcccgaggaaactggaaagcagcttgtatgggctgtttgagtctcaactatggaaaagcacatttttccttctaccaaaaccaaagaagtatattttggagattccaccatagcttctgaatgtcacatcatttggtgctgagattcactgtcacatatcaaattacaattgctcaactgactgcactggtaattaaaccatgggggaagtcaaaattctagagcacacaacaggaagatatcatggcttccactaagattttttaaatgcgagctatgaccaagaggagttttacgactgttttctctgctgttaatttctgctttctctcaacagtcttttacccatcctctgtgcaaggtgagattgccatccaccagggcaatgcagtagacatatgagttaaaaagaataaagtacaaagaagaaagatgaggacaaaggcagaaggaatctgcatatgcattataagcattttcaattatttccatcatgggcatgcattcctgttttgtaatgattttcggaaatttgagtgtaaattcttttgataaagttaaatcctattttaactagtgtcatagttcaatgaagagaatgcttggaaatcccggaagtcatgtttaatggatgttactaataaatatccagaaacaactgagacaaattttcatattaagggaggggtaatgtgtagcaagaaaatggaggagttatagaggccattgagttcaacaataaaatgcaaatagaatctcatttgtctccaaactcctcgagggtaggaatgttacaggtagttagataggcatgagcagggtaggagagggctcttctcccccacccactggaaatgtcaggtgatggatcaacaattatcacactgcctctctaaaaatgataattccgcagaagtgccagggtgccagggaaagaaaatctcctgatgttccacagctgttaaaattaaagtgttaattgagtgcagatgccagggagaagcaacttcctggacatatgtgttaagagacaaaatggcaaagtatgatattccagggacgctccaccagaaaagggaagaaagcctcgggcgtgtgtacaacgtcctaaacacactgcgcatgctcacttcctaagggtgagcagggcattgtgcatgcaggcagcccacactactagaaaaatcataggaaaagggtgcaagatagaagcctataaaatcctagaatcatggttaaacaccacacttgacattcaggtgctcacttgggtctcttccaagtgaattttcctttctttcctgttctaaagccttttaaaataaacttccactcctgttctgaaactcaccttggtctcttcttctgccttatgcccctcagttgaatcctttcttctgaggaggcaaaaattgaagttgctgcagacctgtatggatatgctgctggtaactctgataccttccactggtaacaggaacagttttatcactgcatcccaaacctatccccaaatttagcatcgagagggcaccaataactgtctgtcgaataaagtaatcactgcatatcgaattaattacacacatttctatgtacattattccaaaatatcaggtatcttacctaactttagcgggttttttaatagataataaaggcaataaatatctcctctcaaacggtatctttattttctcctgcatatacttactggggtatatatatgagtacatgaacataaagtataaaagttttagctaaacgagaaaagagtaaatgaattgatagccaatggttacaaatatttaacagatttatagcaaatgaatgagtcaatgaagacttgtcccaaaggttcttgtttgaggctttgtaataggtatgatgataaatcctagctcagttctacttcatatttgccctccttctctccttcattgtgaaggcctggattgaggtagttcttagtcctctctgctcctgctcccagaaaccaatagaaccttgtataatacagcaacatattcatcagttttttttcttaatcatctttgttcccaggaaacagtcacaaaaagaaaagaaagaaagaagaggaagagaaaggagaagaaaacaaatcaggttcgaagttatttgttgatatttcatatctaagaggggcagagtttgcataaaagcagtaggaaagaatttgcatatagatgaaaatagcttgttgaagttgtgatgtagaagatgctactgagtcacctaagaattcagctattaaaaaaattatagcaaagcatggccaaagaaaacaaatcattcagataataaagtgacaaatgtatctggttaaaagttagttaaaaagcacttctaaagtttatataatggatttagcgttggtgatttattcatggctgcttaaggcacttcattcttccgattccactaaagggtaagcagaagtgagggtcaaattattttacagtcagagtgacctaaatattgatcattaaaaatggatgtcagctcattgtactggagtcacatcctgggggctgttaggctttggccctcacagcagtctggggttgatctcgcggatttggctatttttaaagaatgtggctttggagtcgtgtggcacttaaagacaagatactttctgagaaatgcgttgttaggctattttgtcattgtgtgaacatcatagagtccactcacacaacttacatggcataccctaccacacatctagattcatggcttagcctcttgctctagcctataaatcggtacagcatgttactatactgaatattgtatacaattgtaatgcaatcatgtttgtccccaaacatatctaaacacagaaatggtatagcaaaaatatggtataaaagataaaaaataaaaaggtaaaccgtgtagggaacttactatgatgtagcttgcagaactgaaaattggtctgggtgagtcaatgagcgagtgagtggtgagtgagtgagcggtgagtgagtggtgagtaagtggtaagtgaatgtgaaggactaggatattactgtatattactgtacattactgtagactttataaacactgtacagttaggctacaataaatttatttacagaaaacaaaataactgcactatgacattacaatgcctatgtcactaggcaatagaaattgtgctgttctgttattatcttatgggaccaccatcatatatgcgatctgtccttgacctatatttcattatgcagtacatgactatattttaatatttaaaatacaaaatattcatgatttttcatgactgaacaccagtcccttgagatcatactacatatgttaaacagatgagaaaatgggcccacataagatactgttaggcatttcacagcaaacaatgagaacatttttttctgtttttttgtgtgacagaggattttatattgtatattatggggaaaaaaaagagcattacagtttgaaagatttatagcctgtgtgatggttaatatttagtgtcaacttgattggattgagggatgcctagatagctggtaaagtattgcttctgtgtgtgtttgtgataatgttgccagaaaagactgacatttgagtcagtggactaggaaaggaagatgtaccctcattgtgggtgggcaccatccaatcactgtcagcatgggtagaaaaaggcaaggtggacgaaggtgggatgtttacttgcctaatcttctggctctctttgctcttcctgtgctgaacacttacttctgctcctcctgccctcggatctcagactacaggttctttgggacctggaatctgggacttgtatcagcagcttcccaagggctctcgggccttcagccatggtcactgttggcttccagttttgaggctttcaaatttgcactgagccactactggcttctctctttcccaagcttgcagatggcttatcctgccttgccttgtaattctgtgagccaattctccctaatcaactcccttttatatatacatatatcctattggttctgtccctctggagaaccctgactactgaaattgtcattaactaaacagatttgcagaggtcatgtttgcaaggattagctgtgggttggtgatagcattttcttttgacatactacatttcagattagctggatatgttgagttaaacattaggcataagaatataattattaaaaagcagggttagaataaagatggaaatttgggtctctactaaaaatacaaaaattagctgggtgtggtggcatgtgcctgtagtcccagctacttgggaggctgaggcaggagaattgcttgaacctgggaggcaaaggctgcagtgagccaaaattgcaccactgcactccagcttgggcaacagagtgagactccatctcaaaaaaaaaaaaaaaaaaacaaacgtggaaatttgggagttatcatcatcatacataaagtcacaaaattgactatgactatctagggggaaaggttatacagaaacctaggactcaggtattccaactcctgagtcctagggtgtttgaatacatggagtgagtaatgtgaagaacaattagcaaagaccaagaaggagaagtcaaaaagtccaggagaagaaacaaggcatgtggtaacaggggagcaagtataaaaagtatttcatggagtgattgggtcatatggtactaagagttaaaatgaccttataatatattatccaaatctggatgcattgcagaatgaaagcagcagctataaataattaaaacaggacaatagacagagatatgattgtcccaggaaaagtataggatgtatactcaaactattcataggccagtgtagatggtctaagaattaattgttagattcagtaaagtggtggccataaatatccatcagaaaagtgatttcagagattggcaatgattggagaatgctgaagagaaaacagaagtaggtaaaaattggaggacagtgaatacagacaattgtctcaacacatcaaaggaaggagacagaataatgatagtatggtcaaggaagacaaaagaggagtgcttttttgtgtgtatatgtgtatatgcttgtgtgtgagtgtgtgtgtgtttaataagaaaaatagtaagtcattattcttatcttcctactgggcaggcactacaaccataccataaagcaatctgtgtccaggacaggaagcatccaagtgaaaatccttcattggcttcagatggatggtggcccatattttacagacggatgctttaatgctgtgagcctgtgcagtgtcatttggaatattttgttacatctagaagtagaatttagcaccttgatgatattaaagttcccagtctcttcaagacctaagatgctattcgtctgacatgagaacttactccaataacagtaaaatccaccagcaagactaactgaataaatcaggaaaggcttgccagacaacgtaccctaaattctagataccagagtgttagacatgcaaaggaggcagaatcacagaccatgaataggcactgtcacccaatagcatagacttgaatcctgtctttaacattatatggctatgtgacctaaggcaagttcaaatctctctctgattcaattttctgagctataaaatagaaatacaacaacaagaagacacctacttgtatttgttgtgagcattaaaagagttaatacccattaagtgtttggaacaatatctggcacagaataaatgttcaaatagagtgaactacaatgatttaaatgttgcactttgagcaatgaatttggaaagggacctcagtttttattatcaaaaagcaaataggttttaatttctagatggaattcaaaggctgcttaaataaaaccagtagaacagtgtaatgtaaatagttagagccaaagtgatgaaatttgagaaactgcagcacatcctggctctgctctcaaaagttgaggaactttgaattaaaaactcaggtattctaagttttagttttctttaggataatatcagataataatatatactctatagtttctttgttgagaagactatatgaggaacctcatatgtggggatataattactacatattaaattatgctttcctgttttctaagttttatttttatttctatcttaagttttggggtacctgtgcaggatgtgcaggtttgttacataggtaaatgtgtgccatggtggtttgctgcacctatcaacctatcacctaggtattgagccctacatgcattagctatttttttctaaagctctctctccccacatccctcctgccagcagaacccagtgttgttcccctccctttgtccatgtattctcactgtttagctcctacttatgtgagaacatgtggtgtttgtttttctgttcctgggttagtttgctgaaaattgcttccagctccatacatgtcactgcaaaagacatgatctcattcttttttatagcggcatagtatttcatggtgtataactatcacattttctttatccagtctatcattggtgggcatttgggttgatttcatgtctttgctattgcgaatagtaccacagtgaacatacatgtgcatgtatctttgtaatagaatgatttatattcctttgggtatatacccactaatgggatcactcggtcaaatggtatttctcgttctaggtctttaaagaattgccacaccatcttccacaatggactaatttacattcccatcaacagcataaaagtgttcctatttctccccaacctcaccagcatctgttgtttcttgactttttaataatcaccattctgactggcatgagatgatatctcatggtggttttggtttatatttctctaatgatcagtgatgctgaggtttttgccatacgtttgttggccacataaatgtcttcttttgagaagtgtctgttcaagtcctttgcccacattttaatgtttttttcttgtaatttgtttaagttccttgtagatttttgatattagaactttgtcagatggatagattgcaaacattttagctcactctgtaggttgctgttcactgtgataatttcttttgctgtgcagaatctctttagtttaattggatcccatttgtcaatttttgcttttgttgcagttgcttttggtgattttgtcaggaaatctttgcccatacctatgtcctgaatggtattggctagattttcttctagggtttttatagttttgggttttacatttaaatctttaatccatatcaagttaatttttgtataaggtgtgaagaaggggtccagtttcaattttctgcatatggctatccagttcttccagcaccatttactaaatagggaatcctttccccattgcttgtttttgtcaggtttgttgaagatcagatggttgtagatgtgtggtcttagagttcactattctattccattggtgtatgtgtctctatttggaccaattccgtgctgttttggttattgtgccttgtagtataaagtctggtagcatgatgcctccagctttgttctttttgtttaggattgtcttggctatatgagctgttttttggttccatacgaattttatcttatttttatttatttatttatttttttgagatggagtctctctctgttacccatgctggaatacagtgttgtgatctcggctcactgcaggctccacctcccgggttcaagtgatcttcccattacaggtgtgtgccatcacgcctggctatttttgtgtgtgtatttttagtagagatggggttttaccatgttgttcaggctggtctcaaactcctgatctcaagtgatctgcctaccacagccccgcaaagtgttacacttataggcatgagccaccacacccggccccatacaaattttaaaatcgtttaattctatgaagaatattaatggtagtttaatgggaatagcattgaatctacaaattactttgggcagtatggccattttcgagattttaattcctcctgtccataagcatggaatgtttttacatttatttgtgtcctctctgatttccttgagcagtggtttgtagttctccttgaagaggtccttcacttcccttgttagctgtattccaaggtatttaattctttttgtatgctttcttgttttcaactgttttcaccttatcgttttccctccacctcctctcctacttaagcatatgtgaaggcttaatatgtgcactaccatcaaggtaggataaaacacaaagaaccaggagtcggatgtcaacttttagtttgttagggatactttggtaaatttgtaactgtttcttaatggttgttgttgtttgtttttaatttttaggagtctggtgcttgggaagaaaaactgtgattctttctgccctgcctcccaattttatttattttaattttaaaatttggttttaaatatgaagaattaatgcttagaaaacagagtttaaatagagtttaaacaacaaactagtaagtggggaacaaaatgcacaattatgtaaggatcaatttctgacctaaaggtgaacattttgagcagttagaaggaaataaagaataagaggaaaataagcaggtattaaaagctggtggtatctaaacagcagaccatcactgtttagacggtgttcccatctggacattttttaagttggtagaaaccaaatagaaatatcattaacgtttgacgtatcacaaagcagaattgcagaagatggccacttacagagaagcttcatgtgctctcttgtctaaatagcagaatgtcagtgcttggaagatctatgcaggtatgagggtatgtgaactttgcatacattcctgctcaaattctacatgctgcagaggataggcatgaggttgagcacagtgtccttgggatgcaagtgtagcatatgacataaactagaatgggcctcataatcatagcatcacagctttttacaaactgtaaagttcactcctaaaaacccgactttggagtaagaatcccatttacgctctttaatgggaataataaaagcacttagaggtttgtgtaaaaataatatgcactaatacattgaatgactttagcacaatgtcaggcacatatgaaatgtccaaaatgtaacagcacttactcttaagagagtgagaaaatattatcgttaaaattttctcaagtaaacaaaagcagagtagaccttcctagcattggttttgatcttctgtctgtgacaaattaaactgaattgcatttaaaagcagtttctgaaaatacactgtgaagggaataggttgaaagtgtgaattaataggtatggaagaattccacaacagacctctatgatttttcttttatcacctctatttccatctgtatgtgtttccatctgtacgagttttccagaaagttttggttgtttatcccaagtacatggctattattttgtgacagtataacactcaacattctaaatatttgacaatgttcgttctgttttccattcctctctttttttgtgatatatttggttgcatacatacttacctgcaaatttacttttttttatattttaaaatatgtgatcatttatctaaaataaattctacttatattttcattattaaggaagaagaatttcattgaagttatgaattatgttggtatcttaagtattatagaagctgtctgtgagcccatcccacttagtcatagagaaggtagttggtgcttatacttaaaggagagactttccttttaggaaaaatatttctagccatctagtgacatctacttggaccaaatcaaaatgctgcctttggaatagtgaatttaagtcatactagagaaagttgtcctcagtatgtttggcctacagtgaacagtgtgaatatccacaaacaaattgaagcttattacataataattatattctttatgcattcaatactactacggtgccatcatgcacatatcaggcactttgtcaggaattaaagatataaagaagaatacaattttgttcttgcccttaagatggagagacaaacaagtcaacatgttagaatgtcaatttctttcatctgttaatctcccagtataaaatgtacttatttatatttgcactggaaactgtacatttcagggaatttccttttaagggtatataagatatattgaggaagtttggtcatagaaacaggctcaggagataatggggaggtgtctctaatacctgagagtaagcaaaagttccctagagatgtctcctaatctgaaccttaagagtatagtaaacagagctagcctgacaaagaagagtagaaagaacgtgcccagtacataaggccataatgatcaaagacacagaatctaacaacaacgtaacaggtaattgagctggagaaaaacacaggtcaggactggggaggaaggaactcaagtcatagcaatcttgcttattatgtaaacaaactgcactctatcattatttttagttgattttgacaggttaaagttacacagaattctggtttataaaacagattgaaaaatagactttattttgttaaattggtgtgtgttataaggaggcaccatgttcatcacacaaacatgttatgtgtggagtgagagggtcaacttttcttatactaggtcacacgcttgaccatgtgggatagatttaaaggaaatatgaatgtgagcagagagaacactaggagcctctgattgttgtttaagcaagaagtgataaggacgtggagtacactgtatcctctacttctctcataatgaataactaagtcatatagatactatttttttccttcaacatctaaagtattcatttttttctggagaaggtccatctttaggcctctaatggtcaagactaaatataaatatctgaatcctcatatgatttgtgtaaaggctcctgctcaaggacaaactttgtttgttatccatgacaggagccattgaaaatcctgttaatttataaggtaaaataagataaattttaagcatcattgggaagagaaaataataaattttagaatcattatatttaatggctaaaactaggcttggtaacacatataatcaagtaataagcatgttgtaaccaatttttaattgtgttttaatgatcaataaagtttgcttttttccttgaaaaatctgtattatatacctgttttattacctgccttagaaaataatccaagttcacattgccaccccacaatttctttagctatgttcaagcatatctaaatccctgaagaaatcacaacacaggctcacactacagttccccctgcatcactacccttgtcttcacattctgcttgatataatccttaacaatttattatactcagttatattttgttgaattcagaagttggttctttaagtagttgattaacgaattcatcatacctgaagttccaatctcaaatcacattagtgattactggaatacttcatttcacataataaattcatggcatattcttgaaatttacacataaattgattttctgaatacactatattttcaatgaactctagagaaagttgtggcacatcctttggggaaaataaattatctcctcttaatttatataattcataaattattttaataaaatacctcccttttatttctataaagccacctatcgagaccatttggtccaggaaatgagatgtcaggtacccacagatttctatttacagtggtgagaagattgaaattcgcgtctgtttaaaataggttactagaaattccttacctaatctcatttttacaactggctcttttactttactctcaacaatagcctacacaatgattttatgaaactatgaaattaaaatagttcctaaatgttaagcagtagttctaatggaatataatttcatatcttggataatgttccttcttctgtcattttataagtgaattggaaagataaattaattggaatgtattcagagactgtgagaaggctgacaaggaaattatctcctacatggaataggcaatggaataaaacatatttagctcatggaagggaaggttcagaacagacataatagctctttataaatttctgaataattgttctctgggaaaaagtagtaagctcattgtaatccttcaggaactcagaccacaattaggaattagaaaaaagaaaaatgaaaacttcagaaaaattactagagttgctctaaatgggaataagctgcttcttgaagtactacacctgtagtcactggaagtgttcaaaagaaaagctaagtagccacctctccagcacctcttataagaaatgaatcttgaagcacccttcttagattccagttcaaagagtctgagtatctagtagattatagcaatgactataatacccatagctcctcctatcaaggcatggagttgatttcccattaagcactaattctgggcttggtcatatgacttggtctagccaatgatgtgttagtaagcagaggctcagaaaggacttgagtagtacccatggtactgtgttgctgcttttggagccttctactgagtgaataaggccatactaccctgttacatgatgaagtgactacacagaagagataaaccatcccagctatagacctccactactaccaacacaatggaccctcgtccagctgaactgacatctgaccaaaaggcatgattgagtcaagaatgtctccaacctcacagataattccagaccagttttccaatctacagggttgagggccaaatcgatggttattcctttaaggcaaaaagattcatagttgtttgttatgcagcagtaaaaaaatgacaaatatgtacaaagtggtacagaccaaaaaaaggtaattatcttcggagtgaaaaacgtcatggagtcctgtggttctcaggaatttcttgaaaggaaaaagtgcataaatgagtttgaaggatgggcagaatataaatagagggataattaggaactgcaaagtaggaaatattatgaacagtatgacccagttgttctttgattgcaagaatagaagacaactttggctaaagataaagaggaatttgtgtggagacagggaaaatagtttagaaaaccaaaggagagactaaacaaacagtcccttcaaagggcaatgcagtaatagggcaagtatgagactcttagtggcaagaagtaaacaccattctcttaagaacactactcctggtataaattacctttaatttgcctttcaaaatctgccctggtataattgctccatgtttaaactcctgggagaggagttctaacttgcccaagatgatcactcactcaacccttggccagagaaggaaaggcacctcagaactaggagaggcatgtgtaacagagaattggctctgaaggaaatttaaggaagtgttaccaaaggaaaggggaggggtgcctgaacagcaattcagatggggtagactacacatgatcaattacagattaaccacagttaaatcatataataatgaataacatgcccaacactgttgtagatttttgaagtattaactcaaccctttgaagaagagtactaatattgaccttattttacagatatggaaagggaggttaagtgacttacacaaacatacgtaacacacacatacacacacacacacacacacaccctacacagtgacaccacatgtaattgggaattagatgtctgtattaaaaactcactatcttcttcattaaaatataggagatgtactgcttacttattatcaaaaaagttcattttatgtttattcatatattagaatttctataaagcaggtgaattcgctaaggccatttcattgtacgtttcttatcaaatttgaaaaaagttacataattggaagcttagttgagcataatataccactctatatttatgcttgcaaatttagactatttcacagtggatataagtgatcagtcttgaatatggaggcaatataaggcaaagaatatgaagcctttaaaagggaaagtttacaatggcagtgataccaacacagcaagtgactgagtgaataattaggactagtcaatctgtatgctaaaaatgtaagaatgttatattaaataagatatttttattggattgtactccaaaatggacaaacatccaatagtagagctgatgcaaaaattagttttccaccaaccattaaacagatcaatgatctattaactaagtcttgctagcaatgaaatttcattataatctgtgacctgcattttggacatcctactgacaaagtttagctttgaatgaaatagttattttttttatataaccaacactgataagtttgttcctagttgacaagcatattatatcaaagtgattttgtcctttaaatcaaagactatttcagctttgtgtatgttcaatatccttacataatgaataattatattcagcttattttgtaatacttttgtagccaaaacttcacaagagactcagatgatttttagtaaatctccacacttaagataaaatattataaagccctttctgtcaaaacacattttcaaagttatttccatagcagtgcaaatcttttcattctctccctcctccacccacatgcaatgtcctcaacaaagtcagcaggagttcacacatacacatgcaaattgttagagaactacaggcaagatggggttggaatagtttatgaatagtagcattattctaattcttaaattaaaagattagagaaagtttataaaaatatggagaatgatttaatacaattgcaataatcactttcatatatataacattttcttcttacgacaaacttcttcaggatagggagaaatatcagaccttattaataaaggaaaaaaaacgtattattggaaaaatattcaaccagtcatacaaatgttaggaagactatccaatctgtgtgtattttctataatgctaatgaagcaacatatggaatttcctttccataactttgagctaaaatacctgtcctagtattaagacctactctaaggagcagtagaaaaacagaagttcaattagaactggggcttgagaaggcagagaaggttgagcaaaggtttgtttgttttttttgtttgtttgttttttgtttttgttatgttttttgttcgttttttgagatgaagtctttgctctgtggccaggctggagtgcagtggtgcgatctcagctcactgcaacctccaactccctgattcaagcgattctcctgcctcagcctcccaagtagctgggattacaggcacatgccaccacatgcaactattttttgtatttttagtagagatggggcttcaccatgttggccaggatggtctcgatctcctgacctcatgatctacctgcatcagcctcacaaagtgctggaattacagccatgagctaccatgcttggccacagcaaaagttttaaataaattttaccacatattagtgaaaaaagtagacttaaataaagtcaaggaaaagatgaagaaaggaggtaagctaagattaaaaataagagctgtgtgacatttggataaacatatgttaagttttctttgataaggttaataaaccactaagctaattacaaatactagagaaattgtacattttcaattttcccaccacaatatgtatctgtattatatattaataaaaataaattttattaggcaaaggacaccctgtttaataaatggtgctgggaaaactggctaatcacatatggcagaatgaaattggatctctatctctcaccatgtaaaaaatcaactgtagatgtatcaaaggctttaagaccaaaaccataaaaattctcgaagataacttaggaaaacctcttttggcattgacctagacaaagaattcatgactaagacccccaaagcaaatgcaacaaaaacaaaaataaatgagacctaattaagctaaaaatcttctgtacaacaaaagaaacagtcatcaaggtaaacaggcaaaccacagaatgggagaaaatatttaccaagtatgcatctgacaatgcactaatgcaaggaactcaaacaaatgagcaagaataaaagaaataactccatcaaaaagtgagcaaataacatgaacagacatttcttgaaagcagaagatatatacatggtcaataatgttcaatatcactaatcatcagggaaacacaaattaaaacctcaatgagataccaccttactcctgcaataatggccattattaaaaagtcaaaaaacaacagatagtggcatggatgtggtaaaaagggaatgcttatacactgctggtgggaatgtaaattagtacaacctctatggaaaacagtatggatatttcttaaagaactaaaagtagatctacaatttgatccagaaatcccactattatttatccagaggaaaaaaaaagtcattatatcaaaaacacacctgcacatgtatgtttattgcagcccaattcacaattgcaaagacacggaaccaacttaggtgcccactgacaaatgagtggataaataaaatgtggtatatatacaccatggaatactacttggtcattaaaaagaacaaaataatgtcttttcagcaacttggatggagctggaggccattattctaagtccatgtgctgcacaccagtcagagcgattacataaaatgtaagttaacattatgctgcttctcagctcaaaaccctccaagaactccccttttctcattatataaagtcaacgtccttacatgacctggcctaatccaatctttctggcctcagctcacacaattttaccccttggtcactcaggcagctgcactggcctcttcactgttccaagctatttgctttgcttagacttctttcctgcagatatttccatgctttaattctttacctacttaaagtctttctcaaacgttaccttaaataaacccacctttattccataatacaacacatttttgcttgcttactatgctatcatttattgcctatttttccttactagaatgtaaggtaaaagacaacagaaaatgtttttatgtgtatcttttattgttgctgtatccccaaattcaacaaatagtgcctttcgtataatagatacctaaaatatattttagtaaatgaagaaaatataaagaaaatatacaaaaaataacacttatgaacactttgggaagatttcattttgagagagtagtgcaggtgtatgcaatgcactacaatgtttatatcacttaaaatatttgtgacacattccatttgatcttcagataaaataataagttataagtggtttagaggtagtcatctgtctaaaaaaaatctatacaatattatatcttgggatcactcatttttctgttgtcctctaaggaagaactttagataagaactgaatataggaatcttccccagtcaaacacgagagagtttagttttcaggcagtttgcatgaagtttagttttcatgagttgaagttgcatgagttgaagttgcatgagtttagttttcaggaagtatacatacagcatttgaaaagttttctatttaaatagatcaaatgctcacagctactcctattctgtctatgccattcaagttatctgtgtacatcaatgtttcttttttgaaacaaacagttttggagctactataagtataataagtatgtattttatattggatgttgcgtgcttgtggtgaaaaaataagtctttaacattggacaaagctgagattaaattcagttcttctctttacaagttgtatagccttgagcatgttgcttaacttctttgaatctttagttgactaaatgtgatttgggggtggtgctatcacccaccactttattgaaaagattaaataagataatgcttataatatacagtggagttagacagtgactggaacaagaaacaatccataatattactgatcataactaaaatttattgagcatttatatttcaaacagtctcataagtgccttatgataatacatatatataagatgtaaaaggtacatattatcttatatacttatataatacttgtaaggtaatactttcactcaagcatctctgtaaacagaggagggagaattaatccacagtttgtacagggcttacaactccacacagaatttgctgattctctttcctatttccctcagattcaagaatgaactgcactgtcttgaattccagagcaattaaataatatttctctaccttttaggtttttttgagatagagtctcactctgtcgcccaggctggagtggagtgataagatcttggttcactgcaaccttcacctcccaggttcaagcaattctcctgcctcagcctcccgggtagctgggactacaggtgcacgatgccatgcccagctaattttttttttttttttgcattttttagtagagacggagtgtcaccatgttgcccaggctggccttgaactcctgaattcaagtaatccatcctcctcagcctcccaaagtgctgggatgacaggcatgagcacccgcgccctgcctatttttatttatgtattttttaagatgctaagagagttcgttcgttcttcatttttcctttgttgtctttgcaaagacattgtcatttagctcccttactcgaggagagggagcttctggtttccgaattcagtgcacacgaactccaaaatcaagaaacaaaatcttccccaaactgtttggggtggctgtggttacgggcagcaatcacaggtgtaggctggtatgaaatccaagtgagggaggataaagacaggcctgaagtatacttcaggatgtaaagcaaaacaatagacagaacaaagggcctctgaaatgtagaggcctctcctgcttgagtgcccaaggaaaacactgaataataatttggggaaatgaatccacgcataacagtaaaacttgaaaacactgcacaagaaaactgctccagcactgttgaatggaaacacaaaagggacaagaaagctgagaggctgacctgtatatattataagcatgggccttttcaaagaggtatgtaaatgctttgaagctacacacagcaaaggaagaataaatttctccatggacagtcagaagctggctaaaactaaagtaaagggaaaaataaacagaaagaaagtgaggtgacagagcttcaatcccgatcagaagagtgacactaattacaaaatatatgaactctgactaggtatcagccactattttactatatacctatacctatatttgtgtgtatatctatatgcattatgtcatttgatcctcagacaactctgtaagagtgcaattactacctactttacagggattctgaaattgaagcttaaaattattagtatgaggcctaaggttactcagctatttaatgtaaaaacagcatttaaactcaaacatacattatgtctaagttccttctcaattaccatgctgtgtttttaagaaagtgtctttccagttcctgttggaattattgccagagccctactagcagcagccattcttaccagcctgaaagagaatattccattctgctgttttcagcaatttgttgttcatgaccacgtaatgtttacacatggccaattaattacatatcatatctttctatgccaaaaatgtgaatccatttaaaaaaagagttgaactttattgttattttatttttgtgtaccccccccctccactaatctctttctctaaagcaatcaggaaaatattacattagttatcttcagattatacggcaatatcaaagctatcaggagaatttaactacagaggatagacatataaacagtttctgttacaaggtttcctctcttgttggccaaatctcttcctggaatatactgcaatatcacatttggtttggcatttaaatttgtagggagaatgcaaggaatatgtgttggttatatgtatggtgaacataaaatgtataattctacctgaaagttttagagagtaaactgctggacagaacatctactcaatacatgtatattgagactattcttggaaaactgagaccatttgcctggttatgtgttgcttcatctcttaggaagtgtgaagagttttagacacattttaacatttttgtacttttcctggcaagtcacggatgtatctttccaatgtcagctacttatttatagcccagcaatgcactagatccctgaaaatgacagactggtttgttcaaaatgaaaggaaagttgagtgctgggtggttgtgtcctatttgataggaaattaaaacatatctttgcagataactcaagcctttccttctctgctaagtgaaaacaatcattaaagttctctcctctacttataaaatggtctgagctttccagtgtgtaccaggttcacaaaactcaaagacataattaccttcccctctccctccaattcacctacagatgtgagctttatgctctttctctcttaaactagggacttttacgtatttcatatattgttagccactcaaaagaaagccttcattcatgtgcctccattattactttagtaatatgtgtatttttgaaaatttagatttcttggtattacctaccatacccaagttttatcaaaaatggagaaaagcagtcaagtcttatgtttatgtaagtcatgtgaacactttaaaggcaagggagtttattttgtgaataacttatgtctcctcaatatgcacgtgtcagtgaatattgttgaatggataaattaattatttgttgaatattaatggttgaaattgagagggtcttgaattatctaataaccatcatttttagcaaaggtatctgaggcaaattcacactcataatgctctaatccccattccagtatctttcaaattcttttttactggggaaaaaaactatgtatttgaaatacctaaattaatgtgttgcttaaaaactcaaccatattgatccatgacatcttctgagacctagatgggtggatcaatttattttatggcaacccatgaacagctgtccacaataatttctaatgagttcatttgattctgacacacaatgtcttgacctcatgatctgggcccatctgtgagaatggcaggaagccctcaagcaaggtggcaggccacaggccatctgcagcctggcacaggtaggagggtgggtggagtggagctggcagaacgatgttgccaccaagccaagtcctttcatagcggcagcttggccacctctcaaatttgcctttttaatacatttattttttatttttattttttacttttattcgtgaccagtaacaaccagggaaaaataaaagagtgtaaaataaaatctagtgaaggctgtgaaataaaaggaactaaaactcaccaaaatgtagactgggttgcgattaagaactaaagaaaaaaaaaggcactaaaaataattatcatggccatagagtgctggagctacaggataacttagagaaaaagttctacttctgtattagacaaaactgaggtccacagagaaatgctgtatttatgtacagcaataaatccacaaaactccatatctttatattactacaaagtgagtcccaagaaggtaaggattatctattttgttcaaggaagtatctctgaacttacaataatgccttaaacgtagtagccatttattaaatgcgtgtgaataaatctcaaaggtttttgttgttgaagtcagtgtaacacatttttaagatattaaagtcagagtcaaacagatatggtatgaatgctgattattacctactagacatgtaattcagggctagcaagtgttttgattggatggagaaggaacaaagccttggatagagttaatccacatattatatcctgcaaggaagaaaggaagagagaaagggagggagggagagaggaagtgaggggagagggaaagaggagggaggaaggaagaaggatgagagaagaaagagggtagaaaggtgaaagtaaaaaggggaaaacaaggaaaagggaaagaagaagaaacgaaagaatatgaaagaaaaataagaaggaaggagaggtcaacaaccctataaaaagatgttcaacactagtgccattagaaaaatgcaaattataaccacaataagatggcactttatacgcattaggatggctattatttaaaaaatcacacaccaaaaccagaaaatatgaagtgtttgtgaggctgtaaagaaattagaagctttgtgcaccacaagaggaaatgtgaaatgttgcagccactgtggaaaacactttggtggttcctcaaaaagttaaacatgggacttccatatgatccagcaatttcatttctaggtgcatacgaaaaggaattgacagatacttgtacacctgtgtcccagtgttcttcacattattcacaatcgctaacaggtagaaataacccaagtgatcatcagcagaagcatggtaagcaaaatatgacacacggatacaacggaatattagtcaatcttaaaaggaataaaattttgataaattctacaacatgattgaaccttgaaaacagtatgctaagtgaaataagtcagacacagatgaacatatcatgtggttccacttatattaagtacctaaagcattcaaattcaaagagaaagaaggtaaaatagaggttactagaggcaagagggtcttccagaggaagggggaaatggtgagttattgcttaatgggtaaagagtttctgcttgagatgatgaaaagctttggagatgaatagtaacaatggttgtacaacaccattaatgtacttaaagccattgaattatccaattaaatatggttaaaatggctagttttatgttacgtgtattttatcacaataaatacattaaaaagaaaagagagctaatatacaactaatgaacaattaggaggaaaaaaaattaatggacagtgctttgttgcctaaccagtttttattccctcacttttcttatatctcttacatttaccactggatgatactaaaaggaaatgaggataatttcatccaaattgccagaatgatagtttaagagattttaaagcaggtacaagtcaattagatcattgaattgctctggccatataattttctaataatgttaaaattgagaatttgttgttgatacttattcaaagcaaatttctactgttctccagttgtaagtgagaagaacatacataaatctaatggcaggcactttacaaccacaaggaaggcatccttagaatgactcagccacatggagacgggtatatcttaggaaaacaaatctcaaattaaaatggagctggcatcttgatagaaagctacctggatcctacactgcctctagtcttgtttaaacaataatgacatggttttcaattatttttcaggcaaaataattatattagaaaattagaaataccgaataagtctttccttagactagctctcctcattcgtgcatttttataaaaatgtttgaaaaaataatgagattt

SEQ ID NO: 21 - DNA, 35042 bp, Homo sapiens
aaactcttttggacagtttcacttgctttagatcattatgtaatttttattctgcaggctatagaaatacaagtttttttgacgtggcatttgatctttaattatataaatttatatttttcgaggaagaaattctgatggcataaatcaggattaaaaaaacattctctttaagactcattactaacaatagtcaccagaggcaaattgcttttactttctcaaggtcttaatttaattgtgctttcaacttggcagtgttgtatattttataagctccactaaagaacacatctacacattatgacatagcacgttcttggaaacttgacagaactgttgacaagtacagatttgtttttggttactgtgagtattttttgtggtaattgaactgttgttagttcttggtagctttatgtgcttgtcagtctgttttcttcataagtgatgattaatttaaatctgtgtgatgtgttccagttcacttacttgatggaaattggagaagtgcatagctttctgatattcttaattactggttcccattaagtgactggagaagcaaatatttatgtctcaggtattgtagtattgaatttccagtcattctttcttcctggctataacttagtcactgaagaaataactatcctttattcaaacaacttccttggtacaatccagcaatatgttttttttcttgcaatattaaaaacctccgatgtaagtggaaaaagagttatttccaagcagaatgagaataatcatagcgctgggcacagtggctcacacctgtaatcccagcactctgggaggccaaggtaggtggatcacctgaggtcaggagttcgagaccagcctggccaatatgatgaaaccccatctctagtaaaaatacaaaaaattagctgggtgtggtggtgggcgcgtgtaatcttagctacttgggagactgaggcaggggaatcgcttgaacctgggaggtggaggtctcagtgagctgagatcacaccgctgcattccatccagcctgggcaacaagagggaaactccacctcaaaaaaaaaaaaaaagaataatgataaatatattatttgtggataagagttttctgcattttaaaaaattattaaaaaggatatacagttgtcccttggtgtccatggggaattagttctaggatctcgaaaatcctcagatgctcaagtctctgatataaaatagtgtggtatttgcatataaccaaaatacactctcccatatactttaaataatctctagattacttataatacgtaaaacaacaaatgctacataagtacttgttatactgtattgtttagggaataatgataaaaaaaagtttggtacatgtttattatagacacagatttttattttgaatatttggccctcagatggttgaattcctagatgtggaattcacagatgcagagggccaactgtatatgacttactagaaataccatgataaagaatatttcctatgattaattttttttctttcttggaaaaattggattacttaaactccaggttgtcttgtatttggatcaataagatattctagaagttatttccttgacaatattttatctagtttgttaaaaaagagttgcaagttattaggctgcattaatttatctgttatatttggtcatagaattcatgtccccagtatttgttttttttgtttgtctgtttctgacagggtccctgttgcccaggcttcagtacagtggtgcgatcactgctcactgtggccccctgtctcctgggctcaagcaatccttccacctcagcctccggagtagctgggactacaagcatgtgccgccatgcccggctaatttttgcattttttgtaaagacagagttttgctatattgttgttagggatagcgctcaaaatcctaaggaaattgaacactcgaacaaaggatttttagcaaaacaattttacttctgcgcagaggggtgcctccttggctggttgccgtgagagcacacctgaataaaggggcgtgagagcctttattcctgatgcaagtcctgcccctgcaccctttcctcatttgctacggttgggttgtacaatctaaactaatcccggttggctaaacgtttgattttttaagataagatgggcacgtaaaagaaagtggagaggaatgggaagggtgtctgtaatgagctagaaagttagtcctctttccaaataaggaaaggaatgtgagctggtactgataatgcctggtactgtggcgtgcctgggcatctaacaaaggcaaaaaggaaaaaagagaaaaaggagaaaaaaggtgtgtgtgtggggtactatgaattaaagaataaaagattaatcagattatttgaagagaagcctcatgatatcccacagttgtccaggctagtcttgaactcctgggctcaagtgatccttttgccttggcctcccaaagtgctgggattacaggcatgtgtcactgtgctcagctccctgcatttattcttgatcttaagaatcaaggtttttcaaaataagctaaatttattatattagattagcaagttttctttacttttttgacatggagtaaaattggagagagaggccaggagcggtggctcatgcctgtaatcccagcactttggttggccaagcagggaggattgcttgagtccaggagttcgagaccagccttggcaatatagtgagacttcatctctacagaaaattttaaaaatttagccaagtgtggtggcacatgtctttagttccagctgctcaggaggctaaggtaagaagattgcttgagcccgggaggcagaggtggtgaacagagattgtgccactgcacgccagcctgggtgacagaacaagactctgtttaaaaaaacaaacaaaaaaactggtgagataaataattctaaggttataataactgtagacatagtttaaacaaatctcattatctaagtagaaaattctcattaaagaaaatttggggaatgatgaaaaatgaagaaaataaaaatgatctctaattatactgctgctattatttttctttccctttttgtgtggaggtgggaaacaagactcagatcacttttgcttgttttaatatattatagacctgtacaaaataatttcaaataatttatgtagatactttgcctccaaggaggtgtcgcataactctctattcttatgggtgagttgtgtgtaatgacttccttctaagaagtagggtatggaaaggggaaaaaagcaattttacagcagagaaacctgacaggcactacctcagccaggtgatcaagattaacattaacaaccacaagccatgttgatagcacatacccttgatatggtgggatgagaatggcactttatctctgcgttctttctccccaaaacacataacctttgtctaaccaggaggcaaacatcaggcaaatctcaactgagggaccttctacaaaatacctggtcagcactcctcaaaactgtcatgaattaggtgcttatcaatctcatgcataatgtcacatatttgttatgtatgtgtttttagtatttttcatcttataaaatttctgttttgtttgtttgttttttagtagagactgggtttcagcaagttggccaggctggtcccaaactcctaacctcaagtgatccgcccgcttcggccacccaaagtgttgggattacaggtgtgagcctccgcacctggcccttataaaatttcatataagtagtatacttatatgaaatactactttatatatttgtctgcaatttgctttttttgttattattgttcaattttggtgtttgtgctttatccatgctgatagatacagttctgatttgtttaccatattctagtccattgtttggctgtcactattcacttttttatttcagacatttgggttaattctaatttgttgctgttatcaacattgctgcaataaccatttttgtacaggaactcctagtccctaggtacaagggttcctgtaaggtttttacgttgcagaggagttgctttggtctaaaatacataaatcttaaatttttatagataatgccaaaatttcatagataatctccaaaatgttacatttccaacaacagtatttgagagatgctggtgaggatgtggagaaactgtattcactatcgtggggcattttatttttgccagtataatggaagggaaatggtattaattgtcattgtcttgattattaggttgaactaataaatattttcgcttatttatcatttgggtttcctcctctgtgaattgtctgttcatatttttggtcaggtttttatgttgtttttcagtttgaaggagtcgttatatatttttcatactgctattttgttagtagtatgctttgcatgtcagtagtatgtcagtatgtaatagtacgtagtatgtcagtagtattttgcttttcaaaatctcagtctttgatctgaatttaaagaatagtatttttttgtgtaagaggttatttttatcttttgctatttaaaaaatcaagtgccatttgtatatgatagtacttaagtcttcagtttgaattctaaaaatgtgtatacctatataatccacacacctgtcatcccatcatcctatcaacacccctgaaaattcccttgtgcctcttcctagtcaaccccaccactgcctcaagtaagtactcttctgatttctgttctcatagattagtttcacttgctctagaacatcatataatggggctgggcgcgatggctcacgccagtaatcccagcacttgggaggctgaggtgggcagatcacttgaggtcaggagtttgagaccagcctggcaaacatggtgaaaccctgtctctactaaaaatgcaaaaattaacctggtgtggtggcatgcctttgtaatcccagctactcaggagtccaaggcacgagaatcgcttgaacctgggagacagaggttgcactgagctgctgcactccagcctgggcaacagagtgagactgtctaagaaaaaagaagtttatatgatggaattatacagtaaataatctgtatctattttcatttagcattgtatctatgaaattcatgcatgttttatctattaatattttttttggccgggctcggtggctcacgcctgtaatcccagcacttttggaggctgaggcaggtggatcactaggtcaggagttcaagaccagcctaggcaaagatggtgaaaccccatctctactaaaaatacaaaaattagctgggcatggtggcaggcgcctgtaatcccagctactcaggaggctgaggcagagaattgcttgaacctgggaggcagaggttgcagcaagctgagatcgtgccactgcactccagcctgggcgacagagcgagactccatctcaaaaaaaaaaaaaaaaaaaagtttgttttaaataggatattttttagagcaattttaggtttatagaaaaaactgaagggaaaatacagagagctcccataaaccctctcaccttcctcccccttgcagtttcccctattaatatcttgcattgatgtggtagattaattgcaattgatgacccaatattgatgttattattaattaaagtccattgtttacattagcgttcactctgcttcagctatttatctttctctccctcctccttcctgaacccctggcaatcactgatctctttaccgtcttcacagttttaccttttttagattgtcatctaggtggaatcatacaatatatagcctttttagaatggcttctttcactgaattatatgtatttaagattctttcctggcctttcatggctcgatagctcatttctttcttttttttttttttttttttttgtattttaattatttgactctaattttcctctttgggaactcttagataagctcatttctttttagtactaaataatatttctttgtctagatatactccggttttatttatctgttcacctactgaaggacattttggttgcttctaacttttggcaattatgaataaaactgctataaaaaaccacatacgtgtttttgtgtggatgtaatttttcaattcatttggggaggtatcaaggagagtgattgctggattttatgcatatggcaagagtatgtttagtttcttaagaaactgccaaagttttatccaaagtggctattccattttccactcccaccagcagtggatgagagttccagttgttccacatttttgtcaacatttggtgttgctttttctgcatctattgatagaattatatgatttttttatatgatctttctgtaaatttctttataagcactgcttttgatgcattttacaatttaggttgtattttcattaaaatatttcattaaaacatttaaattatttcactaaaatatttaaaaatttctctagacttcttctttgacctttatattattttaaaatgtgttgtttaatctccaagtattgtggggtttttcagccatctttctgtttttgatttctagtttaatttcattgaggtctaagagcatacttcgtataatttctattcttttacaattgttaagttgtgttttatggcccagaatgtggtctgtcttggtcgttgttccatgtgagtttgagaagaatgcatcttctgctactgttggatgaagtattttgtaaatatgaattagatccaggtgattagtagtggtgttcatttcagctgtgttctgcctactggatctgtcagttactgatagaagggtattgaattctccaactataaaagtggatttgtcaattttactttgcagttctatcggtttttgcgtctcatatgttttataccagttaaaatgcatactagggtagctttaaaaaaaaggaaaatcagtcagttaatagagtaactaaaaaaaaaaaaagaaaaaaatacatactgtcagagtgaatcaaaagacaaatacccaactaactatatgttgtctataaaaaacccattttaaatacaaagaacataaatataaaaaagataaagatacaccatgctgacactaaccaagtgaaagtgggagtagctacattaatttcagactgaacagacttcagagcaagaaaagttattagggatcaaagaagagtattacacaatgataaagaggtcagttctccaaaaaaacatgtctttaatgtgtatattcttaacaataagcatcaaaatatctgaggaaaaaactgatagaactgcaaggagaaatagatgaatccactatttatagttgaagtcttcagcactcctatcagtaatggacaaatgtagcaggcaaaaaatcaccaaggatatagctgaagtgaacaggatcattaatcaactaaatctaagtaacatttatgtactactacagtgggagaaaaagggagagatgaagaggtggaacacagaatttttagtagtaaaccataatataaactatagactttggtagataatgatatgtcattattggttcatgcattgtaacaaatgtaccacagtgatgtgggatttttttttttttttgagacggagtctcactctgttgtccaggctggggtacagtggtgtggtctcggctcactggaacctctgcctcctaggttgaagcaattcttctgcctcagcctccggagtagctgggattacaggtgcgtaccaccaccagctaattttttgtatttgtagagatggggtttcaccatgttggccaggctggtctcgaactcctgacctcgtgatctgcccacctcggcctcccaaagtgctgggattacaggcatgagccaccatgcctggccatgatgtgggatattaatggtggggtaagctttgtttgtgtgggagggtcttctggaactctgtagttttaagctcaattttgttatgaatctaaaactgctgtaaaaaataaagtttgcttttttttttttttttttttttgagacagtttcactcttgttgcccaggctggagtgcagtggcacgatctcggctcactgcaacctccgcctcctgggttcaagcaattctcctgcctcagcctcctgagtagctgggattacaggcatgtgccacagcacctggctaattttgtatttttagcatagatggggtttcttcatgttggttaggctggtctcgaactcccaacctcaggtgatgtgcccgcctcggcctcccaaagtgctgggattacaggcatgagctgccgcgcctggccagtctgctaatttttaaaaatgcatttggaacccaattgtttctaaaggtattctatggtttcttttttgtagaagtatttccattagatctgtattattgatgtattactactaggtaaaaatatagaattgttttgctctgatattaaagttgacattgggcccagtgtggtggctcatgcctgtaatcccagcactttgggaggccgagacaggccgatcacttgaggcccacagtttgagaccagcctggcccatgtggtgaaaccccatctctactaaaaatacaaaaattagcccagggggtggtggtgtgtgcctgtaatcccggctactaaggaggctgaggctcaagagttgcttgaacctgggaggcagaggttgcagtgagccgagatagtgctgctgcactccagtctgggcaacacagggagattctgtctgaaaaaaaaaaaaaagttgacattgagccaggcatggtggatcattccatatagtcccagagctttgagaggctgacgcaggaggatcacttgaggccaggagtttgagaccagcctgtgaaacatagtgaaaccccacctctaaaaaaataaagttgacattatttgaaagtatatttattgctagatgccatttatccacgtttgtttgttgtaatcaccaagccttgttttgaaatactactctaataaactaaaagcttagtggaaaaagctatgttttacctaccaaagagtatcaggaactgactttctgtggtttatttttagtgccaactttaaatactcttcaagcagcaagaataaattaatggttgtacaaatgtgaaattttaggggacttatttgggactaaaagacaggctttggggttgattaatatcaaggttttttccttcaaatattgagctcccaatttcagttacttaattagcaatttactaaaaaatggtatcattatcttgaggttcattctatttatttattttaaaataacagtcattttgctcttgaatctgaactgtaggcagtgctaagaggaaaagttcctctccttaaggtgtttgcttgactaggggctgaaggatctacttctaacatgtctcattcatctgactggcagtttaatgcttgctattgactgggagctcagccaagactgaggggtgaaggacagagttcttttgacatggttcttcataagctgtttttagcacagtgcctaggttctaagagagacaaaggggaagttgtcagtttcctaagacttgagccagaaaattggcatagcatcacttctgctataattttttaaaatgtggatggatattttgatataggcattcaatgtctaataatcatatcaggggaaatgggatatccatcacctcaagtatttatcctttgtgttagaaacaatcaattacactcttttagttactgtaaaatatacaattaaattattactgactatagccaccctgtcatgctatcaagtactacgtcttatttattctttctatatttttgtacccattagtgatccccacttccactgcccccacctcccactatccttcccagcctctggtaaccatctgtctaccctctttctccctgagttcaattgttttaatttctagctcccacaagtaagtgagaataggccagaatgtaatcccagcactttgggaggctgaggcgggtggatcacgaggtcaggggttcgagatcagcctgtccaacatggtgaaaccccgtctctactaaaaatacaaaaattagccaggcatggtggcaggtacctgtaaccccagctactcaggaggctgaggcaggagaatcacttgaacctgggaggcagagattgcagtgagccgagatcacgccactgcactctagcctgggcaacagagcaagactccatctcaaaaaaacaaactaaaaatagagctagcatataattcagcaatcccactgctaggtatattcccaaaagaaacaaaatcaggatatcgaagagatatctgcactcccatgtgagccaccgcgcccggcctatttttagttttttgaggaactccaaactgttttccatagtggttgtactaatttaccttcccaccaacagtgtacaagggttcccttttctctgtatcctcaccagaatttgttattgcctgtcttttggatataagtcatttttttttttttattatactctaagttttagggtacatgtgcacattgtgcaggttagttacatatgtatacatgtgccatgctggtgcgctgcacccactaatgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggatatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatactcatttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatgatatctcatagtggttttgatttgcatttctctgatggccagtgatgatgagcatttcttcatgtgttttttagctgcataaatgtcttcttttgagaagtgtctgttcatgtccttcgcccactttttgatggggttgtttgtttttttgttgtaaatttgtttgagttcattgtagattctggatattagccctttgtcagatgagtaggttgcgaaaattttctcccatgttgtaggttgcctgttcactctgatggtagtttcttttgctgtgcagaagctctttagtttaattagatcccatttgtcaattttgtcttctgttgccattgcttttggtgttttggacatgaagtccttgcccacgcctatggatataagtcattttaactggggtaggatgatgtctcactatagttttgatttgcatttctttgatgatcaatgatgttgagcatcttttcatgtatgtttgccttttttatttctttttttgagaaatgtctgttcagctttttttgcccattttaaaattgggttattagatttgtcctgtagagttgtttgagccccttttatcctggttattaatctcttgtcagatggatagtttacaaatattttctcccattctgtggattgtctcttccctttgttgatggcttcctttgctgtgcagaagccttttaacttaatgtgatcccatttgtccacttttgctttggttacctgtacttgtggggtatttactcaaggaatctttgcccagtccaatggcctgaagagtttccccaatgttttcttgtagtttcatagtttgaggtcctagatttaagtctctcatccattttgatttgatttttgtacatggcgagagataggggtctagtttcagatcttctgcatgttgatatccagtttgcctagcaccacttattgaagagactgtcttttctctgttttggcacttttgtcgaaaatgagttcactgtacatggatggatttgtttctgggttctctattctgttccactggtctgtgtgtctgtttttatgccagtaccatgttgttttggttactgtattagtccattttcacactgctgataaagacatacccgagactggaaagagaaagaggttttaatgaacttacagttccacgtggctggggaggcctcacagtcatggcggaaggtgaaaggcacatctcacatgaaggtagacaagagaagaatgagagcttgtgcagggaaactcctttataaaaccatcagatcttatgagatgtattcactattacgagaacagcatgggaaagacttgcccccatgattcaattacctgccactgggtccctcccacaacccatgggaattcaagatgagatttggatggggacacagccaaaccatatcagttactatagctctgtagtataatttgaagtcaggtaatgtgattccaccagttttgttctttttgctcaggatagctttggcgattctgggtcttttatggttcattatacattttaggattgtttttctgtttctgtgaagaatgtcattggtattttgatagggattgcattgaatctgtagattgctttgcatagtatagacatttcaacaatattgattcttccaatccatgaacatggaatatcttttcattttttttggtgttaccttcaatttctttcactattgttttaaaatagttttcattatagagcgctttcacttctttggttaagataattcctaggtatttaattttatttgtagctgttgtaaatgggattactttcttgatttctttttcagattgttcacccttggcatatagaaatactgctgattttcgtatgttaattttgtatcatgcaactttactgaatgtatcagttgtaatggtttttttggtagagtaggtttttccaaatacaagattatatcatctgcaaaaaagaacagtttgacttcttcctttccaatttggatgccctttatttctctcttgtttgattgctttagctaagactttcagtattatgttgaataattgtggtgtaagtgggcatacttgtggtgttccagatattagaggaaagtcttttagttttcctctattcagtacgatactagctatggatctgtcatatatggcttttattatagtgaggtatgttctttctatcctgtttgtttgtgtgttttttcagttagcactagccatctcatccccggttttttttgacagttttcatcatgaagggatgttgaattttatcaaatgtcttttcaccatcaattgaaatgatcgtatggtttttatctgttgatgtgatgtttcacattgattgatttgtgtattttgaaccatcctagcattcctgggataaatcctacttggtcatgatgaatgatcttaacatattattgaattcggtttactggtattttgttgaggatttttgcattaatgttcatcagagatattggcatgtaggtttcctttttaaaaatttttaatgtatctttggttttggtgtcagggcaatactggccttgtagaataaatttggaagtattttcacctcctcaattttttggaatagtttgagtaggattggtattaattcttctttaaatgtttgataaaagtcagcagcaaagccctgaggtcctgggctcttctttgatgggagactttttatcatggcattttttttttttttttttgagatggagtctccctctgtcgcccaggttggagtgcagtggcgcaatcttggcttactgcaacctccgcatcctgggttcaagtgattctcctgcctcagcctcctgagtagttaggactacaggcacgtgccaccacgcctggctaatttttttgtattattagtagagatggggtttaccgtgttagccaggatggtgtcaatctccttgacctcgtgatccgaccgcctcggcctcccaaagtgctaggattacaagcatgagccactgctcccggcctataatggcttttaatgcatgttcatcttgttacttgttattggtctgttcaggttttggatttcttcattgttcaatcttggttggttgtatgtgtctaggaatttatccatttcttctagattgtccagtttgttggcatatagttgttcatggtagcctctaatccttcagtttctgcggtatcagttgtaatgttttctttttttatctctaattttatttatttgaatcttgtattttcttagtttggctaaaggcttgtcaattttgtttatcttttcaaaaaaccaactgcattttgttgatctttggtatagttttctacatttcaacttcattatttttgctctgatctttattatttctttgcttctactgactttgggtttggtttgctcttgtttttctaattctttaagatgcatcattatgttgtttatttgaagtttttcctctttttgacatggggacttatagctataaacttcttccttagtactgctttcactgtagccagtaggttttggtttgttgttgttgctgttgtttgagacagagtctcgctctgtcacccaggctggagtacagcggcatgatctcggctcaactgcaacctctgcctcccaggttcaagcgattctcccacctcagcctcctgagtggctgggattacaggcgtgtgccaccacacccagctaattttttgtgtttttagtagagatggggtttctcagtgttggccaggttggtctcgaactcctgacctcaggtgatccacctgccttggcatcccaaagtgttgggattacaggcatgagccaccgcgctcaacctgttgtttttccattattgtttcaataaattttttaatttccttcttaatctctttattgaccattcagtaatggtcattacagtaccgtattggtcattcagcagcatattgtttaatttccatatgtttgcatagtttccaaaattcttcttgttgccgatttctagttgtattccattgtgtttaaagaagatacttaatattatttcaattttttgaatattttttagacttggcttgtagcctaacatatgatctgtcctggagactgattcatgtgctaaggaaaagagtatgtattctgtagccattggaggaaatgttctgtaaagtctattaggtccatttggtctatagtgcagatgaagttaaatgtttctttgttgaattttgtctagatgatctgtctaatactgaaaatgggatgttgaagtctccagctattattgtattggggtctgtctctttagctctaataatatttgctttatatatctgggtgctctagtgtcagtgcatatatatttaaaattgttttattgttttgctgaattggctcttttatcatataatgacttttttttttggtctcttttgtagtttttatcttgaaatccattttatctgatataagtatagctactcctgctccttttggtttctatttgcctggaatatcttttcctattcctttatttttagtctatgtgtgtctttttttttttttttttaattttttttgagacggagtctcgctctgtcgcccaggctggagtgcggtggcacgatctcggctcactgcaagctccgcctcccaggttaatgccattctcctgcctcagcctcccgagtagctgggactacaggcgcccaccaccacgcctggctaattttttgtatttttagtagagacggggtttcaccgtgttagccaggatggtctcgatctcctgacctggtgatccgcccgccttggcctcccaaagtgctgggattacaggcatgagccaccgcacccggccctatgtgtgtctttataggtgaagtgtgtttcttttaggctacagatcattggatcttgtttttttatccattcagccactctgtgtcttttgattggagagtttggttcatttacattcaatgttattattgataagtaaggacttactcctgccactttgttatttgttttctggttgttttgtggtcttctctcccttcttttcttcctccttgtcttctttttagtgcatgtgattttatttggtggtatgttttaatatctttttattttttctgtatcctttatatcacagtttttagatttgaggttaccatgagcttgcaaataatatatcccattattttaaactgatgacaacttaacattggtagcatacataaacaaacaagcaaaaagaaaactagtaaaaactctaactttgtctccctgctttttaactgttttttgtttctattttatattttattgtactatgtcttgaaatgtcattgtagttattgtttttgatcagttcatcttttagtctttctactcacaatatgagtagttcacacaccccaatacagtattagaatattctgtgttttttcatatatctactattaccagtgaattttttaccttcagatgatttcttattgctcattaacatcctttcctctcagactgaagaattccctttagcatttcttgtaggacaggtctggtgttgatgaaatcccacagcttttgattgggaaaatctatttcctcttcatgtttgatggatattttctccagattactattctggtataaagtttttttttttttccttcagcactttaaatatgtcatgccaatctcacctggcatgagattataagggttccactgaaaagcctgctgccagatgaattggagctccattgcatgttatttgtttcttttctcttgctacttttaggatcctttctttattcttgactttcaggagtgtaattattaaatgccttgagacagtcttctttgcattaaatctgtttgatgttctgtaaccttcttgttcttgaataatgatgtctttctctaggttggggatgttctgtgctgttatccctttgaataaactttctacacctgtgtctctgtttaccttatctttaaggccaataactcttagagaagcccttttgaggctgttttctaaataatctcgtaggcatcattctttttttttttttttttttttggagtcagagtcttgctctgctgcccaggctggagtgcagtggcatgatctcagcttgctgcaacctctgcctcctgggttcaaggaattctcatgcttcagcctcccaaatagctgggactgcaggcaagcgccaccatgcctggctaatttttgtatttttattagagaccaggttttgccatgttgcccaggctggtcttgaactccagagctcaggcaatctgcctgccttggcctcccaaagtgctaggattacaggtatgagcccctgtgcccagcctctttttcttttttgtttcctttgactgtgtgttttcaaatagcctgtcttcaagctcactaattctttcttttgcttgatcaagtctgcttttaagatactctgatccattcttcattatgtcaattgcatttttcagctccagaatttccttttgcttcttcttaattatttccattttgttgttaaattcatctgaaagattctgaattccttctctatgttctcttgaatttcttcaagttttcccaaaacagctattttgaattttctgtctgaaggatcacatatctctgcctttctttgattgttccccggagctttatttagttcattttgggagctcacgttttcctggatggtctcgatgcttgtggattctcgttagtgtctaggcattaaagaattagatgcttattatagtcttcaccatctagtacatcttgtttttactcatcctctttgggaaggctttccaggtatttgaaaggatgggggtgttgtgatctaagttgtatctgcattaaagggcaccccaagtccaacatcattgaagttcttgcagacttgtagaggtaccaccttggtggtcttggataagatctggaagaattctttctattgccaggcagagactcttgttctcttccctttttcccaaataaacagagtcactttctctgtgctggactacctggagctgagggacgggtgacacaaggacccctgtggccactaccactggcactgtgctggatcagacctgaagtcagcatggtactgggtcttgcccaaggcccactgtaaccactacctggctaccgctcaaggcctaggactctacaatcagcagatggtgaagccagtcaggcttgtgaccttccattcaggggattgagttctcctgagccctagtagttttagagatgctgtctgggagccagggcctggtttgtaaaccttaggaatctacctggtcctctgttctgctgtagctaagctggcaccgaaaccacaagacaaagtctttcccactctttcctccccttctcccaggcaggagagcctctgcctgtatctgccaccatcaaaggcccataggaagtattgccaatgttcacttaagtcctaagggcttttcagtcagcttgtggtgaatgcttccaaatctgcaactcacccttcctggcattgggctcctttctgggccaggataggtccaaaaatgtcatctaagagccaaggcctgaaattgaggctccagagtctgtttggtgctcttccccactgtggtagagctggtacctaagctggaagataaagtcccctttatttttccttctacttttttcaagcaggagtctctccccataaccacataggtaggaatgtggtaggtcacacctgaagccagcatgtttcatagtctcactcaaggcccacagcatgttctacctggttaccactgctgattattcagggctgaaaggccctttagtcaggaggtgatgaatcccgccagcagtggatccttcccttcatagcaactggttcccatctggcccagggtttgtctagaaatgttgtccaggagctagggcctggaatgggggcctcatgactctccttggtgcactgtcttactttggctgagctggtgtccaagttgcataacaaagtcttctctactgttttctctcctctcaagttgaaggaaggagtctcttttggagctgtgagctgtgctgcctggggttggtggaggggtgatgcaggcactcccttagctaccccagctggtgactcactatgtcatgtgtcccctgagtccgctggctctgatcctagcacagcttttagactttcctgtaagtttcagtccttgtggcctagagtgccttttgtttattgaggaccccacagctctttagctttctgtggtgaggcttgccgaactcaagttctggcttctgagatgagcaatcccactttggctagagctgatctaaatgttccctctgtggacattggctgagttctgcctggtgttggcagcaccaagttccaatgtaaagtcccacaattgctgcactctccctctcccaaacacacagattctctctacttggctgctgctagcggatgggggaagggtggtgtcggaaattaaagggcctttcctacccacttcagtttgtttttctgcagtatgaagttaaaaccaggtattgtgatcactcacctgatttttggttcttgtgaaagtgcttttttatgtaggtgtcatatttggtgttctgacagggaggaagattggtagaggcttctgtttggccatcttgctctgcctcccagggcctagatggtaatttgttaaacaatggatgaaccaaaattggcacatgattactatccaaagtctgtaatttatcttagggttcacgcttgatattgtaacttctatgggttttgacgtgtataatgacatgcatctggcatatagtatcatgcagattggtttcaatgtccaaaaatctctgggatccacctattaatccctccattccctcgcccccaaaccctggcaaatattgatttttttttttttttttgagacagagtttcactcggtcgcccaggctggagtgcagttgcacaatctgggctcactgcaacctccacctcctgggttcaagcaattctgcctcagcctcccaagtagctgggattacaggcatgtgccaccatgcctggctaattttttgtgtgtttttttaatagagttgggtttcaccatgttggccagcaggtctcgaaactcccaacctcaagtgatccgcccacgtcggcctcccaaagtgctgggattacaggagtgagccaccacacccaggcaactattgatcttttcactgtattccatagttttgctttcccttcaacatgtgtttgtagagcgcctactgtgttccagttttgcagaccttggggattaaatattaagtaagaagcagtggcctttggagcaagatataggcctggcagttaccctgcattttaataaataccactagtttactaggcagtctagaaagacccccgtcccagatttgggagttaaggaaagacttcatggaaaaagttagatctacatcgaagcctgaagaaagaggtggtatcaacaaggtaaggcgataaaggaatagcaactaagattttctaggcagagagaatagcctaggcaaaagccaagaggatagagatagaatatacacttaagagctaaaaggagctcaaaagcaatggtaggaagaacaaatgattggaagattgtaagaggtagggggatatgaagagaaatgaagctagagaaggggagaagtttcctgactgtgatttgccttgtaagccatattgaagacttagaatttaaatctagaggtcagagaagttcttatagatttttttctttaattaagctttgtatttagagataattatagtttgacatagagttgcaagaaataattcagagagactgggcacactgcctgacacctgtaatcccagcattttgggaggctgaggcggaaggactgctttgagtccaggagttcaagaccagcctgggcaacatagtgagcccctatggattagtcaattttcatgctgctgataaagacatagccgagactgggcaatttacaaaagaaagaggtttatttgacttacagttccatgtggccggagaggcctcacaatcatggtggaaggtgaaagtcatgtctcacatggtggcagacaagagaagagtttgtgcagggaaactcccatttttaaaaccatcaaatcttgtgagacttattcactatcgtggcatgggaaagacccgcccccatgaatcagttatctcctggtgggtccctctcacaacatatgggaattatgggagctacaagatgagatttaggtggggacacaaagccaaaccatatcactctgtctttacaaaaaaaaaaaaaaatatatatatatacacacacacacacacacacacacacacacacacacataatgccaggcatggtggtgcatgcttgtagtcccagctactcagaagactgaggtggaaggattgcttgagcccaggaggacaaggctgtagtgagccgtgattgtgccactgcactccagctgggtgagagaggaagatcctgtctcaaaagaaaaaaaaaagtgatgaattacattttcatttttcattcaaattcttttttttctttagtatcgtagcctaatttttaaatttgttttggctctgagccccttgctaatttgctaggctagattaggcaaacagaaatcagcaccctgaattattttctactcttatcttaaagaagtttatggtttgtgaatgtgtgtgagagaattttataaagcaagaagttggtagctttaaagaattctggacttaatgttgatctgcaacatttagaattttttatttgaaatgttattgatacagtatgaatgcttgttggaatatgaattctacttcaaggtgttagatgatgtatttgcagagatacatagaccctgctctcaaagtttagactctgttgggtcaaatagactttttgacataatttcatttcattgaggtaagtgcagggatagagatattagggcatttttggaagagaaaggggcacttaccttactaggagaggaggagtattggggaagccatacttgaactgagtcttgaatggtgaatagaaattaatctgttgaaggtgatgataagacatttcagaacatttagaatagcacgaacagagacacatagaagaagcatcatattgggattgctagttggggaattacaaacaggttagtgctgtttgagtgtcaagtgcgggaggcaggaagttgtaagacactaaaagataagcagggcctgttgtgttgagtttgaacttcatgctcagtgattctcaaacatatccagcccagtgtttctttttttgtagtaaatattttctaatgctcctttatgatccttaaaaggaattcttataattcacatataataaaattaaaacataatttctaatatgatgtcataaatgtagtacaaaggaaaagtataagaaatctaaacatgatttgaaatatatattttaaaatataaatgcttaagcattatatcattagaacacataatgaattaatcagatgcttgtacctatacatggtattactgtgaatgcacagcaacaaatgcaggtatataaaatgtgttgtattggtaggtaagatattttaaatggtattgtcactggtaatgagatttttcaaaatacttaacatcctatttgtaaagttctgaccaagtcaaagtacaagttgtattaattgcattcctggaaaacttggtgtttattaaaaccgtgaaaaaatacttttttatgtaaaacaaaatacttaatttttaggctgaagtaattataaacaggtttttccacacaatgtcagatgggacattgcaaagtcatgtgagacacaggtctttttgtcctgtgggatgttcttggtcaggggtctgcaaacatcagcccacaggtggtcacactgcctgtatttatatagcccatgagctaaaaatggtttttacatttttaaagagttgtacgaaaaagggaagaatatgcagcagagggttacaacttttacagaaaacttgccaactcccgtttcttgggtattgaaggatgccgaacatccctagctcatgctcacttaatgcgaacagcactccctccaatcactgtgaaaccaaatgtagcctccaccatttctcaggtgcctttgggagggcaatactacctggttgagaaccactgttttggtttatcagttttcaaatttttattcctctgcgacacatttaacagatagtaatacatgcataatatagttctatgcagagttcctgtgtttttaattttctttttttcttccattcaagtaaacaattaaaatgagggaggtaattgtttaatataaggatactttgaaaaccctctgatttatacttataaaaatctttacaaacattaatacttgtactactactactgctaactatattatgtacaacttaccttatacctcataggagagtgcttcacaccatcctgcctgaccaccactgaagcaagtaatagtcagccatgggataactttaaacaagcaagtgccagcatcctatatttatattatagatagatcactttgatagtggtatagaagatagacttgagggagtccacacttagtttaggttcaagatagtgagggcttctaccagctagtagggacagatcagaggggacatattattagagaattatttcagatgtaacaatcagtagaacttgacaactgaaagttacaggcatttgtttttctttttcttttcgaactcattttactgccagaggcatttgtttttaacactttgttgcctgccagaatcactttggaagctttttaacaataccagtgcctaggctttactccataattcctggaaatcagaatttctgggataatagctgggcgctgatattttaaaattgtacttcaggattctaatgtgcagccagtgttgaaaaccactgattcaagatgtggaagagagagaagaataaaggatgagtaccaggctgtcagcctaggctgccagtagatggaagtagtgtgctgtgaacagtatctgttttatggtagctattcaaatatttcttaagtgaaaattgatgactttgaacctaaaccaaaatcaatttctcatttaatttttgattgttctaaatttggatgaattgaccctagttcaagatattattgactggaacccaaccaaaataacttttgtcacagatgaaattatatcagaatggatatctcttgatattatttgagaagaagaatgatacaaattacctgagttgtgacataatattgtgaagcaaggtgtcagtggaaataatttgacttaattatagtatattatacaaaataattccttccttccttccttccttctttccttctttctttctttcttggcggagtctcgctctgtcacccaggctgaagtgcagtggcgcaatcttggctcactgcaaccttcgcctcccgggttcaagcgattctcctgcatcggcctctcgagtaggtgggattacaggcacctgccaccacccccggctaatttttgtattgttagtggagatgggatttctccatgttggtcagtctggtcatgaactcctgacctcagatgacctgcccacctcagcctcccaaagtgctggattacaggtgtgagccaccacgcccagcctgtatttgtattgattggcatagccagaggtttggggtcctgctatctggtaaataggcagatattcagtaaatgtttattgaattgtaatgtgaaatatctttaatgtaccagaaagttgtaatatttaccatataattttttatattaatgaagaaatgaaagacagcttgtttttctttcagctccagtctcacttgctctgcctgtgttctacttggtgttgttacctttacattcttctgttcccactgccaccaccctcttttagtcaagactcttggttccaaatgataggaatacagcttaaattgaatagttgatggaattttgggttgtctgtaggaaggatgctgagatagcattatagaattgcaggaaggcctgcaggaactagggtcttgggaactataaaacagggatatcaccccattaaaatccactctcacttcattctattttcttgcagacatgcttttgccaaaaggtccaagaaaatgctgtctgtaactccagcctcatgtccttcttatactatgacccaaaaagacaagatcatttctcctgccctaaattgggaccagtcagtgcgcccagagaaaggaggatattgtgatctgtctggtttggagcttatgccagtccccatggccactagcagataggggcatagcaaagaagaggcaaggggaggcttaccctggggactaagttattaactgctgctgtcctctcctaggctccattgccctagccctctgaaaatttttcacttcagtccaactacttactgttatcagattcagcttaaaatttttttttcattaaaaacatttttaaaagagagacagggttttgctgtgttttccaggctggtcattgtcaacctccagggcttgaacaatactcctgcctcagcctctggagtagctgggactgcaggcgtgtgacaccacactggccagattcagcgttctaaaccacacgttgcatcatgatttcccagttacctagcctttagtggcccctcattacgtatatataacaatgtctaaacttgatgtactttaatctggctccagactgccttctcaatcttatctctcagtttttctattcactgttaaactgagctagttggccttctaagttctgagaacacttacatattcctcactcagtcatctaaactttaagtaaaaaatttgtggtaatactcttcaaatcattgtttgatgtctcaggatctctgaaggccagcaactgaagcattgtagctactcattagggactggcatctctgtatcattgttgacagaatgtaccagtttacatttttttcagtggtagtgataccgagtctacttctctgtgtagtcacttgtgacagctaatcagagggaaacctggcttaactgttgaggctttggccctgcacttatctcatggtgctttcagaaaaatcagttgactgcttgaagcttcagtttccttttctgtaagttgagagtgaagagcactataatactatcatctacctcattgcctttgaaaattgattatgagggtcaagtgcagtaatacagacatacctcggaaataccttgggtttggttccaggtggccacaataaagtgaataatgcaattaagcgagtcacatgaatttttttgtttcctagtgcattaaagttgtgtttatactataccataccatatcatactacactatattaagtgtgtaagaacactgtgtctttaaaagcagtatacatactttaattaagggatactttattactattcaagaggctgaagtcagaggattacttgagcccaggagtttgaggctgcagtgagctatggttgtgctcctgcactccagcctgagtaacagagaccccatctcccaaaaaaaacctaaaaactttattgctaaaaaatgctaatgattacctgagccttcatctagtcatattctttttgctggtggagggtcttgccttgatgtcttgtttttgttttctaaatgtgtgtgtgtgtgtgtgtgtgtgtgtgtgtgtgtgtgtgtgtcagaagtgggatttgaattgccttgatgtcagtggctgcttactgatcagagtggtgattgctgaaagttggggtggctgtggcaatttcttaaataacacaacaatgagattgttgcatccgtggactctccctttcatgaaagatttctctgtagcatgtgatgctgtttgatagcattttacccacagtagaacctctttccaaattggagtcagttctctccaaccctgctgctgctttatcaactaagtttctgtaatgttctaagtcctttgttgtcacttcaacaatgttcacaacatctttactaggactagataccaagaaaccactttgtttactcctccataaggagtaacttcttatccattcaagtttgatcataagattgcagcaattcaatcacatcttcagatttcacttctaattcttgttctcttgctgttttcaccacatatgcagttacttcctccactgaaatcttggactcctcgaagtcatccatgagggatggaatcaacttcttccaaactccctttaatgtggatattttgacattcttctatgaatcgtgaatgttcttaatggcacttagaatggtgaatcctttcctgaaggttttcagtttattctgcctggatccattagagtaatcactgtctatggcagctatagccttacaaaatgtatttctttctttttttttttttttctttttagacagggtcttgctgtgtcacccaggcaggagtgcaatggtgccatcttggcttatgcagccttgaccccctgtgttcacagtgatcctcccacctcagccttctaagtagctgggaccacagatgcgtactaccccgcttggctagtttttttgtattttttgtaaaaacgtggtcttgccatgttgcccagaatggtcttgaactcccaggctcaagcaatctgcccacctcggcctcccaagtgctgagattataggcttgagccactatgcctggtcacaaaatgtatttcttaaaaaaaaaaaagactttacggtcaaaattacttcttgatccgtggtctgcagaatgaatgctgtgttagcagtcatgaaaataacatctccttgtacgtctccatcagagctcttgagtgactacgtgcattgttagtgagtagtaatattctgaaaggaatcttttttctgagcagtagttttacgtaaaatattaagcgcactgtgaatattttaaattcagctgagtattttaaattcagcaggccatgctgtaaacagatatgctgtttaggctttgttgttccatttatagagcacgggcagagtagatttaacatcattcttaagggccctagagttttctgaatggtaaatgagcattggcttcaacttcaagtcaccagctgcgttagcccctaacaagagagtcagcctgtcctttgaagctaggcattgacttctctctagctgtgaaagtcctattttatgagaactcacaaacaaaaaataaagtcctagatggtatctttttccgatatatggctatttcatctatattgaaaaccttttgtttagtgtaaccacgttcatcaaatagctagattttctggataacttgctgcagctcatacgtcagcacttgctgcttcatcttgtgcttttgtgttaatggagacaacttctttctttaaacctcatgaaccaaccttgcttcaaacttttcttctgtaaactttctcacctctctcaacctacatataattaaagaaagttagggccttgccctcgattaggttttggcttatgggaatgtggtggctggtttgatcttttgtccagaccaccaaaaccttctccatatcagcaataaggctgttgtgctttcttttttttttttttttttttgtttgagagagagtctcactctgtcctccaggctgaggctggaagtgcagtcgtactatcttggctcactgcaacctctgcctcctggattcatgcatttctcctgcctcagcctcctgagtagttgggattacaggcgtgcgccactacgcccagctaatttttgtatttttagtagagacagggtttcaccatgttgtccaggctggtctcgaactccggacctcaagtgatctgcccaattcggcctcccaaagtgctgggattacaggcgtgaaccactgcgcccggctgtgttttgctttcttgtcatttgtgtgtgcactggagtagcacttttaatttctttgaagaacttctccttggcgttcacaacttggctagctgtctggcacaggaggcctagctttcagcctatcttggcttcctctctaagcttaaacatttctagcttttgatttaaaatcagatatgtgtgactttttcacttgaatacttagaggccatcgtagggttattagttggcctaatttcaatattgtgtgtctcaggtcatagggaggcctgcagagagggaaagagaaggaatggccagtggttggagcagtcagaacacaagacatttatcaattagttagtttatctgtcttctatgggcatgtttcatggcgccctgaaagaattccactagtaacattgaagatctctgatcacagatcaccataacagatataaataatagtgaaaaagtttgaaatatgagaattttcaaaatgtgacacagagacacaaggtgagcatatgctatttgaaaaatggcaccaatagacttgcttaatatagggttgccacagaccttcaatttgtaaaaaatgcagtatctgtgaattataataaagtgaagtgcaataaagtgatgcacaataaaatgaagtatgcctgtagatgtgaaaatgctatggtatgctaaagattactgtgcaaatttaaggcatgttactatgcttgagcttatatttagttactgtgtcttcttggatgctggaatagagaacccagattcaatggcaattaacttttgaaaatttatgggaaagtataaagtagtatataatttcacagtagtattattgtgaatgagctgtttggctgaagatgggcttcaaagctaagataaatacattcacttaacaataatttacttagtgcatcacatggataaggcattatacagttgaagtatatcaaaccaagcctggctataaggcattgtgaaattatgtaagattttatcaaacaaccaattaattttattcttttgttttattgttattattattattttagagacagggtcttgctgtgttgcccaggctggactcgaactcctgggctccagctgtcctcctgcctcagcttcccaagtagctgggactacaggcacacaccaccacacctggcttgttttattacttcaaaaaaaatttcattttatctccccgccatagaactggatatttaaaaattatattctagttattgataccgaattgagtgacatggaatttttaacagtagcttttctgatatttgatgtttccaaagggagtatttttgttataaagagcttattctcattactgtctgccccctcccccacccacttttttttttttgagtgcagtcttgctctgtcgctcaggctggagtatagtggtgtgatctgagctactgctacctctgcctcccgggttcaagcgattctcctgcctcagcctcccgagtagctgggactacaggtgtgcgcaactacacccggccaattttgtatttttagtggaaaaacagggtttcaccattttggccaggttggtctcaaatttctgacctcaagcaatctgcccacctcagctttgcaaagtgctgggattacaggtgtgagccactgtacctggcctctttactgtcccttgatgaccttttattaaaatttatttcagtgaattttttttttttttttttttgagacagggtctctctctgtcacccaggctggagtgcagtggcgcaattttggctcactgcagtccctgcctcccggttgaagcgattcttgtgtctcagcctcctgagtagctgagattactgagattgctgttattgcatatataccacgcacaaccatgcctggctaatttttgtagttttagtagagacagggtttcaccatgttggccagtttggtctctaactcctaacctcaagtgatctcacctctgcctcccaaagtgctgagattacaggtgtgagccattgtgtctgggctatttcagtgatttaagagtcactcaaaatataatctgtagttaagaagctatctttttctaattacctatttaattcaaattttttgctttttctgtcatctttatagtctattgcgtctgcagacatggatttcaaccagctggaggcattcttgactgctcaaaccaaaaagcaaggtgggatcacatctgaccaagctgctgtcatttccaaattctggaagagccacaagacaaaaatccgtgagagcctcatgaaccagagccgctggaatagcgggcttcggggcctgagctggagagttgatggcaagtctcagtcaaggcactcagctcaaatacacacacctgttgccattatagagctggaattaggcaaatatggacaggtgagttaaacttaagtcaattttcctttgtaaactgtatttttcactacatgttagcttgtctattcagcttgattttatgcaataacagcaacaggaaaagacactgtttcctagaatcctttttcagaggtagaatcatctgaaaatttggatactctcacttgtggacagagtctggaaactagcctcagggtcctggcagctgtctcagaagaacagaatgggccaataatgtgattgctcagaagctgaccactactgcatttggttagatctcaaaatccttggcatttgttcagaatttccaaggcaatgatagagataataaataaagaccaagaatttggattaaacaacacaatctcatccagtcatctttaataatcagtcaggtataggaggcagtgtatcttaatttacattaatacattgttcgtaaagacccctaaatgtgctatctctgtccttgaggtcacaaataattctcagtttaatcttatgtacagtgcttcttttcccaacagttacagcagtcattatagcagataattttaatgtctatatggtttttcttgaagtcattcactttgtgttccagatgactgccagctcagacttttaatgatctggcttatgtctttggggaaaaaaaaagaaactggtaattaggaagagaaaacccaggtcaatgaattagctaatcacatttattttcagataaataatcaaataagtgcttctattatatcctacaatagaaatttatttcttacttgatgagctgtcagattttcttacatattttcttttatagtttctttagatttttcagtgtttgcagttctgtactgactttaattttaatttaaaagataattcagggcctggcacagtggctcatgcctgtaatcccagtttatgcctgtaaccccagcactttgggaggctgaggtgggcggatcacctgaggtcaggagttcgaggccaacctgaccaacagagaccagaaaccccgcctctgctaaaaatacaaaattagctgggcatggtggcacatgcctgtaatcctagctacttgggaggctgaggcacgagaatcgcttgaacctgggaggtggaggttgcagtgagccgagatcatgccattgcactccagcctgggcaataagagcgaaactctgtctcaagaaaaaaattttttttaaataataaaagataattcagcctgagcacagtggctcacacctgtaatcccaacactttgggaggccagggtgggtggatcacctgaggtcaggactttgagaccagcctggccaacatggtgaaaccttgtctctactaaaaacacaaaaattagtcaggcatggtggcaggcgcctataatcccagctacttgggaggctgaggcaggagaatcgcttgaatccgggaggtggaggttgcagtgagccgagattgagccactgcactccagcctgggtgacaagagcgagattccaccagaaaaaaaaaaaaaaaaaaaaaaaaaaaaaaaaagataattcattaaaaatttttggccaggcgcagtggctcatctctgtaatcccagcactttggaaggccaaggcaggtggatcacttgaggtcaggagttcaagaccaacctggccaacatggtaaagccccatctcttctactaaaaatacaaaaacaaaacaaaacaacaacaacaacaaattgccgggcatggtggcgggcacctgtaatcccagttactcaggaggctgaggcaggagaattgcttcatcctgggaggtggaggttgcagtgagcagggatcacatcactgtactccaggctgggtgggagaccctgttgcaaaaaaaaaatttaaatatggaataccttttattcagttattataaagtagtgctacttgtacttgttgactagtttgtctgatcctaaagtcagttctcttgctgggcacagtggctcacgcctgtaatcccagcactttgggaggctgaggcaggtgtatcatctgaggtcaggagatcaagaccagcctggccaacatggggaaaccccatctctactaaaaatacaaaaattagctgggcatggtggcaggcacctgtaatcctagctacttgggaggctgaggcaggagaatcacttgaacctgggaggcagaggttgctgtcagccgagatggtgccactgcactccagtctgggcaacagtgaggcgctgtctcaaaaaaaaaaaacaaaacaaaacaaaacaggccgggtgtggtggctcatgcctgtaatctcaacactttgggaggccaaggcaggtggatcacgagatcaggagatcgagaccatcctggctaacacagtgaaacccgtctctactaaaaacacaaaaaaattagccgggcgtggtggcgggcgcctgtaatcccagctactggggagtctgaggcaggagaatggtgtgaacccaggaggtggagcttgcagtgagccgagattgtgccaccgcactccagcctgggcgacagagtgagactccgtctcaaaaaaaaaaaacaaaaaaaacttgtctgttctcttaaccattacgttatgtgacagatatttttacacacacacacacacacacacacacacacacacacccaacagattagaaaagtttaataagtacacttggatatctaagttttaccagctatttatatcggctatttagttttcatcctgccagcagtgcttatttcattttgtctatatttaacatttggtcaggaatatgaaaacataatctgttttaagactcctagaaagctatgatattatttcgttaatactatcataggtttctaggttacaggttgctcgcttctgtaatctcagtactttgggaagctgaggcaggcagatcacttgaggtcaggagtttgagaccagcctggccaacatggtgaaaccctgtctctactaaaaatacaaaaattagccgtgtgtggtggtgtgtgtctgtagttccagctactcaggaggctgaggcacaaaaatcacttgagcccggaaggcggaggttgcagcaagccaagatcggatcacttcactttagccttggtgacagagtgagactgtgtctcagaaaaaaagaaaaagaaaaagaaaaaaagtgtgacaatgattgtatacatatgtcaaaacttataaaattgtacactttattatttacagtttattgtacatcacatacttcaaa

SEQ ID NO: 22 - DNA, 23962 bp, Homo sapiens
ctggaacacctcttttagaactgtattgaatatgggcattactctgcatattttggagacatttaaatcttcagtataattttgtgacagaaaaggacagcaatgcctgcaagtccctatgccttaatttatgttatgttatgttatgttatgttatgttatgttgtgttatgttatgttatgttatgttatttttttgagacaaggtctcgctctgtcacccaggctggagtacagtggtactatctcggctcactgcagcctccacctgcctggctcaagcgatcctcccacctcagtctcatgagtagctgggactaagcacacttggctaatttttgttatttttttgaagagacaatttcttgctatgttgctcaaactcttaggctcaagtgatctgcccaccttgacctcccaaagtgctggaattacagccataagccaccgtgcctggccttctatgccttattttaaaaatgggtaataatagcaactaaatttagttcctgatttttatagtccatgttagcctgttcagtgcattaaagaaaacagtggagtagaaagtcctcttcacattagaattgaaactcagtgactactgtatttaggaagaatagagtagcaactaactgccaccatggagatttctgctacccagctgacttcagtaattgtggctttttttaagaatctttgcagaggacaggttgtcagcatgattactctgtctttaagcttctgcataggtttgcagtaaggtcttcttttttcaatataaaaggaaagtgtgttgttttctgagagaagatagatgatagctttctctgaactatcactgggtaggggtaagtcttgatacactttaatattttgtaataatttagcaaaacattattttttaaaaaaatagtttttaatgctttatccaaactgtaactatgtcttttgtaattcaaaagcagtactattttccttctaactgaagattttgacaaaaacttgagtctgggaggtcatgagccatgactgtgtcactgcactccagcctaggcgacagagtgagagcctttctccaaaaaaaaggaaaataaaaaggattaaaataatgatgccaataaaactattggataggttttttttccccaaaagggtgttatattctactacattggatggattataaaatttaatattacagttgtctttagtgactcttctttgaatacatttcattaatgagatatagtcaaattattttattatagtcacttaaaatatttcctgattttgttctaaatgtatgaacacttgcttgatgaatacttcatttcagttatttaagttcatttttattgtgagagtactgatgtcctaaaaactgccagtttttgtccctaggctgcttttatctaaatggtctttcttactagtagcattctggttgccagaaaataaaggaaattggcttcaccatcaatttatgagataggtaggaagatatggttgactctccaaagggatgctagaattctatttagctaccatatgattattttgtaatgattcttaatggttatagatagaagattcatatatatgagatactgctagatatccactgtacctaagaatagaaatgctaataatgttatgagatgtacatactgttttttaaattcatattgtttttttaaattagatatccaaatctaattgttatactctttgggcacagttaccaattggtatcaaattacaagcccaagaatacaacaggatatgtgtatgcataaagttcacaaatttagataaatctaatttcactttattagattccaattttgtcttgatatatggagtctttttttaccccctttaaaattttttattatggaaacttaaaacagaaaaaatatatataatgtatccattatatgggcataaataaaataatataatgtacctatattcctattacccagcttcaatggttattaacccatatcccttcttgttttcatctatatttctttgcccattggattattttgaagcaaattccaaaaattatttatttaatcatttaaagagaaactttgtttctttacatatataaccatgatatagtaatcattatcacatttgaaaagaaaattagagtttcctgtgttctggattttgctgattgcatccccatgaagttctgtagcatgtttctctgacacctgtatttcctgttagacctagaaaaggttctctcaacttctcactgttggaattttgtactggataatttttttgttgtagaagactgtcctgtgccttgcagaatgtgtgggagccaagcccttcggccccagtggtttgctgaaaaattaccgacaagaagcagattgattaataggaaaaaaggcatacacatttgtttaacgtgtatacacgagagccttcagaacaaagatccaaagatatagggaaattgttcattttcatgcttaggtccagcaaagtatggacagccatgtagaaacatgattggacaaaaagagtatgatctaatgctaatagacttaatggggaaacccagcaaagcctgtctgttgagattcttcttgccctctcagagcatgcatttcgtccttctgggtgtgggcagggctctctctgggatgggggtcttatggcccacagtgaaacaaggtaggtcatttcatttctttatggccagtttttacacagggtattgttaggctttctggttggtttttgaggaaaggggttctgatttctatgacccaccttggggaagggggattctagtttctgtggctgacctcgggggagaatgggactaagagacaggagagcagaagtcagaaaaaaacttagcttctgcggctgcttctgaagcctacagtttggggattgttttctgagctccagtagatgtttagcagcatcgcaggtctctagccactagtcaacagcaccccctccaccaattgtgacaaccaaaagtgttccagacattgccaagtgtctcctgggggcaaaaattgcccctattgggaactctgctaatctagaggctgatgagattcaggttcattttcttggaaagaattcttcatatgttgttgtggtattttctaccttttctaaacatcactttttatctcttttgtcatatacggtctcttaatagactatatacttaaaatatttgctgaagctttagaagcctcagttttaacatttatttgagtatttatatgataatatccaaaatgtattagttattttaccatttattttgaattttagaaaaaaacaatatattttacaatttggtaaaaatacagtactctaggtgactgtgtaacctcttaaatttttttcatttacaccccccaggtttggatttaggtttacagtttatagatacaggtgcttcttgttttagtattagtttgataaagtaccaattatttttaaaagggatgatacttagtatcattaaatagaattccaaatgactaataagagagagaatgcaggcaaagtaaacctttgagattttgtgaaacatcctctgaattctctatattctggccatactgatcattgcctcactactcttttatctgtgttggcaattgaccttattctctagccccttaaccaactattccttaagtcctcacattagttagacacaaccagccccaatactagtgagctaggcctctgtataacagaagacaaaatataattaaatcctaaataaatgatactatgtttattgagtactttttctttttaaattaggtttacttaggaattcaaatgcattcagtagttactgttttgtgtttgatcttttaagcacccaactctgttgctacagagcatagatactttttctatcccattaattggcttgattgaagctgttaagaagcataatactcattggtaggatactgactaaaaatactgcttgtttctaactgtgcttcaccagtgaaagttgttggtaattaaaatggattaactcatatctggttttttgtttcacattaaactgaggagccagggtatctgtcatcttacattgggctcgtcttttctctgggggcctgttgtttatgttaaagtaaattttgtttgattacttgttttcatgatgctagatttgcatgaatttcattttgaagacctttgtggttatcagtggcttttaaaataaaaatagctccacattctcaggaggagttggaatttgatctctaacgaattatacagggaaaggcttgtgtggtgggattccagtgatctttactcagattatctctgtctgacatctcagaaactgggttattttagctccctttaaatttgcttttgagaacatccactatcacattaacaatacttagttgattgttgcttctgtgaaatgctcttttctgctacattggtctaccttgtctttatatgcctttaacactttagtatgtataacacaatctaacacttcatacaatttattatttccctagttaaatttttgaaaagttttgagtataaaattgtgtgttatatatcttgtactgaacatgtagaaaagactcagaatatgcttgtgattgattgtcaggttattaagaactatccagcatgtatgaattttgtaaatatgctcacaggaagagttacttcaaatctgactgtgccagaaaccactgactcatgaccaggtgtggtggctcacacctgtaaccccagcactctgggaagctgaggcaggagcatcacgtgagcccaggtggccgagatctccctgggcaatgaagcaagaccttgtttctacaaaaaatgtaaaaattagccaagcgtggtggcatgcgcctgtaatcctagctacagaggaggctcgggtgggaggatcacttgagccccagagttcctggctgcagtgagctatgatcatgccaccgcactccagcatggatgacagagcgagaccctgtctctaaaacaaaataaaattaaggaaaaaacctacaaaccattgactcatggaaataaaaaatcatatctgctgttcaaagcttcaggcatgttctttgaaattaataattgtttactttggtggaacctcatacatccctatagatttcccccttgctgctctttttctgttggtttagcttctttctctccttctctcctctctctctttctctctttcactccttccttccttcattcattcattatttttttgagacacagtctcactctgttgtctaggctggagtgcaatggcgtgatcttggctcactgcatcctccaccctccaggttcaagcgattctcctgcctcagcctcctgagtagctgggattataggcatgtgccaccatgcccagctaatttttgtatttttgtagagatgaggtttctccatgttggtgaggctggtcttgaactcctgacctcaggtgatctgcccaccttggcctcccaaagtgctgggattacaggcgtgagccatgttgcctggccagtttagcttctttaaaacagacataaataaatgtaccttaacttacatcttaggtttagatttttgaacgatttatgacttagctgtatttggttactattttgtactagcttaaaaaaaaagaaattaattttaccagacctgatttacttcttttttctttggaaacaggaatatctggtataaagggtaatatcctactagagatgaatgaggaaaccatagttttaagatgacttctgctgatacaggatatgctttcattatgcttttacttacctttctcctcagttaatgaacaaaggcaagtctgaaatattttttggaatgaaaatgttgaattaggatagccttgggagagaacagaaaaatatcttttttaaaagttactttttggacacagtggttcacgcctgtaatcctagcacttcaggaggctgaggcaggtagactgcttgagcccaggagtacaagaccaggctgggcaacacagcaagacccccatctgtaaaattaaaaaaaaaatgttaagctacttcttaaaaagaagtaccttagatataaatacttcaaatatttgtttgatttgccctgctctcaagctactacatttagttgttaaatttgaactccaggtttcagctagtggttatattagatagcacattagagagggtgaaactcatcaaatggtgtgactgcccaccttgtcctctacatttatgatgaaaactgaagttaaaaatatatcaaaagaggctggacacagtggcttgtgcctgtgatttcagccctttgggagaccgaggcaggaggactgcttgaggccaggagttcaataccagcctggccaacatagggagaccccatttctacaaaaatgtaaaaaaaatagccaggctggtggtgtgcacctgtagtgccaactacttgggaggctgaggtggtaggatcgctggagcctaggaagtcaaggctgcagtgagccagcctcagcaacagagcaagaccctgtctcaaaaaaaaaaaaaaaaaaaaaaagaaatgtattaaaagaggttacggatttgaaattcagcctgttggggtggaaatgttaggtaggagactgttttagtttggttctttgtttccattaatagtcacacttggccgggcatggtggctcacacctgtaatccagcactttgggaggccgaggtgggtggatcacctgaggtcagacgttcgagatcagcctggccaagttggaaatcccgtctctattaaaaatacaaaaattagccaggcgtggtggcaggcacctgtaatcccagctactcgggaagctgaggcattgcttgaacccgggaggcagaggttgcagtgagccaagatcgtgccactgccctccagcctgggcgatagagtgagactcagtctcaaaaaagaaaagaaaagaaaaatacagtgaagactggtgtacctaccactaatttcattacttgctaaaattttgtcatttttgcttcaactattcatgaacatctaaatgttttcagatgtttaaggctcaactcatcattttgtaattgggccatatctaccttgaccaggaagttgttatagtataaaatacacagtatagttgccagtcactatgtgtatggatgactggtaaggttttctcaatgtacaaaatacctgacttgcctttgccctttgatttctaaggagaaacagttttaaaaaaaaaagtctcatcctatgtttctgaatactagactgtgagagcttcagtttagacagacattaaagagaaccaagcaataagtgaagctgttagcagcatgaggctcaaattacttgcttcatcatcatctttgctctcatgacagccaaaaactgttatccaatgactattctgtgtaagataatcatttcacatgtttaattcttatgtttccttctgtgaagcatgtaggaagtttgggatatgatttcagtatttgatttagataaaaatttgtgcaggtctaagcttgaagatccacactactacagcacagacctctgcagcacagggccttggatagagtggagtaggcattcatgataagtttaactgaatagtattattttgtatactgatacttaaagaaaagaaatggcacctctcatttaatggtttctctagaagttttcacaatatacttattttccctttattccaatacatatttattaggctagaattcaaagctcaactgaaaactgctcaggcaattgaaataagtttttattgatagtgacctctgattggtgaggattcccagttctatgtttgtgtgttgagagagagccagagtatgtgtataagctgtagcaatcaaggtagaatggttttttggccagacgtggtggctcatgcctataatcccagcactttgggagacctaggcaagtggatcacttgagcccaggagttcaagaccagcctggccaacatggtgtaacactctctacaaaaaatacaaaaattagctgggcatggtggtgcatgcctgcagccccaactacttgggaggcttgggtgggaggatctcttgagcccaggaggttgtggctgcagtgagatgtgatcatgccaactgcactccagcctgtgcaacagagtgagactctgtctcaattaaaaaaaaaaaaaaaaaaaaaagcagggctggcatggtggctcatgcctgtaattccagcactttggggggctgaggtgggcagaccacctgagcctcaggggttcaagaccagcctgggcaacatgctaaaaccctgtctctaaaaaaaaatacaaaaaattagccgtgtgttgtggcatgtgcctgtagtcccagctacccaggaggctgaggtgggaggatgtctggatcctgggaggcggaggctgcattgagtcaagattactccattgtactccagcctgggtgatagagtgagaccctgtctctcacacacacacacacacacacacacacacacacacaaagttaggatggtttcttagaaaaaaggtgtagggatttttttcttcttgagacaacaatgctaaattaatatggaatcttttcaagtttagtaaacaaagataaaccttctatttgctatgattggttggtaaaatgagtatctttcacactgacaagttacataataatactttaaatagtgttttatggacattgttttatcatatccttacaatgatactgtgaaataagtagggcagctgttaaaatcctttttaacaaatgaaaaggcttgagaaaaaaattacttgctttttagctcacatgagtaatttgtaacataggcaaggagaaaacaaacttacattccagtttgctgttctttttgaagaccacatagtcttcgtagtctttaaattattgtgtattacaactgcaggatatggtattaggtataacagctaatgtattggatggtatgtctttggaagttagaaagaagtgcagctgatagtggctcctctggagctgatgtaaggggctttgttttgttttgtttgttgttgttgtttcctgaccttatatgatttaaactttgacatcagttctaatgttcgtgatgctttgtagacatagcctgtcattggtggttgtatacatagaccatccatcacttccaccttggttttattctgaatttaagatttattttcaaagataaactaaaatttactttctgtttggcccctaggattagtaaacttaacctgctttttgattactgctcatactcttgtggtaggactttttaaaataatactttcttcttgttgttttacgagccatttgtagatgagtgatatatagtggtttattggggtgattggggacaatgagtttttgttgtaccttgcattcaagtatatttacttatgcctataaatcaggtattatcacctctcctttttcagatgtcagtccatcaacagtgtatgctctttaccatttgcatttcaagaaccacttggaaacttggaaataatcctttatttttgctagtcatgcctctgtcgtaatgttccaagaggcctgggctgctttggagaggcttgtctggctttgcctgccccctgcctcatttaactacaatagaatagctcataagatgctctctgcataagattttatttgaaggaaggtatctatatttaacttgggaaacaaatagcttaggtagaattataaacgagatggtaatattgccaaataaatgggatacaccctgcccagctccttcccattctgtcacacagtgcataggagcagttttgtaattagtaaactctatgtggccatgatctttggaatggtatgtatgggatataacttttatttccattaatatatatttatgattatgaaagtcttagatatggtagctgcgagaggtatcattttactggttattagtcttattcatatttggattagaactttatggatttccttgggcaattagggagataacttttaatggtttacattttgctccttggagttatgatgttacccagaagtctcaaagcccatcatgggggagggagaagccaactgaaatatacatggctctggccctaatagccattttagttggaggagctccagttttatctgttaaattagtgggattctacaaaaaattagtttgaaagaagattctgggggtaaaataaaatttgaaaccactggattagtagaaagatctaggagttagaagacttatgttccagttttggctgtcacattaactagttttgtactgttagataagtcacttaacatatttttctcagtttttcacatataaaacagaactaattcggtctgcctcacagagttgtccttggatagtggtcttaaaaactggtgaatcagtctgggcatggtggctcactcctgtaatcccagcactttgagaggccgagatgggaggatcacctgaggttaggagttcaagaccagcctggccaacatggtgaaaccccatctctactaaaaatacaaaactagtcgggcgtggtggcatgcacctgtaatcccagctacttgggaggctaaggcaggagaattgcttgaatccaggaggcggaggttgcagtcagccgagatggcgccattgcactccagcctgggtgacggagtgagactctgtctcaaacagcaacagcaacaaacaacaacaacaacaaaaataaccaaaaaacgatgaatcaaaatgtattaagtaatgaagatattgttaataatagcagcaatactccaataactgagaaattgaaaatggctttgaattttgttgtagaatttatcacaataacgtatggctttcttttttccaattttctgttatctaggcatgattgtttcttttttaaatgttttattttttgatattttattttttatcatttatttatttatttatttatttttgagacggagtcttgctctgttgcccaggctggagtacagtggcacgatcttggcttattgcaacctcagcctcctggattcaagcaaattctcatgcctcagcttcccaagtagctggacttacaggcatacatcaccacgcctggctaatttttgtattgttagtagagccggggtttcaccatgttgcccaggctgatcttgaactcctgacctcaagtgatttgcctgccttggcttcccaaagtgctaagattacaggtgtgaggcatcactcctagcctgtttccttatttttttaatgttagatttgttggccaccttccttaaaatttcatttctaatgaaagacagtttatgtatactcatatacacagcatatatagttgtgtgtatgtattttgaaaaacttatattgattttcttttacagtttctaagaacgtaagtagataaatgaagcttaatttggagaaaactttaactttctctgccattcccaagagaaatcaagctcagaatgcttgcatttatttccagcctttgaagggccagaaaattgtgcctgaaaattgggttagcacattttctgaatctgactgctgttaagttactctgtagttgggttggatgctatttcctgtcttctttccttcaagcagagaatatgcacttcacattttttaaggaaaccattcctagcttgtatattcatttacattctacatcttatgattgcaaggatacacataaagagtaggtcttattcagaaaagtcctggcagttgtcccagccttaaagagaacaagcctgtgctcttcccttttacctgatggaatatcactatggcctttctttgaggagttgattagcaaacttgactcagagaggaagtgagaatagcacattgtggttaggtggtgctggctgattttctagctcttgcacagcatatgcctcttaaatatcagggggagtaagctgctcttgcatcataccaccatggttggatagcccaagttgcaatttcaagtattgctggccagtttctggtacgtagttatggaaatataggaaagcacaattctgtctgacgaaggaacatatatatctgcttgtggagtattaagtgtgagatatgccaggtagtattttctatcttttggaagttaagaaaattaaatacctgaaaagaagtgttcttttttcttatttaaagctctttctactaaacacaaatatccttagaaccaagaattccataggaactatgaaacctaactggtcaagtattttctggcatagtaacatgtagttttattgcccaaaggccctcctgggaaaaatttatatagctagcaatccctttgataatcataccaatagccatttgttaagagtaccgcttagctgggcacggtggcttatgcctgtaatcccagcactttgggaggccaagacttgggggattgcgtgaggccaggaatttgagattagcctagtcaacatagagaccctgtctacaaaaattacaataattagctgggcatggtggcatgtacctgtagtcccagctacttgggaggctgaggtgggaggattacttgagcctagggagttgaggctgtagttggccatgattgcatcactggcactccagcctacgtgacagagtgagactctgtctcaaaaaataaaaatagaaaaagtacctattatatgccagttcttaaaaaatgtattttaaggtaaataaatgaagacaaaggtcatacaagttagtagcagggccagagggttgagtacaattctccctggtgtaaaactcattttctttccctatgttctcagtgaaaaatcatttataaaatatatcttttacttttcagagtatagtttctcttgaaaacaatttatgtgaagtgaaacctacttgtatttttcatggtgaaattagacataatatccctaaaaatgaaaacccaaaagacaaaatatttcaggaagaaaattaaggttggagttcttggaattatatatcaccaagatcaatttgccttgcttgaggattttagtatacacctgtcagtttactttttggttgtgtcatagtctttagtacaggaatttttctttgcccccttcccccctcccttttatttttggagacagtcttgctctgtcacccaagctagagtgcagtggcgcgatctcgactcactgcaacttctgcctcctgggttcaagcagttctcgtgcttcagcctcttgagtagctgggattataggtgtgcaccaccacacctggctagtttttgtacttttagtagagatggggttttgccatgttggccaggctggtctcaaactcctggcctcaagtggcctgcccaccttgcctcccaaagtgctgggattacagacatgagccactgtgcctggcctttttcttgcccattggtcactgttttcctcttcacactgctgtactctacccccagaacattacgaggatcttatcagtccatgccaccagaaactttgctcttcctctagatattcatgacttatacaggaatgcaatattacatttagtcagtagatgccatcatctaacatataatatgtttcagactggaacttctttaattcgtggctttagtttattttaaattaatccatttctactctctagattaaaaatcatgaatctcttgatttgttaataatgaaaactacttgtggtttttttttcgctcaataaattacatttgtaaagttgatgtgtgttttcttttgccagttttattaatagaaaagtaatcattgagctgtttttatgcattttgttagtattttgagatagggtctcactctgtcaccacgttggagtacagtggtgctatcatagctcactgcagccttgaccttccaggcccaagcaatcctcctaccttagcctcccaagtagctgggcaaacttggccaattctttctgtgttttgtgtggagatgaggtttcaccatgttgcccaagctggtcttgagctcctgagctcaagccatctgcctccctgtcctcccaaagtgctagtgtgtccggaattggtgggttcttggtctcgctgacttcaagaatgaagccgcggaccctcacgggtgagtgttacagttcttaaagatggtgtgtctggagttcgttccttcagatgttcagatgtgtccggagtttcttccttccggtgggttcgtggtctcgctggcttcaggagtcaagctgcagacttttgctgtgagtgttgcagctcataaaggcgatgcagacccaaagagtgagcagcagcaagatttattgtgaagagtgaaagaactaagcttccacactgtggaagaggacctcagcggcttgccgctgctggctctggtggcctgctttttattcccttatctggccccacccacatcctactgattggcccattttacagagagctgattggtccattttacagagcaccgattggtccattttacagagagctgattggtctgtttgacagagcgctgattggtgcatttgcaaacctttagctagacacacagcgctgattggtgcacttacaatcccttagctagacacaaaagttctccaagtcccctacccgattagctagacacagagtgctgattggtgcatttacaaacctttagctagacacagagtgctgattggtgcgtttgcaaaccttttgctagacactgagtactgattggtgcatttacaattctttagctagacagaaaagttctccaagtccctacccaacccagaagcccagccggctttacctctcaatggcactctccgggggactttgtggcacctagcctgggcactccggcaacccagaaggagcttgtgccccgatcaagcccagcaggtgctggcgggccgtgccgagtgcagggcccactgagcccgtgcccacccggaacccgcgagcgccgagcgcagccccggctcccgcccgtgcctctccctccacacctccccgcgagcagggggagccggctctggcctcagccagccccggcgacgggctgaagggctcctcgagcgcagccagagcggatgccgaggctgaggaggtgccgagagcgaatgagggctgctagcaagttgtcaactctcactaggactacaagcataagccaccacacacccggcctcttttgtgcattttgtatgctgccattgaggtaatggtgccactagtaaaagcaaccctttgatgtagatgagatagtaggtcagttacagcctttgtctctgaaggtatttacaagaaattgaaataacgtcttttatttttaaggccaaacaatacttcaaacctattttttctgtgacgttttaaacagttgagaagattgtctagtatccactaactttggactaaggaactctgagtctacagtctttcacccgctaaatacacattgttttattcaaagatgccaagtcctatcatcatcttgagatttgtccatgagtcagactttggaaataccagctaagccagtgacactggatatagcttcaggcaaagggaatagcttgtaccttggccaggtggagattaaacaagaacagcagttactattcactgaagatacttctacttaactaatggctagggagtctaggggtgtctctttaaaatatcagacttgagttcattgctatttcatatttctttgttagctgcccttccttcagttctttacatttttattttttaggactaaaccttgttgggagtcatttttcagtctcataaggaagaaggaaaagtctttaaatttttgttgttgttgttacaggtatgagccaccaagcccagccaggtcttattcctttttgcatcacaggtgcttatgacagtattaggcttagtggtgccatacataaacttgtcgcattaatggacaaactgaggatcaggtgttaggagaggcaactaattctgggtaaggatttgcctaactgattctctccagaatattagttccctaaactaataactctcctctaaaatcttgctaactaccttgactaagtacagattgaaagaagaatattaatgatgaatatgaagaaagttagctgttctgagagaggatcttgtataaatttacaagatcagtggtaatttgctttttggtaaccatgagaacattaagccatttgtttctgaatttatcgtgctggtgtttttggtatgtgtatttcattctttctggttaggctctatatctgttttttcctgatgctatgtcagtttataatagtcctgtatcactcactgtggcattgaggaatatctgtcataggatttttgttatatttttgttttttagtgaggtgggggagagggggaatccaaacattttccacacaaaaatcatgatcctcatgtagtaaagttttatactttgctgttttcatggccttcttgctgctaatctccaggtggtgtttttgccttttggcttccctcttgtttatgttaaatatgtcagtaattgaattccaaaacccttgcaaactttggcagccaatttataatcaatttgtttattctttttcttcattatgattaaccaagactagattttactttgcagatttacttaaatttgtggctgtttaacaactcttcattctgctcagttagtcttcgtaacattaggttagaagagagatgtcattttcaaggagagatctttatgttatgtctgataacctaatctgcctcctggtttatctcttgcatttgctgtttgtgtattctgtgttctgccttgatccttttactgatttctgtgttgacctctgttttttaagctaccaatttaagctggaagttaggcacagaatttagaatggttgaaaatagttctttaatatattttgcttttatagtgcctttcctccaaaaaagcttcctgcttttataagtagcttatttgtcttcctggcatctttgcagaatagatttaaggattgggattagtgtttctttttttacatttgttttctgaaaaggtgaacctaacattgtgggctagcagccagtgtcaaagaaaattgaaaagttacattaatgggatgcattccattccttctcccttcacctaccaaagaaacaggtgagaatgagattctgatcatttgtatgtagaatcttcaaggagcaagctcctaacttaaaaaaaaaaaaaaaaaaagacctgttttcttcctgaataaactatcaaagagcttctatcatcatagttttattaatttgatctgtgttacagacattggggaactaagattgtaattgcccgatgggttcttccctgcctgctgcacagacaaaaatcaattcactgagatcatggcattgcagtagggaaagggtttaattgacatgaggctggccatgtgggaaaaccagagttatcactcaagtcagtctccccaaaggcctgcaggttagggtttttatggacagtttggtggatgggggctagggaatgggtgctgctgattggttagggatgaaatcacaggggtgtggaaaaactgtccttacgtgctgagtctgtctctggtggagccacaggaccagttgagccatgaatcacaggtctgggtggggtagatctgaaaaacatctttaaaaaattaatcttagattgtatagtagtgatgttatctgtaggagcacttggggaagttgtaaatcttgtgacctccagccacatggctgctgagcagtaaagatttatagaaactatacctatatcttagcagagttcaggcccctcccataatcctattcttgtggcctttgattagtcttacaaaggcggtttttggtccctgagcaaggtggggattcgttttagagagggactattatcatgcttactttccttcttcttttttttttttttgtatttttagtagagacagggtttcactatgttggccaggctggtctcaaactcccgacctcaagggatctgcctgcctcagcctcccaaagtgctggcattgcaggtgtgagccaccaaatctggcctcctattatcatctttactttcaagttaatttttttttttttttttttttttttgagacagagtcttgctctgtctcccaggctggagtgcagtggcgccatctcggcccactgcaacctctgcctcctggttcaagcaattctcctgcctcagcctcccgagtagctgggattaccagtgaccaccaccatgcctggctaatttttgtattttcagtagagacggggtttcaccatgttggccaggctggtctcaaactcctcatctcaggtgatctgcctgtcttggcctcccaaagtgctgggattccaggcatgagccactgctcctggcctcaggttaaattataaattcctcccaatgtcagcttggcctatgtccaggaatgaccaaggacagcttggaggtcagaagcaagatggagtcaactctgtcagatttcccttactgtcataattttgcaaaggtggtttcaagattattagtatagtttttacagataaagaaatcgagtcctggttaagtcatataactttattctaactatccttcagcaagtgctaaaaatagttctatgctataaaggtacagaaaagtaaagaatttggtctggctatggataagacaggtgtttgtatgtgtaattctgaccaataaaattttatgatagtgtgaacaaaagtgctaagtaactaaaagtcaaggtaaatgtgactagtcaaacaaaagagttcatgaaatcatgacttgagatgggtagaatttatccagagccctatgacttgtaagagaattgggatttgtgtacatcatggtgttcattatatactactattttctgcctgaaaattaaaattagagtagaacgtacgatgaagcattcattgaagaagtaaagagaagaccttatgaatccttatgcctactatattgtcttgatcttctgaacacagtttattttccttcaatgaattttgacaagatgattcagagaatttagcagatggcagttttgaggaaagaacagatgcatttcttttttctctctccagtttgtgatttataaagcagtcacattattcagttgtttcactctctgcaatagctacagcattggagtaggtgaactaatacatgatttacaaagataagactaagcaaatgaagttcttgtgaagcaaataaaatgtttggtttctctccggtatctttggatgcaaagtagtggtggttattcctaccaccaccccaaactgcagacacgagccagagttccttgcttgaggaagaagacattaagaaacatttatttgttttgccagataccaaaaagtattcaggagagttacgtggtccctacccccgagtcccttacaatctggttgggaagacagaaatgaagaacataccttaagtctgcatattgctagtactttacaatttatgagcacttttctcatacacagtcatgtatcccataatgatcttttagtcaatgacagactgcatatatgatgctggtcccataagactgtaatggagttgaaaaattctcactgcctagtgacattgtagctgttgtaatgtcatagtacaattactttatttagtgtagtctaagtgtagaatatttataaattctacagtagtatacagtaatgtcctaggccttcacgttcacggaccactgacagactcacctgagcatcctccagtcctgcaagctccatttatggtaactgccctttcttttctttctttcttcctttctttttttttttgagacggagtctttaggctggagtacaatggtgaggtcttggctcactgcaacctccgcctcctgggttcaaatgattttcctgcctcagcctcctgagtagctgggactacagctgtgtgccaccacactgggctaatttttgtatttttaggagagatggggtttcactgtgttggccaggctggtctcgaactcctgacctcgtgatccacttgcctcggcctcccaaggtgctgggattacaggtgtgagccacttcgcctggccggtaaatgcccttttaccatttcaaaatctttttatactgtatttttacactgtatattttttgtatttttatactgtattataccttttctatgtttagatacataaaatacttaccattgtgctatagttgctcaaagtgttcagtacagtaacatgctgtacaggtttataccctaggagcaataggccataccatgtagcttaggtgtatagtaggctataccatctaggtttgtgtaaatacactctatgatgttaacataacaataaaattgcttaacaaatgatttctcagaatgtgtacctgcaagtgacacatgactgtattctgtttcaagagagtcttggagtcaccatccaagctgcccagttgacagactagaagccacatgatttttaagttgatgtgaatgaggaactaaatttcttttttttttttttttttgagatggagtctcgctctgtcgcccaggctggagtgcagtggcgcgatctcggctcactgcaacctccgcctcctgggttcacgccattctcctgcctcagccttcagagtagctgggactataggcgcccgccaccacacccggctaatatttttttgtattttttttagtagagacggggtttcactgtgtttgtcaggatagtcttgatctcctgacctcgtgatccgcccgcctcgccctcccaaagtgctgggattacaggcatgagccaccgtgctggccaggaactaaatttcagtacttgaattgctaaatgttatgctatggactatggacagtaaaatattaatggtcatgcaagaatgaggtgaccattgttcattgagagattttagggggtttacaaactccctcaaattgtatggtaaagtttatacgtgtgtgtttctagaacgttcatagttttcagcagatttttttctcgtttttttttttaattgatgtataattggcattcatatcatcagattttgaaagtaagtccctggccttggaaaaaggttttaaaactacttgtcttgagtatttggaaaacatttcttagagcatgaggccttggggtgagttctgaaaaataagcaaagagagagcaacctggacatatacaggtgacagcacctctacttttcataaagtatcccttcttccctttactgtgcctcctgttacaagagtcctaattgatttggatatagtggttactggtcacatcatagtcttaataatttttagatgttattgaactagtagagtatttttctagttaaaatgggtgagggaaatacatttaagaaatcacattacatgcaatagaaatgcaagtttaaccagaaaattgaataataattaattgcccaatactaaggatatggtatctacatattttaacccagaagcttatcatggaccagaaatttctgagaatataattaccaggaaaaaaaaaaaaaagacctagcccttgctctcctggagctttcaaaaggaatcccacaaatgtgtgtataattttaaaaactcagctatgctcttagatgtctctttttgggaaaatcccaaataagattattgacatatattggcaggccccctttcagatagttgttcttttattagatgagtggattatcctgggggtttgggaggagggattgtcccccaggggacatttggcaatgtctggagacatctttggttgtttcacctcggggcatgctactgatatctagtggatagaggacagggatgctgctaaacctcccctaatgcacaggacagccccacaacaaagaattttccagctcaaaatgtcagtcttaccatggttgagaaactctgccctaggtgaacatttcaaagtaactgaaaagttaatattgctgaacaggcctttataaggtagaggcagcacttactcaggtattccagtactgcaatatcgtaccatcttatggttctagtgtttcctcattagtaggtttcagactttattaaaagttcctctggtatactgaatttatattctgcttttggtccatttcaatggagtgattaatgtagtaggggataatggctaaggttggaagttggaactctgcttttaaaagaaaaaatgccctaaatttagtgatatgattaatatattgttattattatctgttgtcagttttactgtaattgcatgaatatatctgacagataaatcaaaaaaacatgatcagtttggactgacatacaggaaggacttagaaagtaatcaagataggtatttctggatgaatctctataacagcgcttcactggctttaacatgcagatgaaacacctgggaatcttaattaaaatataagctactgattccatacgtctgaggggaggtctgagagtatgcctttttatgaagcttctgggtggcaagtccagatgaagcattagatcattgcaaaaataagtatgctttaagtatcactttaaccaaaaagaagacaataatttttaaaagactttctggctttttatttatttgtaatttcattttttaattataaaagtgacataactaatgttggagaaaatttgaaaaacagaatagaaatctctagtactaataatgtctgccatctcaatgaagttgctagtattttgtgtatctttcagttattttatcctaagcgccaattaaaaatgttcttaaaacactgtatgcattatacaacttttcatttgcttttgttagggaaaaagggaagaaaaacattctcctttatagttttctcacttgtcttctctgctactatgttttgttattcagccttgaataattcttttcaggaaagaattttttactcctttaaggaagaggcttgctgagagagatcaaggatcacatgccttgctgtagaaacttcattttgtaagctgacttatgtcatgtggtagttaaaaatatatttctcatcactgggaaaactaaaatgagaaaagtctgtccctttaaatttgattttgtttctccttgaagatgcgtgactgatgttctgaaacttgacctagtcgaagaacatgaactttttttttcttaaagaaataccttttcagaagatcaggacttgtgaatcaaaaacaaaaacagaaacaaacagaaccccttttcttccttaaaattggcagctttttgacaaatatgtggttaaagtacaagtttaccttgatatgtacaggtacttaaaatctgtaggtgaaattgttattatgaatcttattttccatttacttgtattagttcagaaatgccctctaatgagaagactataaagaagtttacagattgttagagaaaattaccctttgctctatgcttttaatgcagcttatttacctatattttatttaattatattttatttatttacctgctcaccttagataggctcagtatatttcatgataggcttctagactgacaagaaattaacttacactctggaggggttactattattattttaaaactccatgtaacttataagccatctgagatctctgagggttcagtaaaccatacatagttctttaatctcaactcataatttgtagaaagcatcgtgtttaaagaaaaattgtagagtcattttataaagttgtaagaaatgttattgctgttctgaaaactaatattttttcatatatgc

SEQ ID NO: 23 - DNA, 228968 bp, Homo sapiens
aaaacaggagtaagattgacaaaatgccaacagtctatgtaaaggtttcatgggtgacaggacaggacatggctgataacaaaaggaaacaacaaacatttttgtgtctacctccacctcctactcacccatttcctttcattaaaaacagggcagtttgttccggcactgaacctgaggtttgatatgcaagcacccttaggagaggtgacatgttaatcttcaattctagtaagtgtgaataattcacatctgatcccaacttacaagcagattattttagcaccagaaggaatacatgcaggaggtaatggagtgacgtccccaaagaagagatacccatgaacaaagttcaaactgcagagataagctgttggagcccttgtggtcttactctttagtgaggagagacaaataataaaggtaataaataattaaattatgtattatgctataaggtgatgagtcctgtagaagaaagaaaacacagagcagagtaagggagattggagtgctgggtggagggtgaggctgtgatattaaacagggtggtctgcgtagggctattaggaagatgccattagaagcagaacctggaaatgaggacacgagccagtcagatatctgggacagtttgccaagcagaggatactgccaatgcaatggccctggagcagatgttgctcagaatattggaggagtagaaaagatgccagtttcaggagtggtaagatgaagtagaataatcatgtgatgatgttagagacagtcctaggggaccagaacaggggggacaagcgaagagttcagactggagaagtgctaagatgtgacttacatttaaagaatcactctggccactcagtggagaatagactgcaggggcaagagtggaagaaggagaacagtcaggagactagtacaatattccccctgggggtggtggcaactcagaccagtaggtggcagtagaggtattgaaaagtggccaaacgggggtacatttgcggctagtgctaaccttatttcatgaaggattgaacgtttggtgcaagagaagggtaaaaattaaggatgactccatattctttagccagagcaactggagggggagagttcctattagctgagaagaggaagactgtaggaaaaactagttttgggggtgggggggtgggtgtgaatcaggaggtcagctttggacaagttttgacatatatatcagatatcccaagtacagatggacaagttgacagtcaaacataagtttggaattcagggaagaggtcctggctgtcataagcatatagatggtgtttaaagccatgagtcaagtgaattttctaaagtgagagaaaaatacaggtcagccacaagccagaaggactctgattatctcattttctttcttcctctctctctctctctctctctctctctctctctctctctccctctctctctctctctctccttccccctttctctctctctctctctgacaatggattctaccaggttcttttttattttaaaaatgtaagcacaagtaaacaggcttgttcacatcatgaagtcaaattatcccatgccatgtccctttagctgtggcctgctaaaggcttgcatgaacaagcttaggagaaaattcctaaaattctaactgagtaaagatgacaatgcagagtataatttgagtaaatgaagtcatattatcgtaatagcagattgccaaaagttaggatgtaactaaactcatggaaaatacagagccaaagaaacaggagaagtagcagaggaagtgaatgaatagaataaagtaaataaatctgtgacattttgccttagaggaaaccactcctcccagctgtccttgggtgttttatgcccccaagaagggatggaaatcccaagagattgtgcccaggtgtttccacagttataccgactgtattagtccattttcatactgctatgaagaaatactcaagactgggtaatttataaaggaaaagaggtttaatggactcacagttccatatgactggggaggcctcacaatcatggtggaaggtgaaagaggaacaaaggcatgtcttacctggtggcaagcaagagtgcgtgtgcaggggaactgccctttataaaaccatcagatctggtgagacttattcactgtcatgaggacagcacggtaaaaacatccactcccgtgattcaattacctcccactaggtccctcccacaacatgtggggattatgggaactacaattcaagatgagatttgggtgaggacacagccaaaccatatcaccaactcctccttcccctaccctaagtttactttttattctagaatcgaacttttgccatattaccatatataagttgtgaagtaaatacaaatcgccatgtggaaaaggaaattaactagcagagtgtagaattaatttatttagccaggttgttgtgccactcttgccctgcttcacccttaattttttgaatgactacctactatattcctaaagaatggagagctatttggaatccatcagtgactttaatttgctattagaatgtaagttacactcttttgaattcttctgaaggactcctttcccttcccaaaattctagtttccaaactgaaatattaaaaaatatttctgcaagttatttttcccatactctactgtaattaaaccactatttgtggttccccccccccccacacagacacataagccccttgaagatgtgggctgcctctcttctgtttgctcttgtgtctccaacccctaacggaatgctcagcacatggcaggttctcaaataagacttgactgaacgaattaatagaaatgatgctaattccatgtacactcaaaagaatacctctttgaaagccagtagcttcactctcttctgccaacccaagacttcttcacatcatagatacttacaaataagttacagtaagcaacaatttataagtaaacacagtgtgtcaatgcatgccaaaaggatgattacttttcttggctatccatagcaggacataaaatatgtccttagatttattacagatggccagccggtatgcaccagagaaaatagtggaatgggggaagccaaaagttgtgagtctgtcataatgatgtcaagtgacacactttttcattgcgatctaggtgtaccataccttagcaaaaacaatctattttccatttctggatttcttaataacttaaactatataaataagctccttttccatcatatgaactgttcttacatattctctggccttcctttgtccaaatgttgagttgaagttttcattgcatattctctgtgcactttgcattacctaatggtttcctggctcatgtgagagaagtcagcgtcagcagtcgggttttgccgagatattttcttgtcctttccagcatagagctctacaaacaaaggcagggttatcacatgtacccgagagctgcctgggaaaagtgggagctatagttatcaaaattggaaactttatgaagtatgcttttgtctccgtttttgttgcgttcaatcagatcaacaagtgttggctaagtgttgagcgtggtttcctgtgggattgtgtaaggctctgtaggacaataaacgtgttgggggcactgagtaatgtagccatttctgacccggcagccaggaaaatgtgaaacaatttgcttctggaaacaggacagccggggccgtgttcctgcaacagcagaccaagcaccgcggcggacccaggcaagcacggaacaagctgagacggtgcgtttaagcggcaggtggctactcagtgtcgcatactatgcggaaaataggtttggttcccggtgttgtggggcctgaagttacaaactttgggaagctcactttaagaaaaatagtacaacatttttaatatgaaattgccagggctttctctgggactttagatgggaccaggtaatttggaggccaacggctgaaactgctataatttcactgtaaattcactccttgctcaaaatctcagttagggaagctctcaggttgtttatgtatcaccaccagttctacctagctttgtgtgtattctctgctaattttctccatccgcttctttaggtattgcctttccatagcctttcatattggcctcataactgcttccaaagagacatagaaatgttccttataccttctttaactgtgtttttatgatgttactttagctacaaatatttgctcttaggttcctgaggtctccctaaatcaagtgctttgtgtattttagatggagatagacaggtgggagggaggtgaaccatgcagttgtactcatatccatataattttgaaagattttgtgggccacaatgatttcattggatttgaaaaggagtgcaactttgtggtccatgtaagtgcttctcaagctttcctgtgcacgtggatcacctggggatcttgctaaaatgaagatttggctgcgcgaggtctcgggtgggaactgagagtctgcatgtctaatgatcgcccggatgatgcaagtgcacggaccacactttgagtcacatccaagtatttatttgtaggaaatatggtggcacaaatacacagtcaataagggtatggttcaacctcattttatggtaactcgtctcaggatggaaagtctgcgacaaacctactatgtatggactggtgtttgttgacatggcaatacatgaggaggtcttcctgcctcccattttctcctatacccaggagctggggacagagggatgagaagtaaaattttatcattaaggatcattattatttcactgtctttagttttttaactttttatggtcctttttaaaactttgcctatggagtgatcagaagggacataagcttttagaatatctactagggtgttgggcattaggctgccattttctcttgactacttgtaacccttcgaagtggttattgtttcactgcctttacagatggggaagctgaggtttagctgggttaagtaacatgacagattccatagagacagagcagggattcgaacccagctcggtgctttcacttgcactaaccggcatcatgaaagcagtgttacatgtttaattcagcatgagatgctagctcatggatttattactttttgcttttctcctaaggaagttgcccagagagagtgccctaagcagaggagagggagcagaaagaaagaggttactgaaaagaagaaaagacttagaaaagctctatggggcactgaagattaatctcacacctaaagcaaaacttagctccaaaaagactagcattaagattcttgccttctttgtgagaaaatgatcttcccaaagtgtctggtttttatacacttattttggatcaattaaggtatgatgctccaagatgctgagaatttgactgtcaatgttaaaagatttctgtccatatcatgccaagatcaactttaactttccctctcctgcataacatcatgtgaaataaggatctgtcaggttctgtgaagccagtatttgtctttggccagcatcctaagactttttgaaccactttacttgatcctcagtcaaactttttgttcttgtttaaacctaccatcacattttgttcagttatttagcacgaagataagcgggcctggcatttggacaaatatttgaagatcaagtttgtcacagggccctccagtttcccttccagatcccaccccacttggagcgtcttccctttctttcccacccttcctgctctactgccctcccaccacatgtattattttaacatcttgacacctacaaaatctttagctatatggcatgtaaagtaagagaggataactaaaccaagtcaaagggtaaggaattgctatccttatctctgaattttaaaagataaatctttaaagacaccaccctgagccagtcagggaatacacttcctggttgagggaactatccaatggccacttaactagataaccctgtctcccttggtatcctgtttcctgctccccttctgtaccactgagaatttattccaacttttgaggttgtatgttcttacctattttcagaatgtggtttcaaattttgctatttaacactgcctttcagcaggagattcctatcgaaagattataggtaacatctttctgatatttccaataaaatgtctcttgcactggtctgttaagactcagatttatgggtagtttcaccaaactatgtcccttagcaaagctgtagtatgtttggctgaacacacagatatctcctactctgtttactgccatcatggagtggatggtgtacaggtatgacacctgaagctggctcccagggccatgcctcttaggtcactggttaacagtactggctaagtcacttaggctgctggggctcagtgttacatctgtaaaatgacttctaggtttcttataagatttgacatcctatgactgccttcctgtatttaggttagagcagtctctggtttaggagggtcacacagcaggcatgtccttctctagcattagtagcgtggtcacgaatatgggatgtggagttagactgccgggattcaaatctagctccacccactagcagtgtgacctgggcaatttatttatctattgcagctccataagctataagcagggaatgatgttacaacttactctatagggtgaatgtgtcacaacctatcccatgggctgggagtatcacaaaatatcccatagggtgggggtgttctggcctaccccataaggtggaggtgtcatgagctaccccatagagcagttgtgaccagtaaactctaaacagcctggcacatagtgagccctccttaagcattggctaggatcattatcataaaatcactctcatccttcaaagtctaatttcaatgtgctcccttctaaaataccttacttggctaccttaaggaaaaaacaacttttccttccttggacctttcatagcaaagtgaatagactctactctagcacctacatttttttccccatcttttcttttttaaaacatagttggtacccacaatgtgccaaatactttcaccataaggtttctcatttaagtcccgtaaagtaagagagttgttacctatctcaatttacagatcagaaaactgaaggttagtgcagggaaggggcttggccagggtgacacagtttacaaatgacagttctgtaacctcctccatgccttccgagtctgccaccccacagcaatctttcatattaattagttatgcagcccatctctcaaacttgttcattgtcactcagggccacggacagctgatctttatttctggaaccagtcactcaatgttggacacactgtaggctcaaaatcaagcatgccaaatagaactgccgacttgaacttcttactctcatgacatcatttccttataaatcctaaaaaactatagtgattataagtcatgttaattcaacacacaccttttatgtatgtaagaggttaacgaatggctgctggcttccttataggaaatactatattgatttctgccaggtttttgtgtctcctctgtgccttaatcactttctagtttcatctgtttatggaaataggcagcctgggctatttggtaagcaaattgataggtctattctatgtgggtggtaatatgagagtccacccagatcccactagctcttctatggaaatagatttcttgttaatactgactgggtttaggatctcattttactataaaaggttttttgtttcaccttcccaactgaattttccctaaataagcataagaagagcagggtttgctagttgttggacaggcatttgacttaacagtaagccctgtttatttattgtcacaatacgaggggggaagatattgcatttctaaaaattaatcatcagcaactatccttctatatcaagagagaccacagaaatgttttcaaattagaatttaggccatgtagaggagaaaggagaagtataaggaagggacagaagtaaatagaaggagaaaggcaagcccaagcctgagcagaaaccacatggtttatcttagaagaaactgatctggaaatgaaaaaagcttgagtcatcaaggtggggtccttcaagactgttaggaagcctcagtagcccagcttagggagtggagctttgaaggactgttcctcttggatgggtacctcaaaaacgtgtggcttcaggtgtttgttacacgagaacaacatattacggactcaagtgcacagtatgtgaacccatctttgagaaaataagcatatgtacataaatatttgaaaagaaaaacatctagagatgtgctgtgtttttcttttccctgtctgtatctcttggctttatagaataaacatatattgcatatgaatcttaaaatgaaagcaaaaaatgtataaagggcaggattttgaaatgaacaattatgttgaaatttcacaagttatatttcatcagatgcaacaacgcttgtaaacccttggaggtttactggagaaggtgcttgagggctcaataccttcctttttactcaatgttcttcctttcaatacacagaggcaactttgtgaatttgtcagtggtctctgtgactcatcttattaattttttatataaaattccaaaaattctcacctttagtgtgatgcacataaaagttttatttttcttttcttcttctttctttattattattaattttttttggaagacagggtctcactctatcgcccaggctggagtgcagtggcgtgatcctcctgcctcagcctccctagtagctgggactacaggtgcatgccaccatgtctgctaatttgtcaaaaaaattttctagagacaggatctcactatgtttcccaggctggtctcaaacttctgacctcaagcgattctccctcctcagcctcctaatgtgcaatatgctggggttacaggcatgagacactgtgccctgcctaggtgtgaaagttctatagacagaaaaatatgtataccagcacatagtactgggaaagactgaatagcaccttggacattgggatttttacatttttaatacagtgttgttaatgtcacaaatcaattcagcatctaaaaaaattaaaaagtaaattttctattcaactaatcagatctatttaattagcactctgctttgaggaatgatgtttcagctgtggatataaaaaattgacaagagttttcacagttttctccttctgcttcattagtaaaatacggaaatataaaaggcaaaagtaccctacaaccatgtccaatgtgatattgcctccccaaaggaggctttcactcaaaaaaagtagaccctcattgtttccataagtctccgagcaaattctcttccggccacagactttggatgtagaaaataagcttatctgggcaggtggatatgcagagtttgcaatggaagcaaagataaaaggaaggcatgctactcttacctccataggctctactctaccctgatctctgccctgtctttgatcactgggcaaagaaaccagtgaccatggcaaatagtacccattgtactcagaagaaacccattatacttttgtgaaagaattatcctttttaaatagctaaaacaatatcccagggaaaaagtaaccaagactttattatattgaatggataagatttccactacttctgtctaaaaatcaaataatgcccttggaggacattttaggaattaataaataatcttttgttctacatagtaaataataaaagctggttttcttaattccactttgagagttgtgtggtctatgttaggaggaaagctggctggagccaaccatggttaattcaatgccaggctgtatttcttagtctccctttcatttcactcttctgccatagtgggtccatcatactcccaggccagtgagaagtgccctctagtgattggatgggttcgcttggcgcccgcctccatgcagacagagcaatgcctgtgtgggtgcttcctgatcaagactgatgagtgggatgcaaatatcttctttttaatgcatgaccctggcatagccagagggaatatgagtgatggtgcctcaaagcagtaactttttgcttagagcttgagagtcaaagttaaggacccacatgtatacttcggctctagcgagtctaaggtgagtaaagccttcagattatcaataaagaaagattttaactattgggcatgtgaattcaaataacgatgcaatttcacaaagcaaagaagaacataagaaagtttgtttctctggcctactgctcaacattgctacttttcatgatcagacctgatattagactgagggttgaagtaactgtcttagtagaattagaaaattaatgcatttatttttcagaaataccttaagttttaatgttttacatgattttgggataaaaaggaagagtctttttactttgtaaatgtactcattttttcagttcttttaaatctcttttgatagcatctgttagtgcaccctcatacattttcctcattttatcttatcttaggcatttactttgattttaaattctcatagatattgaaaattatacctgtgtaatttatgttaaagatctggccatgatcaggggctgcaggtgttatttacaataatgtcagtgtctcatagtggtttgggtaatttggtcaaattacaggccgttacttcataaattgtgagctgtctggagttaaattttctgaagttttattatatccaattcaattcaaccaacacatatagaatgtttaaaaagtaaggagcattttgataaggtggtctggagaatggggcaaagatgatgaatttattatccacagtgggaggagtcaaaagtataaagtgctttttaaaaatcaacatatttataaaacccaaagcaaaggcagcagaaaaactgtagctattgtgtaatttattctataatcctacatcagtctcatttattaaaatcagcatttatattatcccttaataggaaatcgttgaggaaaagatatgaaggttaaagagaacttacctagatgctgcaaatactcattttaattatttattttgtttaggatgataatatggatacaaaatctattctagaagaacttcttctcaaaagatcacagcaaaagaagaaaatgtcaccaaataattacaaagaacggctttttgttttgaccaaaacaaacctttcctactatgaatatgacaaaatggtgagacatcatgtgttccattatttttatactatttattatttttcctaagtctccacaaagtacttgatcataatgaaagaatatcaggtttcttaacttacactgtgaagatcctcttctatccacttatcacatgaccttttcttaatgaaagtataatgaattcaagataaaggattttaaaacattagttaactttactaaggcaaattataactttagaacagtggttctcaactgagggcatttttgctccccaggtgacattgggaaaagactggagatattttgggttgttccaactgggggataggaacagtaagtgttaaagacatctagtgagtagaggccaagaatgcagctaaccatcctgcagtgcacaggacagtcctcacaacaaagaattacccagccttaaatggcaatagtgccttaaaacaatgctagaaataagactattcctgtacagttgagaattctactatagtaaaaacactgaaatactgtcataagactgagccaaaatgaagatgctttgcagaagttaaatcttgattttcctgagtatattaaccacatggtaggtgatttgaaacacatttcaagataatcaaacaagattattaaccactggaatatatgtgtttgtgtccagactcaaggaatagattatgttgtcattggattttgactattacggggtaataggaagtgactctccattgcccaccccccaccccaatctccctctcaggcataacttgggctttatgcctttccttgtgcaccatgatgtattgcaggaagtatcttacattttgttttttaattcagaaaaggggcagcagaaaaggatccattgaaattaagaaaatcagatgtgtggagaaagtaaatctcgaggagcagacgcctgtagagagacagtacccatttcaggtaaagggaagaacgacattgcattgggtggatagttcttccttcaatttttctatcgtgaactcaatatatctaggaaaaataatgatatttcaaaataatctaaacaaggcttggaatattcccacatgggagttgggcattttgctaaaattctgtccaccaatctgccttccctggagggaagggaagggaagcaagacaggagcgtaagtcgcagtgacctgacctgcctcaggtctgatcatctcttttaacaaacattgctgagtatctccgatgtggtacacagtagtaggcatactatggggaacaaaacactgcccctaccccaaggcatttacagggaagtggcaaaatagactaatacacagaccattacaaagcagtgagggtgagagttaaggtggaggtcagcagaatgcatccatggagtcccaggatgtggaagtttcattcctcactccaagaggctagagagatattctattggaggtgacactcaagttgagaaggacaagtaaaatttaacccagcaaatatgagaaggacagtggtacaaaggaagcagcaggtgtcaaggcactgatgagtgaaacagtatgacacatttagagagcactaagtagtccctatgaataaagaagcccatgtgacagtgaaagagatagcctggagaggtgaccatgctaaggagttttcattttaccctgaagtattttaaacaatggtatggtatgtagtgtatgctggtagtaccttttggaagtggcctaatctaagtcatgccctacttttcttatagcataaaatcttacatttctgatccaaaggtagatggattgtctttcagatggcctgactacccagtgctagtattaggaacctgtggccaaaaatgaaatacaataatccagttgattaacaacccatacttcccatttggaaaaaatattaccaggccaggcacagtggttcatgactgtaatcccagcactttgggaggccaaggagggaggatcacttaaggctgggagttcaagactagcctgggcaacatagcgagacctcatctctacataaacattgttttcattaaaaaaattacccaattgggggaaaccaggggagggcatgctcatggaagatgctgcaaactcacctcatagaggcatagtgctcaaaagatcacaggctttggagcccccagagagttcctagttccaccacttatacttgtgcaactgtaaacacatactcaacttctatttctcacagagttgaaataagattaaaatactgaagtagctaggaaagagcccagcaactagtaagtgtttaacaaatgctgtgtatatttaccaacaagagttgaataaactagagaaggatctggagaagatattgtaatcttcaaacgtttaaacatttgtcttaagaaacagaaaagtatatattctggagattcctggggtgccacatgatgaaatagatgaaagtaacagggaaacatatttttactcaatgtaagtatgaactgtataatgatcagaatatatggatattggcagagatgacatagcagagtaaagaacattccatccctgaaggtatttttaaagatagagcagttaaacattttccagtgggctgtaaggaaatcatgcactgggtaggcaaatggaccagaacaatactaagacacgtgtaatgtctaacatattaatgtccatagtccagggtgtccctgatgagaactcagtgttcaccactactatgaggtacatcatcgctgtaattttccaaagtataggagtgtctgggataaaacaaattgataactggaggattttttaagaaaatttttttcatctaattccagagctgatgtatactgtataagcaaactcaaggtttcttttggatgacaaaaaatttgcaggtgcaccaaagtgaagtatggtgcaattatatataaacacaccaaatattttcctttccagattgtctataaagatgggcttctctatgtctatgcatcaaatgaagagagccgaagtcagtggttgaaagcattacaaaaaggtaattcaaaaaaagaaatgttgaaagagaaaggtcaaaaaaagccataaaagagagtcgttttttgaggcttggtggaggaaagacatggcagtaaaaagactcaatgccaagagacaatctactgattttcctaccaacctcagggaatgtgtcagactcatcctcatttttgctttctcattgttacatacaggaagcctgtggattggattccctggcccacacaaagccagtattgtgccttcccagcagcttaggggaagccaggccacctgctctccactcagtatgcttgcctttaccaggggaaagtctaggtcatcatggggctatgtcaagtcctgtagctaccacacttttgatgtttatagaaagttacatctaatacttatactgagcatttaccatttgccagctactttatcaaatgcttgtaaaacatttttttaggtaaccctcttgacaactctattgaaaggggtaatattattctccatttttcagacaagtaaagtttttaaaacatggccactgtcatagatacagtaacgagggactcagaactcaattacctaaacctgattttttaaccaatacattgtaaatgctaggcaaaactgaagatttaatgaagcttttattcagtgatgtttaggccgccctggtaacaacttttggtagaagggagagaatcattgttaatgatttggcactatagtatttccctctgtgatattttcaagatgggtaaaggtgtgaagacaatatttaactcaaatgaatggctccatttgtgaaatttcaggtattatgctcctagatggaggaagattttattttattttattttattttacttaagttttaggttatggttctttcttagtacacctcaaattacacacagttactccactttgatgcaaatacacccttctcacacatagggcttaatttttcctttgcataaaaaggtttagcaacccattctgcgggtagcaagtggtccactgggggacagaagcttccctctacccaccaccagctcattgaaatgagaaagacaacccctctagagttagacacacctgcagcaaagtgctgctttgctgtgtcacctaataaaatcatctaccatctctgggtttaagttaatcctgacctgtcaaataggagatcacatttcttttctcctagagcagtcacgagccacagatgagacactcataaatatattaaaatatcttatgcacaaacatgagtcactgtggttactgtagggcttctaggaggagctctaagattctgcttcccatttagtctcctttggtggaatttcctgagcggtaggtgctatgtcctatgtacagctcttggtcatgccctgctagatctcatgtgtctgagcagctcatgtgaagacatacgaaatgtaaaggaagagcagagaaagaagcaaaaacacatctcctagcccctcataaaactgcagagagtccccatcactacagctgccatatgcacaataagtggtttgtctctatgcacagtaagtggtttgtatcagttagtgatgttttgggctgcaggtaaaaagacatcaaacagttgctgaaacaaatccacttttgttcttctctcacagtaacaaatgcaaagataggcagtcagtcaagggctagtgcagcaactcagtgaagtcagtagggatgcaggctcctcctagctttctgctctgttatccttagaagctgcaggagagattccaagccttcccagaagcctccctgcaaacttgtgcttatgtcacatcatccagaactatatctgatggccattgatgtgtacaaaggaggcaagaagacagtatcttttttttccagtctctgtgctggaagatagtgagaaagaaggtgcatgggatttgctgtcaagttggccaaccaacctgctgcaggaaaacaaagaggttctcctgctcaaatattctcccctacaaagtttcattgtgctataatggctcctcctgccttttgtgtctattatttggctcaagcattataaactgaggtagacatttaagatagaattttccagatgttaacctacacttggaaggtttgggctgattcagtggtagcataggagtgtgtgtcaattatcatggttctgaattcagctaaccagatgtggaaaaaatgtgctcttccttccaaaaattaaaacagaagggggttttgcagaggagttggcacctgtacatcataatgtagtagaaaaagcctgaggctgagtctcaggtctgctatttattaagcttgtgaagttgagcaattgtactacctctctgcacttcagtttacctaactctgtgagaggtgtaataacaatagctacccctcaggttcttgaattgattaaattagaggacatatgtaaaggaaaatacataaatgtaaagtcctatggatatatgaatatatgagttcctcttattgtcgttattaggtggtgagactgttgcaatgtagacttttggatttggttggaaaaagaattagttacccaggaaaccaaatccatgtagtaaggaaataataggaatcccaacatgtggaggccagaagcttagagagcaggaaggcaagtaatgtgcccaagagattgcaatggccatttggaaccaaaatcagaaacttacgttttataattttaactctttttgccttttgtgatttctgtcataatttccctttaattctcattagtaaagttttttaatgccagcattttcagctaaactgagctaagttaaattaagggaatgatatcactaaagcccactgtttattgaacacctacttactctgggccaaacactgctgggtgctttacatacattatctaacagcctcccaatgacccagcaaagtaattattatctccatacgcttccttgagtcaggactgtaaggataagcataactctcctgggatcaacataaggaaatctcaagatgaacataaggtcaagagagaaagagttaaaggcacatatagaaccagcccttctcacctagatactcttcttaaaatatactaagatcttgtaggtttctctgttgtatttcaaaagaggctaatttgttatagattacagtttcatttatttgaattatacattgccctattcccgtggctttttaaaatatgcacatattcctaggaaagtagccccataaaccattcattccttagtataaacatgtcaaagtcacagaagtcaaggaagggatgagaagcagttctaaattaagggaaactaagtgccatgtttgattttgaattggatccttgatcagaaaaaaagtgagtgattataaaggccattattggaataattagaaaaattttaaagatgaaatatattttaaataataaatgcagccataaaaaagaatgagttcatgtcctttgcagggacatggatgaagctggaagccatcattctcagcaaactaacacaggaacagaaaaccaatcaccgcatgttctcactgataagtgacagttgaacaatgagaacacatggacacagggaggggaacatcacacaccagggcctgttgggggatgaggggcaaggggtgggagagcattaggacagatacctaatgcatggggggcttaaaacctagatgatgggttgatgggtgcagcaaaccaccatggcacatgtatccctatgtaacaaacctgcacattctgcacatgtatcccagaacttaaagtaaaataaaaattaaaaaattttaaaaattaataataataataatattgtatcagtgttaaatttcctgagtttgataatcgtattacagttatataagggaacatccttgttaatataagctatgtgctgaagcatttatggatgacattatttaggtcataccatctactacttcctcataaattattaagcacaatataataatgattttaaaatttaaagaataatacatatgtacagagagaaagagatacagcagatgtggcaatcagttaataattggtgaatctaggtaaaaggcatatggatgctcattgtattaatcttattcttgcaacttttctgtacatttgaaaattttcacaataaaaagtagatggaagtgtatgtttattcaggccttttttttagaaccttttgctaaaatttagccccacccttccccttctgccacaagaaaacaccatgtgttgtaacccactcactttctttacagatatatctctaaaatcctaacatcaagctgatctgtatatgcattttactagttattttttcttcaaaaatgatatgtaattgtgttgttctcaacatactcatggttagacttttcttttttctttttggcttattaactgttgagtgaaagacctatatccttccggaaccatttgctcttaccttggttgctggccaaatggggtttttattgttctgtgataacagcacttactgaatgtttctcctcttggatcaacgtttgctaacgtcttgttttcttcctgtctgctcctcagagataaggggtaacccccacctgctggtcaagtaccatagtgggttcttcgtggacgggaagttcctgtgttgccagcagagctgtaaagcagccccaggatgtaccctctgggaagcatgtaatgtgtgattcctctgttggactggacgttgggtggatagtgctccattaggctaaacctgccagaggccagaagagcttgccagaaaacaagatgtgccagattggttggcatcatgaaaattcagccttgcagatgctatgtgacaaatgaaatctcattctagggtcaattgagtcatggccattaagataataacaatattaacatctgccattctttcatttcatgagaaacattttaaaaatttgaatcattaatcaagcaatgagctgttatttcctcccataatttttcttggttcaagataaactccaaaaaggtagaatatgttagatatgtcatcatagttcaaacagctaggtttccagtttggtaagaaaaccagctcgctcttcgtataaataacgaaaatcacaaactgaaaaaacaacattattaaaaaaaaaaaagatataacttaagtaacacttttcatcaccatgtatactaaaatgatggtcaaattttaaaatatatatttaaagcagttcgccattctctatatgtgtgttaatttcttaatgacatgagagaaggggctgctttacgtgaaatcagattctatccagagttgtactcccagggaaacaagagggacttatatgtatttaaagtttataattatttaacataaagttgttgataaatacaaaataggataacttattttggtaacagttttaccagcctggacaaaatatgcctggattacaatggctttaaagaattgaatgagatcagctacaaaatagaacttcatgaaatggaaaagatacaggcacataaaatattttttaaattcacttcatgacagtattgatacccaacaatcatgttaatgttaatactggtcattttacccccaaaaaatcaattaataaatattcattgtgttttccatcttaattagactatacagtgaatatttattaatctcaactagatcacattgctctatatactcatgaattatagttatttaatgaactatacagattggttgcacatgggtcttcgctccactgtaagggactgaggagtaatgtctccttatggtattaatcattttccccagtggttttgtctatggtctatttggtctattatcattacctagcaggtcagattccagctttgacaatgccctaactttctggaaggagcaggaaaaaggccagagagagcactgccttgggattgccttcctaggctctgtctggatgacactcaccatgtgttctgggtgccacaggtgctgtgcctctgaggaaaactacagagtgtagaggtgttgcagctcctgagcagctgtaatactgtctatctgtccaagtataatttattcccttggcttcttctgctgagctactgggaagtccatgggcataacaactaaaagagaaaaagttaggtgtctttatttctttttgtccaagatgccttgatccatcctctttccaggatacatggcctacataggagttgggccttatataggaaagctacagaatcactccagatgttgtgtctggattcacttaatctggagtattgctcacacaagctggttcattcttttaattcataacattgagtgtttctctttgttttgtttaaagttccttctgatattactttgttttaatgttcagatgctaatctgcatactgcagtcaatgaagagaaacacagagttcccaccttcccagacagagtggtaagtcaacattttaaaaatgtttttcatggtcaggatatattaaataaaccaagagttgccagattcaagactagaaaatgtggaattcatttagacttctcagcaaagagagaaaaaccatgagctctagataatagctatgggtggtattgaatagcggattcaaatatagaaccattgtaatatctcatatttttgcatttcattgttgtgtcttttcctagccagtaagcccataaatagtcaccaaaaaaaaaaaaagaaaaaatgggtgcatgcgggagatgtccttaagatggcatcacacataacaggcagctgttattagctgtcattctttccttaccatcaacatggccaagactgctttgtggaagtatcctggtgttgaaatgaaactctataggacaaaagcagaaaacaacataattctttccctccattatcccttcaaagctattcagtgggctttcttccctgcttccaaataaagtctttgccaaattccatagttttgcagtcattctcaaatgataaaaatgtccccattacttgtaatcataagaacagcctctgaattgttccatccaatgttattatcacatgactgcaaacatcattccaagttaaacatctgtcacctagcttgggcctgcatcacctggcagcatgcttttggggagggattttgggggggctgagattcatggccctttcagagttagttccaaggaagatgaggtctaattaaaaaaagacacacatagctgtttctatcatgatttggtggtggtggtatcggagtgagttttccagcactgattctttatctcatgggagacttttaggaatttcctactgaagggcagatccatatgtagttttatgacaggggagagatcttgatcctcagttcttggattttcagccctcaatctttcaagatggctgtcagccaactttttcccaagagtggagttggcctataagaaaacaaacaaaaccttgattgctctggttaattaagctgtatgtagctctctctcgaagtacaggctactgctgtctttttgctctactctcttgggttcatagccacagccttctgtttttagggttcccaggcaggtgtgagcctcctcaaatgccaggatacacaaaaaatggcttcccattggttctctggaagttcacctgaaagcaaggggacatctccgcccatctattggatctatggtgtcttgggtacttattttcagctacacacattcgcacacacttctctctttctaagtaaaagccacataattttcatgaatcaacatgaaagacaaaaataatccattattgtagtagactgaataatgtcccccaaatttcatatccatgtagaacctcagaatgtgaccttattggaactaggatctttgcagatgtaattagttaaagatcaagatgaaatcacacgaaagatgagagtgggccataaatccaatgactagtaagatgagaggacacagagagatacacagaggagaaggccatgtgaagacctaggaagagattggagttatgttaccacaggccaaggaacacctgtttcttagtccatttgtgctctactaaggaatacctgaggctgggtaattgataaagaaaagaggtttatttagctcaccgttctgcaggctgtacaagtagcatagcactggcatcggcatctgatgagggccttaggctgcttccactcatggcagaagggaaggggagctagtgtgtgcagaaattgtatggtgagagagaagaaacaagagagagggaagggagatagcaggctcttttcaacaaccagctctcatgggaaatcatagagtgagaactcattcactaccatgagaatggcactaggccattaatgagggattcgcccctatgacccaaatacctcccattaagctctacctccaacactggagatcacacatcaacataaaatttggaggggtcgaatatccaaaccatagcaacttggaaccaccagaagctggaagaggcaaggaaagattttatcctagaggcttcagaataagtatggcaatgctgaaatgttgattttgacttctagcctctagaactgtgaaacaataaatttttgtggttctaatccaccaaacttgtagcaatttgtcatggtagccctaggaaacaattataatcgttaggagttttactttgttattagcaacattgctgtttgggtttgaaaatatgtttcagtcctgaagcttgaaaagtatggccctctaaaacacctaggagaaacgcccagattaggcaaatctatagaaacaaagggtgatcagtggttgcctgggaccagagtagggatgagaattgactgcaaataggtatgaaggatcttattggagtgatgggaagactgggctgtggtgatagttatacaagttgataaatttacaaaagtcactgaattctgcactttaaaaaggatgaactaccaataaagtttgttttgacaagtctaagagcagaagataattaagagccagaaaccattgcatctagtctccagcagggaactttttggccaatatattgaaaattatcagctaggcaaatcagtggctaagggttcataagcctgttttgattataagcttcccaaatgaaccagggatcagagggtatcatgtaaagtatgtttttctttgttttgttttttatcagagtattcagtagagggcttattttctgaatggaggaaataaaaatcagctctctagttgttctgttcaaagagatttccttaaatgatttccatttaaggaacttcctagtgcatttttctttggacataacccacttcacagctcataaataacactgtcctgcataattaaaatttccagaatgtcaaagccttaactccaagtaaatgaaatttctgaaaaactaaaatatagcatgaaaaaaatattaaatgcatctctttctgtcacacacgcacacacagacacacacacacatattgtgaatttttaactgaaatataacattaacatagaaaagcacacaaatcctaagtgttcagcttgatgaattttcacaaactgaacaattctgtataatccaccctcagataaagaaacacaacatcacagaaccccagggacaccctgatgttccctttcagtcactactaccctccaaaagtagttgctaacctgatttataacatcatagattgtttgcctgattttgacttttatatgactggaattataaagtgtgtagtcatttattgtgtgtcttcttttcttcaatttgtgagattcgcttatttttttagtatgtgattatatttaccgtcatcattgtatagaattcagttgtgtgaatatacaactgttttggtttcttattactgttctaacaaattactacacaaatttagtggcttaaagcaacatacatttattctcttatagtttggaagatcatatgtctaaaatgggtctgcacagctgtgtttcctctggaagctttagggaagattctgtttccttgcattttccagttcctaaggggtacttacatttattggttcctggctccttcccctgtctgcagaaccagaaggttgcaggacctctactctctaacctctgcttccatcctcacagctctctaatctctgaccaccttatctcccttttataaaggccattttgattacatcaggcccacccccacaaaatccagaatagttgccccatctcgaaatccttaattacaatctgcaaagtctcttttaccacgtaaggtattcacaggttctgggaattaggacatgaacatattcgggagaccatttttcagccttcaacaaccacaacatgtttattattttatcctcttgatgggcatgtaggcagtttctagtttttatctaattaaaataattctgctatgaacattcttttacaggtcttttggtttccctgttgtgtatatatacgtaaaatttatgagtcatagggtatgaccagatgcacatccagatttactagattctgcaaacaaatttccaatgttgttgtaccacttcatactccaaccagcaaaatatgagttccagttgctccatatccttgctcatacctttcttctttccttgcctctttccttcctcccttcctccctcccttcctccctcccttctctccttcctttctctctctttcaagagctgatatacttaattgtcagttcccggtacctgaatctgtgcctcactgtgatgtattaaaatttcttcccctccaaagctgaagatacctcgggcagttcctgttctcaaaatggatgcaccatcttcaagtaccactctagcccaatatgacaacgaatcaaagaaaaactatggctcccagccaccatcttcaagtaccagtctagcgcaatatgacagcaactcaaagaaaatctatggctcccagccaaacttcaacatgcagtatattccaagggaagacttccctgactggtggcaagtaagaaaactgaaaaggtaatccccagctttcagacgggctgcccagcatgtagagtaaacactaccccggctgccctggacctcagcctcaaagctgttgatccaggtcttaggctgtcctctcagaaaatgttcagtgcttgagccagaagtctggggaagcagtggccccactggggctgagaagcatagattttccatttagattatccaatctaatgatctcagtaatgcctgatcattgtattcccttccctttctcctccttctccccccaaatatctccacattccagaatacagaatctttaaaaatctatcctttatatgaaagagcttaggatgggcttacttttgtaatgtgcttcagtatcactagccaaatggcaaatagcatttcaagcaaggccatggcttgccttcttggaatgtacaacctcacctctcctgacctgattagtcttctcacagtttttagcctaaagattctatctaaagccagaattgaaaattccttgaaggcaacatgtaaattgtgtatgtatgtatctcttggtatggcactgaatttgccctacacttgatgcccaataaatgttgaattgaattgcaagatgaccatatggaaagggtcaagtgactccccttccttatttcctgtctcagacctccttcctatcatgttgtctactctctgccatcttctcactcagttatcagcatccctgcagggaagtcatgtctgcctttccccacaatggatacagagcatctctctgactcaccatgtatctcttttcttagttatttttcccatgtccttttattcctttgttctttccatcttcatcatttttgcctaaagccaattactgaaagtttcaataatacagggccatatggaatttgaaataatgtaagtgtgttcttcttgattttttttcagtataataagccatggtccctttcattccaaagtggagctagaatcctagtgtattaatctatacctggtgcccaaggtatggggttacatttgtgcgcctgcagcccaccattcttgtggaaggagaggatcagtaaacccagttgcaaggagagtgaaagtcatgttaattgtgttccaggtccccttcctgacagaaactccagtgattcattgagagaggtgtgaggtgaagctgactgccctgttttcaaataaccaggaggaactgtcgattcacatggggttgctgccattattgagtttttgacactcctttagatttgcacctccttaggtttagtcccaactgtggattttccctagaacttcaggaagctagttattttaacaaaggattgattgatcacctcttagcatgagcagcattgcatctgcaagtaaattataataattgctaaaaggtcttcatggagcttgactttttaaagtgcagccatgattcttatctcatatatgggataatactttttatcaactttctgtcattcttacaatcttccctgagcttctttttaatctactttctgtttagtaagataatctatgcccccattaaatcattcaaatattacagaatattccatttacattcccctaaaatgttttctatgcacatgtggccatgtgcatacaaaagcaagtaagttctcacgatacagtctttgtcatttgttcttttcacttgacatcttcagcatttttcctatttgaatacatgaggatacacctgacttttaaaatttcattttcatttaattttggtgaaatatacataacataaagtttaccatcttaattatttttgagcatacagttcagtagtgttaagtacatttacattgttgtgcaaattgcctgattatttttaatgtctgtaagtaccagttgtatagatactaggtaaacctaagtgatgcactattgatggacattctctaagtgtttttagaaacaacaaggctaaataaaagctattctagtgggcaaggctctttgggaaggtggagagagaggcattttagagtttaagggctttatctaggcattccttgaaatagagccaggggagcatttccttgctaaggaaacttgtttctatgaactgtggttttgaaaaaagtctggactatgaaggcaaacaggaaataggttccacattccagataaaacagcctttagactttgagaggtaggcacttcttcatgctctgcttaataccccaaataaaagagataaaatgatctatggcagaggatgatgaaaatcctccttatccatctgtgtccagaaggagtaaaaagatcagcattttcaagaattttaattgtagtcacaatagctaagaggaaaataagttattttaaaatatataagtgacagaatgcttgcatatatataagaaaatcagggcaaatccagtcaagatgatttattaatctagattttccattgtttaagataattatgagccattattaacaattttcttttgtttagaagtgttgccagactactgcttttattggaatgcctgaaagaaccaaaatgtgaaagtaactcattagcttaaatttcccaaacaagtgaaatgtgtgggtcaaaatgtcaaataaagctaaaacatatctgaacaaaattacttttgtcatttaaaatttataagtagacatatgtttataaacttataaaatgtctcttttttgcagtagcagcagcagtgaagatgttgcaagcagtaaccaaaaagaaagaaatgtgaatcacaccacctcaaagatttcatggtaaatcaaattcagatatctcctacatccagaatatgcttccattttcaggaaaactaaccaaacttgcaataattttgcagctaggctttctacttaaggtaaatataaaccaaaaaagtctatgtagtttgcctctctgaaccctgaatggatggcttttgggttctagtttttcttgaactgactattcctagccagcatccatgacatacaccagtagtagcaccaacattagtatacctgacccaggcatctctagcaggaagaaaagcaacctagagttgaataactcttccataagaatagctatatacacaacccaatttttttttaacttgatactacagccatctctgaaggagtcttcatctatttcgtgagcccactctttggaaaaagtcaaagaaatataagttcttctgggggcctcctggggatctcctgtatcaaagaaccattctttcattaaaacttggcataagcccaacttttgagtgactctctctttactgttgctgtgttgatactttgccaggtgcagaaggagaaacctaacaatctaaatgttatttaggtggataaaatcagggtgggatttgatattgcatggctacgcacttggattatttcttggtgcttttctgcactcacgtttttctcaactcttcttaagggaattccctgagtcaagttcatctgaagaagaggaaaacctggatgattatgagtgagtattgaaagtcttctgggttcttctaaaattagacatagatacttctactctcttcctcaaagacattaaaacagatggctgagaccgtctcaggaggctgtatttacatgggtaaactcacgtaatgttctgggtcatttatctagatgacaggtgacaatgagctgggttgttaccaacgaaaatattttccccaaaactggattatctaaattggatgcaaatacttattggatttatcgtatgtccagcgtcaccttcatttcactttacctttgtagatgtagcatataatgtttctgctcattatttctttcctggagacctctaattaaggtgatgtttgaaagctcttattaacattgagtaatatttttggagaagttattaatgatgcagtaattttacagggtagcacaaatgagaccttgaacatggcaatatttatgtcgacagatctctattcttaggatgaccttgtcattttttttttttttttttgagacagagttttgctcttgttgcccaggctggagtgcagtggcatgatctcggctcattgcaacctccacctcctaggttcaagcaattctcctacctcagcctcccgagtagctaagattacaggcgcctgccaccatgcccagctaatttttgtatttttagtagagacagggtttcgccatgtttgccaggctggtcttgaactcctgacctcaggtgatccacccgcctcggcctcccaaagtgctgggattacaggcgtgagccacctcacccagccaaccttttcatttaacatcaaaattgggatactttagaaagagaaaaagtgcactattaaaaattatacccgttaataataacttaattatacattttaaaataacttaaagagtataattaattgtttgtaactcaaaggataaatgcttgaagggatggataccccataatccatgatgtgattattatgcattgcatgtctgtatcaaaatatttcatgtaccccataaatatatatacctgctatggtgagccgagatggcgccactgcactccagcctgggcgacagagcaagactctgtctcaaaaaaaaaaaaaaaaaaaaaaaacaacacaaacacacacacacacacacacaaatatatatatatatatatatatatatatatatatatacacacacacacacacacatatatatatacctgctatgtactcacaaaaattaaaataaaaattacacctggacatttgacataaactggacttctgggcaaataagaacgtgtggtcaccccaactatactgagaaggttggcctaagtggctattaaggttctttccaaaatctaagggtctatcattctacaaatagggacaaataattgtctcctagatgtaaagattagtgttaagaagaggtgggaataatagagcatattgcatttctcagacacttgataccaaatggcacagaattcacttgaacactaggattatgcatatttccagttctgtttttgtacaagtgttgtattattgatttattgattacatgtgaaacgagagcttttacaaagtacatgctactgttttcactcctcctctcatctctaacccagcctggtcctagccatacctgttgcattggggaagatgtgctgtaccctccacatctttgtggcatggtctctttatcaccttctagctctctttcggctttactttcttccctaacatctattctcaggaaagcattgatggaataattcatactaagacataaaagactgagaatgaccaacgcatggtcatttccaaagataattgcactttaatgaaacacaaagacttaaaccaatgggagtgaacctctaattgtggattgtactctttagcatttaaataaattagaagtctttccctgattgggtaagcccagatatgaccatttaaacagtctctattcccatcttttctgaatgcaagtggtgtgtgagagacagacattgaggaaattatcagggaagacttgtcctcttcaaaatcaaaaagataccaaaaggagctcgggattatagggctataggatctgggactcagtcacctcacattgtgcttaatgctcccagcttcctattctatcagtgtcatgggagtttttgttttatggccataacttcatgagcaattccagtcaattccattaaagacagaagcactaagccctgagatttagatagaaaatcgtgtgttaagactaggcctggccaggtacagtggcacatgcctataatcccagcactttcagaggctgagctaggcagatctcttgagctcagaagtttgagaccagccggggcaacatgacaaaacctcatctctacaaaaatacaaaaattagccaggtgtggttgcccattcctgtagtcccaactacttgggaggctgaggtgggaggatcacttgagcccgggaggtcgaggctgtagtgagccgagatcataccactgcactccagcctatgtgacagagtgagaccctgtcaaaaaacaaaacaaacaaaaaaaaaccttaggcctaggactctgctgctctgtcattgaatactgaaatattatttaaaacaataagaggcaggcctcagcaaaattatgacacaggcaacgtttgtatgtgtgtgggaggtataatgtatagggtacataggttatatcaccttgcctctccaggcctctctcctgattcttgattttcttccttctattcccctgtaggtatatatcctgtatcacagcccctgaagggccttttgattagctagtattaccttaaaatgttgactaataagaaaaacgatcagttaaaatttcaagtgttagttatacagtatccataatggtagagttaaaagagactttcaaacttatcaagatcaaccctctccctagttttacaggtagggaagtccaaggtcaaacaaggccaagtggcttgttcaaagtcatacaattacacatagggaagttatgcctagaacccagacctccaagctgggtgacctaaggctctttctattttattgagctgtccaccagctgacatcccttcccaaaactcatacagagattatacaaagaatcacttcccatccattcctgccaagttctgagataccttctacattgaatttctcctataactcctcccttctaccctcacccccctcttgtacttatttcctctgcagatgttatcttctagccagtgggtcctcccactcacccaaacccatgctacatcccacctcatgccctgcttttactcatttcctaagtaggacattctgtctaaagcccaaaggccacagacattattgccctcacatgagaaacagctcttggcctgttgagctccacatataaagtaaaagcatttgatgtgaaaatagatgttataatcagattattacaaggaaattatatgattggaagacaagagctttcatccttggcagccctgactttcctcttggaatattcttcataggtctaatctctagcccttactcaaaatggtaaaatgtaggaaaacttagaagtcacctagaagaaaaccaaagattcctaaatgccagcccatttaaaaattagatgtgcagactccaccccaacatcagaatttagtagtggggacttaagcatttgtatttctgaaaagctcctcaaatcattctctggagcagttaggcttggaaacccctgaggtaagccaatgcctcattttacagattagaaagttgagtgtcaagctatacaatctaaaacttattgattctcacatataatttttttccttttgcagctggtttgctggtaacatctccagatcacaatctgaacagttactcagacaaaaggtaaatagtcttgtctttaaaacagcctcacagaatctctttgcattttggggtccagaggttgatgcatttctcatagaaaccttcctgctaattatatagtcaagtcattgtagtgttgcttgtccagtctgtgggttgcccgactcttcatgtctagccactacttctgtgtccattatgtattgctgcataataaaccactcctaaattgggtggcttgaaacagtgggatttatgatatctcatgattctgtgagtcagctgggccagcagttcttaggcaagttttgcttaggggcactcctgtggctgcatttgggtcgtggattgactgggggcttgggtttagctgaggcagtcaactggagttccacagttcttccccaagcagtctctccatgtgcctcacttgggcctcctcacagcatggtgatctcaaggcagtagttgaagaggacgagccccacagtgcaagcacttttcgagtctctgcttttgttgtgtttgctaaggtcctattggtcatagcaagtcacatggctcagcccagagtcagtatgggaggggactgctcacagcatgaataagagagatgatttatcggaggccgtcaatgtagccattaacctcagctctgtcactgctcgttagcacctagaccagagtatagcagatgtgatacagaacatgtttatctgactttattactaattgatatggaatgccagtagcaaactcttttgatttctaaaaatgacactttgatatagtttaacctgataaaaacactaaacattacacttatttctttgaggggtgctagtgagaatgtaatgacttcatttggcgttttgtcacattcatagtttataatctgctctttctgaactttgatctgcttagaattagcacaaatcattgagaaagacaacttgagtatagaactttatcaactgatttattcttgatctttggttttctaaaaccttccaaaggcatgatacggtgatacacggttctaaattgtatttcttaaagatgaaaacattaggcttgcataagcacaacaccgagaaaagtaagtgatagggttaaatattaattggagaggaagagttcatacacatacacatacacatagagcagatctataaagagattgagtgagaaacctgtgccttttgtgatatataaagtcaatctaaaagatttgttttccaactacctaccatgcaaaatcattttcaagaatgatgaaaatattttctattccttctatattttccttccttttcagggaaaagaaggagcatttatggttagaaattcgagccaagtgggaatgtacacagtgtccttatttagtaaggctgtgaagtaagtatgatacggattaatttcttttctctttctgcgtatattctttgaatatgctggtcacaatcacattttgggataagacatcatctttaaactctggaattttaaatcaaagtatttctattgaatgtgaccatttgtagttgcctccaccactctcaccccactgccccaccatccttgccccactactttcaagaggccattctctggctaatcctctcctgccccactccaggcagtaacagagtgcccagagcacagcatgcctcagtaaatgtttattaagagactctcgggtgattccctttcattcaggtctaagcctggaaagaaaaaaaatagcaatggagcgtctatactctcagccctagccacctgctgagcaaagatgcctactccagtgtccagttcttagtaagcccttccactgggtgcagagttagcagaaggttgactcagtgctgctgtgttctctacacagcttccttccagggctctgtcctctttgtgtgactaaaagttcttgtttgaagccaaacttctagatccaaatcctggctctactatttcaatagggctttgtgacattgagcaagtttctcagcctctgtgcctcaacttcttcatttgaaaggggaacataatgattgttacgttctatgagtggggtgagttaattaatatattatatccagaacagtgcctgacacatagtaagcacttaataaactaatagtacttactattattgttgttgttgttgctggggaagggtagttctacctgctccactccctgtaccctaacacttgggcataaaagacaccccacagtcatctcatgcaaatcatcatcaaaatccttctccagagttttacaagccactttcttattggtagttagctctttttttttccttctaatcgtcctccaaagcaaatgggaaagctgtttttatttataccatattgcagatgagaggattgaggttcaaaaagagcttataaagacctacctggagctactaagtgactaatttgaagctgggcttccaatagccaagtcatgtttctttatctacacctctgtgtttacactgaacccccagtgttttggaatgagaatctggtcaaatattgattcggatcttcttttaaatttctatgtgtgcaactcttttttagcagctagattgaatgatcgtctgccttggtgccttccccatgtgccctaccccacagtgcatatatgtatatttataataattaagtaataaaaacgttattttattttgaaattttttacagagtgcctacctacacttgagataataggatgtacctgaattgtcccacagcactttccaatgccagaatccatgtccccagtgtatctcatatattattttgcacatggtaacacctggatgctggctaaagccaacccagtaagaatcaggagaagactttgttgactatcaaaagttttgtggccttctggccctgcagtttcagccaaacctggtatcagatgtccttgtagttgagtttcttgactacagattcattttttaaggtagccaggtagataaatcagcaaatagataaagaatcaaatgaatacagaagccctcttttatgaaacctcatcaatggccttgagtgaattgtatgctgacaccaaaagctgattaaacatttgcagcaaagagaagaaccatttctccttttgtacttgcaatttttactcggttgatgttacagcaacaattttttaattttttagcttttattttaagttgattggtacatgtgacaggtttgttatataggtaaactcttgtcatgtggctttcttgtagagattatttcatcacccaactactaagcctagtgttcaatagttattttttctgctcttctccctcctcccaccctccaccctcaagtaagcctcagtgtctactattttcctctatgtgtccatgtgttgtcatcatttatctcccacttacaagtaaaaatatgtggtatctggttttctgttcctgtgttagtttgctatacagcaacaatttattaactgtttcttatatgccaggcataaccatataggtagctagcaagtgatagaactaaactcaaagcctggttcttgaccactatgtcattgtctacaatctaagacaggtgtattattcctgattagcttaaatcaacgtgcatcaattcagcattattgtataaaagcagaggaaaagaaaaaagtgttttatgtggagaaggtacaagttcacatgaggaattaaaggacatcctcacctacttcattctgcatgccccaaaagagcctcctcccatgttttggggtgaggatacccaacagcctaatcacctttacctctctcatttccacctccattattatcctataagataatttatgttcagaataatgatcctgaagaactacaagcctctctcgatcatcaaagaaagattccagttttatacacttactaagggaggagaagcctggaaagttggaattttactgtacatgaaatctatatgtgcaccaaaagatacattgagttcagagaagaactctcttccataattacttttatagttacaccagatttcaagactgagaaaaacaccagatgccaagcctgagaaaacctccctgacttccctctccaaaatttgcaaatgcacctaaaataattatttaacccttgcttaatcaagctttattgtttattttaaatgttctaacattctttctgttactagtgataaaaaaggaactgtcaaacattaccacgtgcatacaaatgctgagaacaaattatacctggcagaaaactactgttttgattccattccaaagcttattcattatcatcaacacaattcagcaggtaacttattttagtttttcttttatgggcccttgttgtaaaacagcaattttcctggatactactgatcctcctaatattcttaattatatagggaaccatgaaagtaggaaaaaatcctctcaagtcttttgcctatcataatttttagcttacattcccaggaatataacatgattctctccttaatgccagaaagaatgaaattgagtaaactgggtgacttagaaagagaaattctctttataaaaatattcgtagggtttttctgtgtatagaagcaagaggattataaatttaaaatattatagaaatatatacatatcgttggatcatggaccagttgtctattatgacagggttttttgcatgctgccactagcacttactaatcattacatatataaatagaaattatatattatgtatatacattacatttttacagagatgagatcattctacacatattgctcagcttgctttctttactcaacatgtcttagaagtctttccacgcaaacacaaagagcttactttggtctatttaacagctgtgtagaattctatcatagttaccccataatttattcacctagccctctgttgattagcagttggatcatgtccagtattttcacattataatggatgtttcagtgcacaattctgcatgcatagctctgtccatctatatgaggggttctatagccaaatccctagaaatggaatttctgagacaaaggctaagaatacttaaaatgtacagattgccaactgcttttcagaaatgtacaatcctactaacaacattttctttcatcctcaccaacactgggtgctattagtcttctaaatttttgcctaatcaactggtggaaatacatctagaaataccctctgttttctagaatagtgccacttaagagcagtggctggatgaatttccaacagtgagtaaaaataagccataagctcagcacttaatttgtgttactttatatgacttgattgcatgcatgtaggtgaattgacctcacttctggctttcattttggctcttactgatgtttttcctttgccccaatttcctcaattgtttattttaacctgtagtacctcagaagtaccttttgtaaaaggtattgcacaaagagatgcacaggaaacttcacaggatatcagaaggaaatattaagatgtttatttatatttggatttttatctcattctcttacattttctgtttgtgagtttatttttataattcacaccaaatatatattttatagaaatgtactaatttttacattttaattaattaatttagttgattaaaggtaaaggattttaaaagtttggagaccactcatataaaaaccagacaaatatatagaaaaaggaaggaggggaaaagtacatgtgtgatagataggtcccttgacttggagagcattccacatttaaagcaaaaaacatatatacatatattttaatgggttctttcaagccactattaaattttataattactttaacccagttttaccataactaaatataaacaattaaaatggcttgaccacttaatgaaacttagtaataggttcagtttttaaaaattcagatggcttattatttttacccttctgtattgtttgaattttttgtcaaatgtatgtgctgtgtgtatacatattttaagcataagattgtaaagagatagcaaaaaagaagggggagaattttaaaagattacatcatgcaattaatttctatgggatttttaaaaatcacatacagtgttttattcatttaattttcgctttgcattaagctaattagtcaagttaagcacaactacaactgaatggattctctctctgcattacaacattctgaactctttgctttttcagccactttggagagagactagttgtgaaccaatgttacataatgtgatgggatatgatataatgatgtgatgatatgatgctgattccattgcaggcatgatcacacggctccgccaccctgtgtcaacaaaggccaacaaggtccccgactctgtgtccctgggaaatggtatggatacatacttgggttcttaaactccattttccatcattttttatttaaatatatggttaatttactggcaaaaaaaaaaaaaaaggaggaaagacaggaaggaggcctctgttcagattgtatcaggaaggattttctttaaaaaaaaaaaaaatctgtcctctcaacctaaatctgtaagcttctagaatcaccaagaagatcatcaatttgttttcttatcagaccccattattagcctccagcacaccattgtctgtcctatctttttcctggattttgtgcccactgagcagagccagtattcaaccttgtgtgttaggacgatcacatccactgcgatcacagtttaatttttttattaaaaaaatctgacaatgttttaccaatctaaggacatcgagtacattttgatgctaagcctctccaagatgcctctgattggcaaattgtttttactctgagccttcttgttaaataactgtagctacttcaagaatagtgttaccctggtgccattatcacgtagccacaagaccacatcactaagggtttttttttttaacttatcaacttaaaataaaaagtcttgtttatattgtcactgtgaaactcccattggagaagaaatcacttgggaagctgttagccccaaagctttctatgctcgtcctaaagaatgtccgtcttgccttgttaggaatctgggaactgaaaagagaagagattaccttgttgaaggagctgggaagtggccagtttggagtggtccagctgggcaagtggaaggggcagtatgatgttgctgttaagatgatcaaggagggctccatgtcagaagatgaattctttcaggaggcccagactatgatgtaagtttttcccaaggaatggctgtttagccctcatcatgggagggcattagcactaataggcctgctgttaactttgcaaggcctagagcaaaagtccacatactgtatcatagacataaatatttagaagttataaattgaactaacagactattaaatcaaatcagtcttatgctcctactttgacaaatataccttcataacaacctgaaaggccatattcaaattgagaattcccaagactctacaaagaaaccagcctctggcctgtggtcttccaaactccacccctcctgcttctcccctcatacccaactccgtcctgcactataaggggcctcagtagttatgtacagacacagcattcagtacacacaagctccctctttgtctcccgcaaacaattatctagtggctaatgatcttggctaggggtagtgtgctttacccttaagcggacagactccttaaggaagagtcagcacaggtcctgaaagaggcctcaggactatatggttgggtgatttcagagtcctggtgctctaagggtggcagagaaagggacatatagggtcggagtaggcatgtctccttggccctgtggcctccttgccctgtggggaggtgcatggtgggatgaagaacagagtggggctaccacccagaactaatgcagtactgaaaattaatgctctaccaacaatatccttttccttcttggtaccttcaatacagtctaatactcttcctaatgtgtctcagctcccagcacaacagccttcaattattggcaatacatatgtgttctctttccctctgtgtcttctctctctctctctcttccccctctctctctttctctctccctctctctccctcttcctctctctccttctctctctctctccctctctctccctctctcagttgtatataattctccctcttcttgtcaacatagtaaatcagactttgtagagtgaccaccattcaggtttgctgaggtctgggaggttttagcactgaaagtcctgtgtcctaggaaacctcccagccccaggcaaaccaggacagttggtcactctacttttagagaatcaatcagtatggtatgaaaaatgatgttatagtaggtctctggtcaaaaatagttgaaataaaaaaattcctagcctgctagagattgagagcactttttaaatttttacttaaacagttatactgtacagtgtttacaggcatttctctaagcactttacaaatattaactcacttaatccccataagaaacctatgagggttgtaccatcgttatcttagatttacaggaaaccgaagcacagaaatgttgaataacttgtccagagtcggcaagctagtaaaagtcgaaaagcagagatacaaacccaggcagacattctagggtccatttctttagttattcttttatgaagaccaaaggaattaggaaagtcagaacaatcacttttaccataattgcaaaattatttggaagcagagatgctatgtgaatataggcctttggccctagctggcttcatgggcatatgagatctgcacagttgcaagggcctagaagtacctagtacctagaaggtacctagaagggcacagtacctagaagggccctgtgcttggtttaatgctctgctgttgtcatcttgaagtaatacttcgtgatttttaaacaaggattcctgcattttcattttgcattggtgcctgcaattatgtaactggttctgccttcagtgattggactgtcataaaactgggaagggggcccctgatattctcctcttgtaggacaggaaaatctggcagaaactttctgccagatttttctcatggttacaggctcatgatgtaacctctgtgtcttggtgtaactttaaaacatatttttgccattaccaagctggtatccataaaaaaatcacaagaagtcatttaaaaacatcacctaatcataaagaaaaacgtcaaactgtgccacaatgggaaaaagtctaatcccaaatgtaggggtcaagctgaagcctatcatgtggggaatatcagttaatatggcgccctcaccttgagccacctgggcagtgactgaatttgttcaaagaatatttctttattgggtgatggacctttgtgccatcacaagccttccctctgaagggagcagtgttgagtaccatgcaggtctccaaaactgctaaaagatgaatactcccaagctcatcaacttgagtgacatgataagcattgtccctatagttaaactaagaaggaagaaaataactaaaaatttaataaattcttattaaaatatttaaaacttcacatgttaaatttagatttctttacacatttgaacattacagaataatcctgtaaattgttaaaattagattaatcatataagaacaagttaatgagcttgtaaaaactgagtgtcccttctcaaaagaagacatttatgcggacaacaaacatatgaaaaaaagctcatcatcacttgtcattagagaaatgcaaatcaaaacgacagtgagataccatttcacgccatttagaatggcaatcattaaaaagccaggaaacaacagatgctggagaggatgtggagagaaataggaacgcttttacactgttggtgggagtgtaaattatttcaaccactgtggaagacagtgtggtgattcctcaaggatctagaaccagaaatatcatttgacccagcaatcccagtactgggtatatattcaaaggattataaatcattctactataaagacacatgcacacatatgtgtattgcagcactattcacaatagcaaagacttggaaccaactcaaatgcccatcaatgttagactggataaagaaaatgtggcacatatacaccatggaatactatgcagccataaaaaagaatgagttcatgtcctttgcaaggacatggatgaagctggaaaccatcattctcagcaaactaacacaggaacagaaaaccgaacaccgcatgttctcactcataagtggaagttgaacaatgagaacacatggacacagggaggggaacatcacacactggggcttgttggggggtgggggataggggaaagatagcattaggagaaatacctaatgaagatgacgggtgcagcaaaccaccatggcacatgtatatatatgtaacaaacctgcacgttctgcacatgtatcccagaactcaaagtataataaaaaaaaaaataaaatttaaaaatcaacttctgcgtggcaacaaaacaaaataaaaaccctatgcaaactaaaagacaaatgataaactgagcaaaattatttgtaattcatattatggacaaaagactaatctccccaaaaaggctaatacctccaaactcattaacaactacactactgcactgtttgtttgtacaatggatcactcagagtcagctcagaatctaagagtaaagtacatgtcaatccaaaaatgtgtccaaattcactgaaatacaatgtagaacagaaaagaaagagtaattggagttgctaagtactttcaaaaggctttatgcttaaccgtgaagacagtaaagagagtaaagcagcagttcgggagcctgtctggagaagtaaaggtgatatggcagcacactgctagagactccgctagacatttagcttaacctatgcatctcacaaatggaaaaaaaaaaaaaaagataggtgagaaaagatatcatgagaaaggtaattaaggtagaagaatcacactttacaagaaggtttgcttgatttcttttaagctctaggctagtacaaaatttaagattgatattacttaaattaataagaaacactaaaggactcttcaattcgcaagattaaacacttccatctggaacatctgattactaaataatagcccatagctacattacgctccattttcttctacttaactttatcattttaaaaagggtgctgggaagaggtacggtaaaaccatctgccataataaaatgaaaattatctcattaaaaaaaaatctgagtgtccatgccatcatgacctaccagaagtgctacatcatatggttagtattttataaatttgttattcaaaaataatgaaaacaataatgtaaaataattttttaaaaaagaaaaaaaatcaaacctcatctgacttcatttagcctacattcttcgtattctaatatacttttttagaatgaaatatttagatgtgaaagttaataaaagagaaatgattgttcttagggtgtggcttcctctaaataagtcatggacgttcccaggatgccatgagactcaacagggtttccagtgcaacagaccattgctaccctgattctctgtaggaaagttgaatacagcattcacaaactgctaaattgctgctgaagtcaccaatgtctgatatgaggcagaaattttttttgcctccaaagataattgtgcttgaaatataagatcctaaacttttccctctctttctctgttcaagtgaaagagggtgggggtgggaattaaaacaaacagaaatctgagagcaactctttttcagtacatgtagaaaatggagtgtggagcattgaactttgaaaatctgttatttccaggaaactcagccatcccaagctggttaaattctatggagtgtgttcaaaggaataccccatatacatagtgactgaatatataagcaatggctgcttgctgaattacctgaggagtcacggaaaaggacttgaaccttcccagctcttagaaatgtgctacgatgtctgtgaaggcatggccttcttggagagtcaccaattcatacaccgggacttggtaagcaaagccattggaatttcaaagaaaagaaagcagtccacggctcccacttctggagatggggtcactggtagggaaggcaagaagggcaccatcacttctactttgctcacttgtgacttgtttaagcaaatgacatttttacaaaaatcaatgtaaaaatatttgaagtatggaaagaacagtgagaataaaataagctgttaaggtctacatagctgtgttgtggcaagaaggagaacagatggaaaggaaagacttctgccaatttagtgtctctcaaaaccattaaacccaaattgaccttcatttcaggaagggcttagtgctaaagcagccatttgatacaataactgaacatgaaaaaaaaaaaaggaaatagaatttgtgtgtctttggatcagaatgagagtggggaatgctgtgtttggtattcactgggatttatctttagagattttcttgcgctcaacagtagacctgcattcacactaggccagtgtgttccctaagtcacaggtgcagcgtttatgccttcaaagcatctgtgaatgcacggtatctggtggtggaaagggagattctagaaatttctcatctttccttgataagctaaggttctgtgtttaaagtgtaataccttttcatgttgtttgacaaggatggatgcttggttgaaagtactcatgggagaacatttttattttgaaaaattgaaaattgcaaaggaaaaaaaagacaactttagagcacttgggggttgtgctaggtaatcttagattttgctgagaattctactcaaaaggaggaaaatgtcaggagattcttggtcactttcactacttggtgattttgtttttcctttaaaggctgctcgtaactgcttggtggacagagatctctgtgtgaaagtatctgactttggaatgacaaggtaagccaattccgaaagggcaaccagtgaaagggggatttccattcacatttgaacaccatcataattgaaggctttgtggggatatagaaggtgctctgaattgggggcttagaaacctaagtccctcccatgggattgttcttcagaaattatctgacgtcacttttagttctttcaacaatctgatactttctaaacttctaaataaattccatgaaagatcctaaatttaaatacaacatgttacagccacattattggattgttttactttcttttaaatttttttatttttaatttttgtgggtacatagtaggtatacatatttatggggtacatgtgatgttttgatacaggcatgcaatgtgaaataatcgcatcatggagaatggggtatccatcccctcaagcattttggagtactactcagccatttaaaaagaatggataaatatttataattttttaactcaatcaaggatctgctagctctttttgtctgtcattaaaaaaaaaacctgatgttcaaatgggtagagcattcacactaggaaaatttttgttgtcacatcattagattttctgcatcacaaagtaaggcataaaactagactctgagattctcttgatgggcattctaccaccacttaatgatgtggaacaattattttgattacgatcgtttttttaaagtcttcttttaccttaatcctgtatcctaatactatttaagcctcagagcaaattttcatagttttgcaaagaaaacgaagacatacacattaacctttctattcaacatttattgagtgcctactgaatacctcagtcctgcaggagatactgatatgaataggatagtccctgctctcaaaatgaccacagtttagtctagagggcaagtagatatccctgacattgagacaaaatataactataaagttgtgctgactcaatatgtaattctgaaggtgaataatgcagtttaaaagagatctgaagagttgaccaaggccaggttaatatttagcaaacattgccctaaaatgccataggaggatctgtttttttaatgtcttctccaaaattcagtgttaggggatgctttttgacccttgtggcacataccgtggaagctatggtaattcctctgggagccctaaatattggcaagatgtccttttagctgtgtactagctaccgtcactccaaccaccatacactgagtcccctacactgaccctccaaacatgtagctttctcaagagcaagaaaaaaaaaatctgctgacaggttcttaaagcagggagaagctcccaggtcaagggaactgatccccacctttactctaaaagcaagaatattggctgttatgccagcatccagggaacatgctttcacgttctctgtagctttggaaaagggagacttttccaaaaaaagatccaaagaaaaaagagatcttgctctgagtaagagatcctggaagccatgtaccagccctgttggttatgaagctctgtggccacatcaattagatgcctgtgacttcatttgctcctactagcttgaaggaaggtttaagccatgagcatccccaaaccaggagtgccagggtagtgtctgggtatctggtagtgtctggggagctgaggggttctggggagaaaagtatggaatgtactgtatgtaatcctatgaaagtgtagtttattaatattattgttaatatttagaaggatgatcttcccagccagctattttaaattacagtgagatctctaaaacatttggtgtgtaaattatatccaaaattccaattgccataactcctgttgttctattttctctaattaagagtcattatgtgtttgtttttgttgtggtttttgtgggcaaatatatgatgttctcttttattaatactataaataatatgtacttattataagaaaaatagcattagtgtagaaagtaaaaagtagaattgttagcagcagtgaatccgtaaaggtctgcagcaactcaattcttgcctcctcaaaggaaaggattcatctgaggggcataaggcagagagagagactgaggcaagtttttgagcaggagtgagagtttattaaaaagttttagagcaggaaggaaaggaagtaaagcacacttggaagagggccaagagggcaacttgagagatccaactgccctacttggcccttgacttagggtttcatacattggcataattccaaagtttgcatcttttctcccctgattcttcccttggggtgggctgtctgcatgagcagtagcctgccagcacttgggaggggccgcacgcacagtgtgtttacttaggttgtgcgcatgctcatttgaggcatttttcttttaccagtcgagtattcttagaggaaggtcatataccagttaaactccattattttgcctcttattgcgcatgtttgaccccagttgcccaactcctgagatcatatcaggaagctgttgatcatcagcttcaagtattttctatctattgggagactgccgttccctggcaccagctgcgaccaattattattttagagagacggttaacaactgcctgactattacctgacggtcacctaatattcctgggttgggggtgggggatctctcctgccctgctcatgtctgcctagctacctattctgacagaatctgtccctcattttcagtgctaggagtaaccactgctcagatgtttggtgggtatcctttcagacctcattcttaagtgtatccaatcatatacacaaatatgcacatttactacttgttcccacacacaaaaaatggaatcacattatacacactttcttttgcacataaccatataccatgagcacctttttattttggtgaagagttatctcatttttgaatggctatgtgctattctattgtgtgagtgtgccataatatatttaattactcctcaacattgggaacattgaggttgctttcattttatcattattacaaacaaagagtttagtgaacattcttcaacatgtattttggtcttgatatctccataggatatttttgttcatcattattcataacagcagaagattagtagcaatttacctggttaaataaattatgtttaattccttccataagaagaaataataagagggaatggtattcagccactaaacatgatgctgcagtagaaatgtaaccgtatggggaaatgctcatgatataccattaaaggaaaaataaaagcaaatctcaatataacagaaaccctattttgttcaacttatatatgtgggaaataagatcagaaagtacaaagaaaaatgtattttgagtgatagaattacaggttatctttagggtgggtttctgagtaattttatctttacttttttgtgtttttctatatttaccaaacattttgcattgaggttttgctgtattcagttagatattatcttttaaatgcttacaaaccataagcagcctccagctaagcccacacattgaaaggaaacaaaagttccagaaaactgaggcaatcgactgagactctgggtggcttccgtgtccttcatcagcctgtaccaccacggcttaaggtctgtgttgatgtgttttccctggcaggtatgttcttgatgaccagtatgtcagttcagtcggaacaaagtttccagtcaagtggtcagctccagaggtgtttcattacttcaaatacagcagcaagtcagacgtatgggcatttggtaaggatgtggccacatacgacctggccctgtttcataagcttacttccacaacaggaaaccacaagagtagcaatgtccattttaaaagggcccttgaacacttacgaagttacacatatagcctgagagaagcaagctgttgaagaaggtgatttattttcttgggtttggtattaggatgtcttctacacatcttgtaatttacatcctgctagcactttctcataaaatcaaaagggataaatctactcagaggttgaggtggaaggattgtttgagcccaggagttcaagtccagctggggcaacacagttaagaccctgtctttagaaacatcaaaggggatgaaagtttttccagtgaagatttcaaataattttttaaaaggagtcattgaaagctgaatctgagtttttgctgagccccaaacgttgaaaagacatcaattttctgcatgaaaataatgggatagccattcccttctgcgctgaccaattcttagtgtaaacaccacacatgacttggtactttctttgactcgtgcctagtttcaagtagtctcctctctgttaaaatttatattttagattgggattggcaaaccacagcccaggaccaggtcagttggtttttgtaaataaagttttattggaacacagtcatgcccattcatttatgtattatctatggctcattttgtgctacaacagcagagtagagtagttgccacagatactgcatgtcccaaaaagtctaaaatgctatgtggccctttataggataagtttgctgactcttattttactaaaatatctatattaaaatttagtaaaggtcattagaaaagggaaacaattcttaaattgtgactacattttatgatattttttctatgttgtgagaatatcaaggctattttcaatcactgtcggatggacccaggataagtaatccaaatgtgactgagacctatttcatgccttagttcataagtgtaatttgatttactgcttgtcacctacaagactgcctttgaaaaggggaaaatttagttatttatttctctatgtgacacaatttttaaaactaactattccctttgtaaaagtggcattgttcgttgttaaaaaaaaagataatcaaatacacacagaaaaagaaaaaaaatcacaaagatagcattttggtgaatacttgatgccatgttgtactgattaacttttgtaccttgttgtcaaaattagttttgaggctgagtgcggtggctcatgcctgtaatcccagcacttcgagaggctgaggcgggcagatcacttgaggccaggagttcaagaccagcccagccaacatggcaaaaactcgtctctactaaaaacacaaaaattagccaggcatggtggtgcgcgcctgtaaccccagctactcgagaggctgaggcacgagaatcgcttaaacctgggaggcagagtttacagtgagctgagattgtgccactgcactccagccttggcgacacagcaagaggctgtcttaaaaaaaaaaaattagttttgataatcatgcatcaattataagtgatagcaaaaaatcaatgccctaatttaataattacagcttgtttttgaccaaaaaatagtattacccagcttgattatttaccgtatgccatagaagttggccccagatattttccagctgtttataaacactaaattcattcttaaacaatatatcccagtgaggatacccaaaatgaatcagggcctctgatagcaattcccaaagaagaaccccacagatattttgaaataagtgtgtagccttccaaagagaaagttatgaggaaactgcattcttttggattgttgttttagactgtgtgatttaaaagaaaaaagcagccataaaatttataaggttgctttattataaatatttgaaactggctgactgttgaaattttctgaccttggccagcacagcacaactgccaccatttagagagcacttgaaacatctcagtgctcttttaagtgctttacgtgttttatcctatttaatcctcacagcaagtccatgaggtgcaaataccccattttatagacggagaacctgaggctgagaggggttgagaaacttatcccacctgtaagtgacagaagtcaacttcaaaggccatgtctaactgatcccaaatgccatcctcctgaccaccatgaccagaaccgagatttcttaacctggggactgcaatttcctggatgagttttgggggactgtgaacatcctgaaactgaacacaaaaatgctgtgtattcactttcccaaaggcggccagtggctttcatcagattcccaaaagggtgcctggcccatatgagattaggaaccactgcagcaatagaaaggagaatgttgtcaatgattttatcttgaaatttccactgaagtgtaatctgattgtgcaatgaaattgttgcatgcagctgccaaagccgagagacggaatgggtgaggacatcaaccactcattcataagggttggggcaggggctcactacacaggtagttgtcactgtgaggctgacaactcacacttcacaggactagcgcaagaattgtgtcttggccccaagaggttcctctgtggctgcccttgccattcacccactttccagcaagcacagatgtacaggtatcagggaacatggggaagaaaccccaggctccagaagcaatggcacaggctcaccttccaagctctgctcatttcgctgggactcatttcccagggatccctcactctgacccatagccttcctgacctgttgtgtgaaactcactccacaaaccctgtactttctgataacagctctcttccttttttatctgggccacctcttggtgtggtgcagggatcctgatgtgggaggtgttcagcctggggaagcagccctatgacttgtatgacaactcccaggtggttctgaaggtctcccagggccacaggctttaccggccccacctggcatcggacaccatctaccagatcatgtacagctgctggcacgaggcaagtgtattctctgggtgggctggaaggggtctcaggcacatccggggtgattactgcatcaccactgggacaaagcttttttgagggaaagcaactggtacagagcaggagagaatggtcctcagcccctgccctaaaatgtttgtaatctaaaacatgcgggtgccaaacaatttactgaacaacttacatacagcagtgttctaagaacactataaatattaacttacttatgcatcaggaaacacactgaggtaagtactatcattgctgaaactaacagaagagtaaacaaggactcagaaaggttaagtgacttgtccaaggtcacatagctagtaagaagtagactagctagtgccagcgtccctgttcttaactgcaacactatggagctcctcgagtagaaaataagtagcagaaaacatctaaccacacgtagagaacacataatggacactatcccatcttctctccccctgcctcccaaacactgaataaaagcattccatgcaggtagaagataagggtatcttatggggaagacatggagctgaagcttcaggggattaatttgcaaagcatccactaagttcatagaactaatggaggttgttaaggaagtatgaggctccatttgtgccctcactgaactcaaagtctttacacacacacacacacacacacacacacacacacacacacacacacaaataggactgaaaacaccaagcagtttataattatgtgcccaaattagaaagacaaggtttttgccataactttcaatggcaaaaaacgtgattacttttgcaccaacctaatacaagaagcgctcagaggaaagagaaaccagcttcctgagagaaagcagcttcttgaatgcattggtacctgagctgaagcaggaaatctctacaaaatttcctaagtatgtgagtggagacattgtaaaagggtgtccaggtgagaacagcacaagcaaaggtgtggaggcaggaacgagcatggcacgctaggctggtgctatcgttggaagggctggagataagtttggaagagtaggtctggttcaggttctgcaaagtgaataacaaggagacaagtgagagttttggtttttgtaggcgatgaggagccactgaagacttttgagcagtaacatgataaaaggaggcttttgagaacattattctaagagcccatgttcataatcattatatggtacttcctcaatggcaaagggcctaatgctgcattcatttattcactagtaaaaggcaaattggtgtaatggttaagcctgtgggttctggcatcagaatacctgggttgaatcctgtcgtgatcacttactagttatatgaccttgtacaaacctcctattattatctctgtgcttcactgtaatgtaatgcttacctcatagaatttttgggtggattgaatgaattagcattataaaggccttaggacaatgcctggtacacagtgctgtttttctgttattaatattgtgtgtgtgtgtgtatatatatatatatttttttttttttacaaagcatctatgcaccaggcagtacgcttggtgctaagaataaattgacgcacacaacttaaatagtttctaaactcttgtaccggagcctagagtcccactttggaagagttgctgattgcatcacataacaatatttttcgtttagccttaaattatcacctggaatatgagcactctgtaatttcccaccctatggcatttggaacagtatataaggtttccacacctttttctaccccaaatgttgactatgggaactatggatatggacagagatatgcagactacagtggccaacagagcacttatggcaaggcatctcgagggggtggcaatcaccaaaacaattaccagccatactaaaggagaacattggagaaaacaggatgagatgttaaagtaacccatcttgcaggatgacatagaagattggtcttctgttgatctaagatgattattttgtaaaagactttctagtgtacaagacacagtgtccaactgtatatggctgccaattagttttctttgtttttactttgtcctttgctatctgtgttatgactcaatatggatttgtttatacacattttatttgtatgatttcatgttaaacttcaaataaatgcttccttatgtgattgcttttctgtatcaggtactacatagctctgtaaaaatttaaagtaagcaataattaaggcacagttgattttgtagagagtattggtccatagggagaaactgtggtcctttataaatagccagccagggtcaccctcttccccgatttgtagatgtattctatgctcttaaggtttcatcttctccctgttaactgaggtttctaccacacttttgaataatgttctttcccctctggttatctgaagattgtcctgagaggaagacataagtgttgtgattagtagaaactttctagtagaccatgtttcttctggattgtaataaaattgttagtagctccttttgctttgttcctgtctctagaaagccatctttgaatcgttaattactttggctttaatcagtggtcacctagaaaaagctttgtaatcataacaccatgactttaattcttgataaaaattcagatgcacacaggaaggagcactgtaaaactggtaggagctatggtttaagagcattgaaagtagttataactcaaggattttggcagaaaggtatgagtttggtcaaaagttagattaaaatttgaaatagcggcaaaataagatttagttgtattttgttttctcacagccaccacaagactgaacaaaatattttctgtttgggcattctgaggaagctgtattacagttaactgttaatgctgtgtgagtttagaaaaagtcttgatagtaaatctaacttttaacacagttagtgcatgaactgagtagttaaacatttccgtattcagacaggaatagtggaaaaggtatcttaggtgcgttactcaatccaaatgtgactgaatcattacagtggaccctcatggtgcattgaaaagaaactgttttatatccaggtttcagaggacctggataaataaaagctttggattttgcattcagtgtagttagttggattttgggacctttgcctcaatgttagctactgggattggcatatgtgttcacaggcagagtagttgatctcacacaacgagtgctctcacaaaactggtgtaagtttcttatgctgatgagcccccgcttttttttaatttggtgcctacaactttgttacaatgattgtacttgctgggctatcaagttacaatgctcttggtcttttttgctgctgtttcgctatttgtccttacacctaggccaagtaccaatgttagctgttggaagggattctgtttattcattcaacatgcaactatctaactttagggaatggaaggaagttcatttttaagttgtgtgttgtcagtaggtgcagtgtctagggtagcgaatcctgtaagttcaaatttatgattaggtgacaaattgacattgagattgtccttttccctgattaaaaaatgaataaaggctttttaaagaaacaaacaaacaaaaatattgtgtctaagattatcaggcagcactagagggtcagactgggtctgggtagagttggtcacagccaggctgacttactgctgtcacctgtcagatgaagaagagcagacaagggtttttcagttgaagcccagaacctccctggccctccctactctagctcctgggaatatgactgcaccataggatggacaggggccctgagtcgggaggaactgccttcttctcatggttggttcataaaagcatgtgaattgtggcagaatctgtgaagaggggtttgcactgagacgacaatatccagttaaaacattgcacctaatgagcagagcttatagatttgggttttccctccttttttagattttattttgtgactttctcaattcataaagagattgaaagaacattcacaattttcattagattttgattcatccttctggtatttctgtatgcaaaaacaagcatatgtatagatgtgtgttttcttgcttccctttctctcttacaaagaaaaagtagcatatgaacttctcctctccataggcgttgcctcactagcaatgtaagagggtacctattttcttataacctcaccaatggagtgcattgtcaagcttttgaagaattcttgccaatctgataagtgaaagcttgatggcatcttagtgcagctttaatatatatatctttcattatgaggttgagcctcttttcacgtttttaagggtcattttgtgtctttctgaactgtcatgtcttttttcttttttctgtcaggttttaaagatctctttacaaattagggagagtaatactttaagttatcagctttatttgattgagggtgggtgggtttttttttctttttttgaccatgcagaaatttttcttaatatagctgaatatatcaatatttgttttcattgcttctggaaattgtcatagataggctttctcatgcccaaattataatgacttttgccaggattttcctctagtacttttaagattgcattattttccatttatgtttctgatatagtttgtgtttgttatggtatatggtattaaatatggctccaaatatataattttatgtgactattctgttgttggcagccctatttattaaaagaccatcttatcatcaggaatgagataccaccttaatggtggtgaaatgccaccctaatattatactaaatttccatatgtacttgaatctatttggagacttcctcttctgttctttggtctctttgttcatgtgctagcaccacactgctctgattctgtagagactttatgatatgtttgaatactaggtaggctagcacccctcattgctcaccttactgtataatttcttagccatttttacatattttttaattctataaaccaaagaatcaatttgtttagcttgaaacaaactcattcatatttttgaggagattgtatttagtttgtattttaagttgggaaatttgacatctttatgatactgacttgtcctagtctagaacgagggaagctttttttttttttttttttttttttaagacagagtcttgctctatcactcaggctggaatgcagtggtatgatctaggcctactgcaacctccaccttccaggcttaagtgattttcatgtcccaccctcccgagtagcttggactacagttgtgcacaaccacagctggctaatttttgtatttttagtagagacagggtttcgccatgttgttcaggatggtctcgaactcctggcctcaagtgatccactcacctcagcctcccagagtgctgggattacaggcgtgagccactgcgcctggccagggatgcttttttatatagtcaagtctacatttgcatttttcagcagtgttttaaagtcgtccccattttagaggggcacacttttttagtgttttattttggtggcgttgctattataaatggggttttctcttacatgataacttctaagtggttactgtaggtatatgtgaaggctattgattttgtatgttaattttatatcctgctctcctagtgaattcctttattctttaagtctgttctaacattgatactctcagattttccaggtatacactaaaatgcttgcaaataaagagactttttcttttccagttattggggctctaattgttcttgctttccaattgcattggttaacaccttcaacataatgttaagagtgattattatagtgagcgtccttgccttatttctgacctcaattgaaatgtctgttgtgtttccacattttaaaagttgctagctttaggacttagatgtaaatattttatatattttatcattgatcataactctcatcatctaaaacattgggtttcttgttgtttttgtttagcttccagaaaagcgtcccacatttcagcaactcctgtcttccattgaaccacttcgggaaaaagacaagcattgaagaagaaattaggagtgctgataagaatgaatatagatgctggccagcattttcattcattttaaggaaagtagcaaggcataatgtaatttagctagtttttaatagtgttctctgtattgtctattatttagaaatgaacaaggcaggaaacaaaagattcccttgaaatttagatcaaattagtaattttgtttatgctgctcctgatataacactttccagcctatagcagaagcacattttcagactgcaatatagagactgtgttcatgtgtaaagactgagcagaactgaaaaattacttattggatattcattcttttctttatattgtcattgtcacaacaattaaatatactaccaagtacagaaatgtggacatttgtcttaatatttcaatgttttcaaacttcagtaggcatgataatcaaatgcagagtttatgaaaagattcctagaaactacctccataaaacctggcggaggaggtctgagtgcagcctgtgaatttgtatttttagcaaactcccagatgttactgaagcagttgttctgaactgccctaggggacctcattatatggtggggtatcattaggtggtccattacccaatccaaatggcacaattctcgtctaatatccagattagtacaatgactctttatgtcatgtataaaactaaagttaaataatattaaataatacattaaatatgttcacataaagcaaattttttaagatgctgaggtacaatttctagaattaattacattgttgctttctaatcatcttttttttttatataagtagacagtttatttgggtcaagtttaaggattataacctgggagcaaagactcaagttgcctggaatctacactttgattagcagcagttgcaagaggagttgtaaagacaaaaacaaagggacagagagtgggctgatacagagttgtttgtcagaaatttttatttatttaaagaaataacattggttattgattagatatatatcattatggtttagggtatgagatatagtgtccaatgtggtattattagtttaatatatatctacttgtggcaatagtgaacagtttcaagagatgaatacataatttaaagggggagaacgacataactgcacgttcatttcaatgtctgagtttgataaccaaaagtactttcattttttagataaaaattttctatttcccaaatctcaagacctggatacaaaatgtagagctgcagatttaaggcctgaatggctggagtagcaggtgttacctgaacatttgtgaacattttaccaagagaaaaaaggggaaagtggagattctcatgtctacatgtgtactcaatgaacacatgttactctgattaggtttgtgggccccatggtctccgaatcagtttcaggtctgaagataacaagagtcattgagggaaataaaacgattgattgttgcccagtgaagttggtagaaattaggatgaactatgtatgacatggtgctgtaaattcttctacttgtggactaattttggtgaccatctgtctaatcatcttaaatccttgagtttggggatctggggcttctggctagtttgataactgaagtttctatttcagtctgctatcttaacacaaaaatacagaagtactattttagcttctcatgcctattactaaatagtatttcacctttaaaacagtacctgcggatgcccttcttcacggcctgctaccgaacccacaggttttaacctctttctgagtattccattgtcttttctataatgtcaagaagggagagacagattctgtagagggcaccattacaatgaagagacaccccaattaaaccctgctgctattttccagagatcagtcaataatctctcagagacacttatatcctctctcatcccactctgtccttcagccaccagctagtttcaatgctccctcttgcttatttgtttcttgacatttcattaataattccttcatttcaacacagaattgacactcgttaacagtcttctattttttacagaggtacacaaatctcaatttataattaaatgtaactcaaaataatcactagggcatttgtatattttatttttgtgggttttttttgtagtgttgactgtatgctaggttctttcctacccaagagaaaagaaagaacaggtgacccaaaccctctttctcaatggacccacagtccgatgggggtgccagcctttcctgcaccaaagactgtttccccactcagaggatgagctcatgcacaagctgggtctttctggtctccctctcgaagatttttttcctttcttcttcttatttttgtatatttaccttttaaaaataatcctctttataacaaaatacacgcttgttgcaaaaattgtttactatgaaaagaggccaaagccctgcttagaagcctagctgcaaaaatcaagtcaggcagcaatttaaggtaccactagaggtttatcagaaaacaagtccagtgatgctaggaggagccaagtaaaagaacactattcatagtatttcaaacgtgcacaatgattttttaatgctgtataactgtgtttagtggtgatatgcagaatttattgttgttatcttaaaccaagtgtctgcctacactcttttggcagtgaagaaaaaggaagactatgtggtaagaaactttcccaaagggcaggctgcagagcaagttcagataaatcacttgctaggtaaaatccaacagatgctccctcgtcttgctgagcattttctgacctaccagaagtcaaacacaaagtcaagagggtctggcaaaactcacctcatatctacttgagtttattaagattccaacacagtagatttagcaagttgagtttctcagtttttattctatcttgagagtgggtttatgaggaggagagattggacctaaggccccatctttacctaaatgtggagggaggaggctctcaaattaggaagaatagttcattgagagacaccagagaagaggaagctagcacctgccatttctggcctgatcactatgtttctctggtctgtgagctccacaatggaccttttgcatttgcagtttcatttaatccttgcttccgtatagcccagggtttggcaaagtttgtctgtaaatggctttgtgggccatgccgtctctacttcaactactcagctctgctctgtagcatgaaagcagccctagacaatatgaaaatgaatgggtgtggctgggttccaataaaactttattatggacactgaaatttgaatttcatatcattttcatttatcatgaaatcttattctaatttttttcaaccacttaaaaatgtaaaaatcactcttagttcacaggccagacaaaaacaggtggtggggtggccgggcacaatgactcaggcctgtaatcccagcactttgggaggccgagtcaggcagatcacctgaggtcaggagtttgagaccagcctggccaaatggtgaaactgcatctctactaaaaaatacaaaaaattagctgggtgtggtggctcacacttgtagtcccagctactcgggaggctgaggcaggataatcacttgaacccagggtgcagaggttgcagtgagccaagatcgcgccactgcactccagcctgggcgaccgagcaagactccgtctcaaaacagaacagaataaaacaaaacaaaacaaaacaaaaaaatgtggtgggcaggatttggcccatgggccattgtttgccagcttccatcctaggcccaggcaccggtccctctttgtagagtctccatcctttcagaggatgctgctacacaggagaaggaccacaagcgttacctggtgggcacagtgaggactgttctggagaaaaccccaaaattaagttacggaaataagcaggtttttctttctgtgttacagttggacactatgtcacatgcacatgggtcctttgccatgtctggggaggctcttttgaaggtgttagatgatgaaattggttcctgcagaaattattcttgcactgtgctgaaccaagtttatgaacttcataaagatcttgtggcaactacaaaggatgtttagatagcagtagcttgacagaagattttcatgatatattagagaagatgggacatatgcaagataaaagaaaaaactgtctatgaaatggttgcttagccaaggagtaaattatattgtatgttgccccaagctgtgggcccagtgaatggcaggatggtgcagatggtgatgcgaaatgttgattgtatctcgtaaaataacaaagaactctatctctgctacctgggtatcagataattaagacatcaaagagcctcaaatgacccttattttgaggttattttacagattatgaaagtcatcttcccttcacttggctaactgatccacaattaccatagagaatttatgaagtacaaagtcattgtaacattatgctggtcaccacatagaatgagttaatgcatagagtttagatatgttaatctatttaatctagttttaaccagtcttcaggtatctaagaaatgctgtgctcacactggggtagtgactgtgagaaatataaaagcagcatcaggtttggttcctaacctgatggtgtatacactctgtacacaacttttttgggactagttttacaattactttgtacaataaagcaatctgagaatttgcaatacatcacgagacatttggaaggccaggagccccagacactcagatgataactttgttcatagaactgaaaagcagacaaaacgtaaagaagccccagcacataagtaagcacaaggagtgtgtaaatctagcatttattgagtgtctgctttgtgctcagcactgctcaaacactgtgagcaaatacaaaagatttaagagactgggtacccacttcagagggtgaacatacagttggaatttccattcactccacagttagagaacagtagaaatgagtttctatcaggcatgctctgggagttcacggaggcccctggctctagttttgtgttgtcagggagatgttgatcaagcaccttggaagtgaaaaagcaatgtcctctacctgttccctggattcttctctctttagacctgtcaccttgaagaaagcatgatcgattccaaacatcactgtaggcaaatcaccatagtacttgaactgagttactgtgaagaaagcatgtcatccttgacaatggattaaatgaaagtgagctaatgcatgccattctcaatccttgcagctacaccagttcccaggcactgtccttacaagtgatccatccatattccatacaagatccaacacttgctccaatgatatatccttgttttcaacttcagaaattcaacagacatttacatttagattatccctgaacagcctgtgagaccaaatacacactttccctaatatactctaatacaaaatccttattaagaaacagaacagaagtcaaatccagagacagaaataaatactgaaagcaatgtcaatgaagatgctctctccttggccatgttgtctttggacaattttttttctgaacagagtcatagttttgacatttaatgatatctttatcatcttatattttctataccatgaaattaacatttacatacaacaaaatcacctcaagaggaaaaacatagatttttctaaaaggaggtctgaacatcatcagtgttttggaatcctggattattttctcctttgctaatatcgatggaggcataaggattttctccacttcttgctttatttttcctgttaaatagagcaaggttgccttaatatacttatgttaaaatcaatcggactgatgaaaatcaaaaagtttcaggggaatctgtgttaaggaggctgggagggaggaacaggaagtttcataaactgttgatgtgagtataaattggtacagccgctattgagggcaatttggcaatatttatcaaaattagcaattgcacgtatgctttcacccagctttcccactgctaggattcatcttaagggtatattggcatactcaggaaattacctatattaagccatcactttttttaagtaaacacaaatgtttggaaacaacataaaagttcatcaatagatgactgtttatcaaaattacaatccattcgtgaaatgggaaattatactgccagaaaaaaggagaagttttttgtgcaactaatgtgtaatgatctctaaaacacattaagtgggctgggtgtggtggatcacacctatataaataaaaatttaaaaaaaccattaagtggaaaacaaaatatgcagaacattgtttatagcctgctaacatttgtatactaagaaatgagatatacatatgcacatacacacaaatatacacactaaaaaagtatatatttgtatactaaaaaggagatatatatatatatatatatatatatatatgtctgagaaaaaagaaaaaagactgtgtgtgtgtgtgtgtgtgtgtgtgtgtgtgtgtgtgtgtatctccaaggaactgataattttgtttggctttgggaagataacttggaggcaaaaggtaataaggaagactcttcatgttcacctttgtattttttaattttaaccatatgaatgtattacacattgaatgcctaatattttagatggagctattttggagaaacgaaaaatctctatagtgaagaaaattgagcaaaatagactagcaaatatagagattcaatcaagaatatgtttaaacaagctgaggtgtgcatagagttttgttaggtgctataaaatattaaccttcattccataagcccagcaagagtcaatttcttaaggacagaagaaaaacatctagtagcaaagcaagactagaaatcaggtctctggtaatttaaatcctcaatgaactttgatcttcagttcaggaacaaattagaacgtgcctaaccatgaactaagagaatgacatagagtctgagctacccggtgagaaataaagctgagtaaagagtagcagtttgggcagggcacggtggctcacgcctgtaatcccagcactggagggcgaggcaggcggattgcttgaactcaggagttcaagaaaagcttgggcaacatgacaaaaccctgtctccacaaaaaatacaaaaattagctgggtgtggtggcacacccctgtagtcccagctactcaggaagctgaggtgggacgatcacttgagcctgggaaatcgaggttgcagtgaactatggttgcaccactgcactccagcctgggtgacagagcaagactctgtctcaaacaaacaaacaaacaaacaaacaaaaaaccaagagtagcagtttcaaagaaatctcacagcccattcttgaacaatttcacggttcaaacccatcagcaatccagtctccagcaatccagtccccacttttagactgaaaaggattcagcagtgagagcagtgaaaaccattccctgagcccacccatacctgctgagtttgcagtgcctctttgtaggagggaaatgacactgtggctgggatggagtttactagggcatgctaataaatcccaggccagatacttactgtgtgggcttactaggaagatgaactgctgatctattaaatttctagggaatgcatcagagtatttagttgcaaaattgtccaactaagtaattggtctatacaatctaccacttactgaaaattttccagttactgttctctaaatctttctatttttggatagttaagtctaggaaaggccacttacttcttccgatctctgatcccagtgaagatcaggatgacaatgccaaccactatcactcccatcacaactccaaaaacaatcagccatatggaaacagggggctggttaggaggtccaagtgttggctgtatccccagaaactctaggctgttgtcattcagacggaaagcatcattgatacggctccgggacatcctatttgcaaaagcaaaaaacagcaaaggggacacttagacaaaataaaattgtgtgtagttatttactgtttatatcattgttcctgaaaggatataatagagcttatcataagaatatacacctagccaggcatggtggcgcatgtctgtagtcccagctacttgggaggctgaggcaggagaatcgcttgaacccgggaggcagaggttgcagtgagccgagattgtgccactgccctctagcctaggtgacagagcaagactctgtttcaaaaaaaaaaaaaaggaatatacacctaaaatcataagagcaaagtaaataggtctaattaaagatataagtctttgacaattatgcatctttcatgccttgcaacctagattaggttcatcaacagctccattggaaaattgagttgtaagtgtggaaatgtataaatggttggcatttattcatttgtgactgctgtgtttaagggcaaagttatcatatttggcaagaatttcccttctgtcagagtacatctacaatgactttatatcaaataatggaaacggataattggatacacctcttctattatacaaatgaatcaggtcctatgaccaagtctctatagtagtattttccaaataaaaggtattggcatttggaggtagcactggggaggcacataagaaagggacctttgccagtttcttcagcactgggatgggaaatggcttacttttatggaggcaaaaggataaagattgtttaaagaaaaaaaaaaacaatgatatggagaacattctggatcaaagaccaaagtgtctggcatctcatcttcctacccttgggtatagcccaggtcaggaggtcagagtccaccagagagagagagagagatcaacgcagaattagtcaggtaacccctggcaacctcagccagaaaagatctgaaaagagtcatcctggaaacagagagtctgaggtcccctgtagcttgcagctgagtatccaggaaggctgagctttttcataaagatctcagccagaagtttttcccaagacagacacaagtcttctggaggaagtgagtgagtctctgggcacagttgggtcatacactccaaccaagccagattttctaggcacaccctgcccagcaggtcttagatctgcttccgaagttaaacaggactctgacgcagctcgagagggccacctagtgagctgcccagaagcagtaggtatattaagcctttttataatgacaggaaaccatctgcaaggtcaatccattcttcgctcctgctgtctgttgtgggaaacaattgaggcaaattggacaaactgtttcttctaaacattcattgcaagtccctcacctagcatagaggccaagcaatatgtaaggaatcctgtacttgcctaccttgtttcaggatttgggcagttaaatgaatcctacatcaaagtcctgagagcaaatgatggcaatacctgtccacgtcccttctgcacttactattttccatgagttctagccagactttcttcaaccagcacctgctcccctttaccagagagcattctcagaccacaagatctgccctgcctgcagggctgaaatgctggggaattaatgccacctggaagcagttctcagccaataactgatgggaggtggtaaataaataccccagcttcctcagccctctgatgggacaattcaggtgcacattctacacagtctctccacatttcccagcaggactgagctctagttgcccatagtggtaacttgcttgataacatgtaatctatagtttttcttcccttttgtaagagcctacatctggcggaactcaaatcaagattattcccctgctgtgggatccttctggaattacgtggagtttgtagcatgaggtaacacatgtaaatgactcagaataatgcttggcacacaggaagaacacacaaaatactggttattgttgttgtatttggtaaccccctcacccttagatgaaagtaaaatgtcacctgatggccttttcaacttcagttctaggaatgatatcagacacatttttaggtgcagtgacaaagaaattaaaggagattcttggtttcaaattagccactcgcacatcctcctccctgtagagaaacaaaacaaacatcttcacttgtggcacagaggacacaatcaagagaatgaagacttcccctgctggtgaaaaggagattagagagagaatcacaggatagagagacatgggggagggcaaacaatgagaggatgtaattgtcaaaaaaaacattaatgctgcccaaagcacatgaaatcaactacataaaaattgtgatatcaagttttggcactatttgttctgcctttatataaaacccacatctttttcaattatagaaaatttccaaactgaaaacagcaggagaatcaacaaggaataatcggtggcccaggattgtggcaaacaatgtggtgggcagaaatggctgagtaccacacacggatttacacccacaacctggtcctacccagcagaaaacgtcgtgttgcacccatggatgaaggtaatgagtggggtctaccatatgatgtgacaggactgtgctctcacagctgtcaagcgatcctagcacaaaataaggtagatcatgtggctcatagcccttgagtgactactcatctaactcagaataaaagccaaagtccttagaatggccttcaaggcccacatgaccttttgtctctccctccttcctctatgccctaacatcgtcctggccatgtctccacttgtcttctaatctgctccagccacactggcctccttgctgttcctttaacaggctgaggatattccttcctcagggtctgcacctgctgtttcccccagctgagacactttccccattgtctgcattgctggctctcgctctcgctctctcgctctctcgctctctctctccctctctcctgcttcatatacttgttcaagtattagtgacgtcttttctgaccattttggttaaaattgacctaccccctgcccaacacacacacacacacaccagccctccccagacccttttatatttttctcctagcacttagtaccttgtaactctatatttcacttacatattacacacatagacacatacacaacatacatactagaatataggtcaatgaaggcaggaagttctgccttttttttctttcagtgctgagggtgtatgagagcattctgagaagagagtgacagctgtttagtaagaacaatactcttgcaatttaccagtcaaataaggcacgatcagccctctatggagtcacccaaattccacaataccaaagaagtataagttactaggagatttttatcaatttcacttgaagaaaagtttaggcagagtatctcctcagactcaagagtaagagaaatcctagttggagtaatttgagaacccagcaaatcaactcacccaaaaagaatcatctgattttttacttttaaaaagtactgcctcatagcatatgcaacagatgatcggaacaggtacatttcattgtcgttccattcatactgcaaattcagaagaaagacactgctcagagggactcgtaagacacatttataatctgatactcctcaagaattattcttaatattccagagattcttgctattcattaagtcagtgaccttcaatgtaagtgtgcatccgtatcacctgaagggttagttacaacactgagtgctgggtccacccctagagcgtctgattcaggaagcccgagatgaaacccaataatttacatctctaacaaactcccaggtggtggtaatgctgctggtcaggcaaccatgctttaggaaccattgggttcacgggtccttttactttagtttgatgtaaactgaaattaacaccttgagtgtaggtttaccgatgggagtcaaacaaaagttgtgggttttgtagcaaaatgtctgtaccttgtggacaaaatcagtttttactatttttatggtacgttctcagaaatgtacttatctataagtgtaaaagaaaaacttgacattcaaatgaaaaataacactttgtaaacagcaagctaatctgtttgttcttgttttccagtgctaaacaaatagcttatgtttgcatagcttttaaagacttaaaagaaagcattcactctttcctccagtagctggcagtaggaatcaatgaatggcactagttgtatgtttctcctttccctttaaaaaattataatatttcacaaaagaattgttacattcacttcagcttggtttcaccgaggtttagaggagttcctttaatagtaataatattattaatattgttactaataacagtctggctactatctctataaatataaaatataaaagattttaaaggctgagttctcaaaataatgccatagatccattggaattcaccatgaaatagtttgaactgagcagatattctgaccctgttgtgtagatgcactaaatatatgatctcgtttcatcaaaacagattgttgctcagtgaattggcctcagaacattacagaatcaaaccccctgaacactatttaccaaccctcactgcatggaaagaggatgagtataaatgtcaagaaaaaagataattgaaaatatcctgatctgccgagactaattaaaatgtattaagccaaggaagagctaataaaaatatgacagagaaatagtcccacaatcacccaatgattattatgaaataggaacttgaactcttaatgattggaaagaaatgcacttccattttcattttttctttcttgaatgttcatctttttactcctgagttatttatgttttgatgtcttaactatgaaaattatactaaaagtgttattgaatcttggacaatgtttaacttttcaggaaaggtaagggggtagaaacacaatctttggatctatccaatgcagacaacaatttgctgtagcatcttggaccattttatccaatagtcccagattgacttctaaccctgcaaagccttcagggtgtcatacccactctcaggcttttgagccccatctacccgagactactctttcctctcctctttcccaatcaaagctaccacttcctcagactggatcatctgagacaggtgttaacgacagagcaatagctaagtaaataattcacattaaggtgtaaataacataatttcctgtaaaatattttgttacccccaaaatgcatttccctaaataagtggttctcaaactttgctgtgactagaatcacctggggagctttaaacactcttgatgcccaactcttgactccataccccagaacaattaaatcagaatctctggaggtgtataacctaggcattaatattttttaaacttcccatgtgattccactgtgcagccaagtttgagaagcagtgttctaaattagagcttcccagtcttgattgtacgtacaaatcacctggaggcttgctaaaatgcagattctgattaagtggtccagggctaggcttgaaattacgcatttttaacaagcttccaggtgattcaaatgctgctggaccatgggccacactctgagtgaagccaggatacaggtgattgactaaaacaaaacaaactaaaaaaacctaactgtaccgcttctaaaaacaaactacctttcaaaatataaccatattctctttctagaataaaagtaatggtgacgagagtcaattgaaaggattggtatctgatatttaaggattgatacagatattttctcattgaagttcataacaccttcaaggcaataagaagtaggaatagcttatccaataaggaataggttactttaaaaacccaaagccaaaggccagaatctggaacttatagttttgaaaagaaccacatggcctctcttctttcagttcacactgaaatgggtttattgtgtcctatttaagtgaagactgtgcactcaaaaataatcaattcactgtccagaatactcactgctttatctccaagagctgattttaggcttatcctcactttgatgctttggtctgcatctgattaaagagaaatagcagactgctggttacagacaacagattgcccacatgtgcttatttccttttcctccaaagatcccactaaagtgatagtaaagggatcttttaaaggtatcaacaggcttttggaaaacgagaaatgatgagacaggggtaactgctttctcagggacaggaagccatgacctaatttgtacacagaggaggcacagacccacaaagagccaaaaaatccaaaagaggtttggaattcaagcacaggtgagggtgggaaaataatactgggctgaaaagaagaggaatggaagtcagggtgtggttaaaaccactttggagaacagttgatcctcctaccccttgtgcccctgcttggacagtctgtgggaggctatgctccagaaaaacaagaggtaatccaagaaagaagacatggaatctaggaagcagtggattcaacccaggagaacaacaaatgttgggaaaggagaatataagactccaagagggaagtctctagggaaaaaaaatgagactgaaaagaatagatatgttgaaatatttgggagaaaaacaaatacaacgtagatagcaaattaggtaagccgaaaaattcaggcaagtagaaactttgagacaaacaacaagccacataagaaaggacacaaaataatacattacttggctcttcaggcatagtgatgtaaacattgataactgttttactaaaaatcattataaggccttattggaagagcaagaaatggaagtggaagagtagaccaaaacgaaggtttaaaactgagcaataacaaaatagcaatataagaaaattatttagaaatatgaaagtgactgccagaaagaagagataatagcattaaaattgttttaaaaaaagtatttgtctttggaaagcaggattcgagtacagttggttggagacagttataatatgtattttaaagatgagactaataaaacagacttgaaagagtacacactcttgtatgtgtatgcacacatgtgcatgcatctgtgtgtgtttgtctgtacagttgctttcactatgtctcatacataggtgctcaacagttgtgatttttctcccataaaatggcagctgtcaccatagcagagaaagaagcaggtactatagagaaagaaacattctcagctgtgtcacaagtcctcatgagactggggccaaaggagactagacgaagtagacaaggaatgggtgtgaaacttgtcaactgggtgtactcacatggactccagtcggtactccatcccacaaaagaattcttgttctggtctttcagccaggtaaataagggctcaaagtagttgagcagtggccttacattcatgttctttgctcctacaacattttccaatgctagggtccagggttctgattttccaagcctcagcatattgctacacaaaaaaagggggttcagggccttttgaggggttccagatgtacatatatttacatctatgatctatggtttcttctctttgacttggctaaatttgcttctggcagataagaaaagaatgcatattaacagatatattccaccctaaaccgctctttccttccaattaccaggaagagagggctgtagttatgatagggagaaaagaggtggcccacccaattgttgtatggtctaggttcctgtctgaccacaaattaaatgtttggtttgtaaatgaggacattttgaggccataaaattttctttttagaacaaagaaatcaaatacaaacctaggcatggaaatgagtaatactgaatactaggagaggttcaacattttgaggtatttcttacaacagtttctgtccagcttctgtagagtttgagatgtcacatttgtgcagagggccttcatgtttagctgcttgacaaagtgcttcttgaaactggaattggtaaagggtccttgtgtaatatctgcacaggagacaaagcaacaaaaaagcagtcccgtgtttacttactgtcttagagttatagattagggcatatatttaaatctggagcccaagtaaccaaagagatactgatcaaatctctgaaatctctttctccagacatgaactctacactcatcataacctatttgtgttttatgtatctgttgataaacatggcaatattactctgttaaatgttagctaacatttgttttgtgttttacagattaatagccctttcacataaatgatgcaaatccatccttataacaggtcgataatattattttcattttacaaataaactgagctccagcaaattcaaggactggggttactaggtgaagaacatatgtttttggacttcaagttaaaaattctctatcacaatgtacaataaactgccagtaacaagaagacaaaactactttttatttctcccaatgatactattgattgctgatgacggggacaagatcttacacaagtttaatttaacccaataaattgtgttagtttaaattgaattgaaattgatcatctatacagacagttcccaacttacaacggttggacttttgatttttcgactttacaatagcgctttcagctgtatatgttaatggtaagtacccaaagtttttcactttcagcacagtattaaataattacatgagatattgaacactttattataaaataaggtttgtgttagatgattttgcccaacagtaggctaatgtgagtgttctgagcatgtttagggtagactaggctatgctttggtgtaccataggttaggtgtattcagcgcattcttaaggtattttcaacttatgatgagtttattgggatgtaaccccattgtaaagcaaggagcatctgtattgagcttggtagttatgggtggaaatagaaaaattataattatcacttcatttatccctactttttgtcgttattagcacagctgtccacaaaccctagaagttaaacagaaacaagaaaactgtaatttaccgaatgaatgagtaatcattagaaacatggaacagagatgcggggtcacagtatgtttcatcatggggcacaggttccaccaccccaactatctctcgcctttggggagaaaagaaaacaatacattagctgtggatcacccatcacaagcatcacaagcaggtgggcataactagtgcagtttcatcaatcaaattttttttttttttttttgagacagggtctcactccgtcacccaggctgtagtgcagtggcacgatcttggctcactgcaacctccgcctcccaggttcaagcgattctcccatctcagcctcccaagtagcttggtttataggtgtgcaccaccacatctaactaatttgtgtatttttaatagagacagggtttcaccatgttggccaggctggtctcgaactcctggcctcaagtgatctgcccacctcggcctcccaaaatgctggaattacaggtgccaccgtgtccagccaatcaatggtatttacattagaaatggttgttgggtgaaatagaaacaatgtaaaaaaaaatcacctacaaaaataaaaaataaataaaaatttttaaaaaatcagacagtaaagctcattatgtagttatctcttagttttaattaattcagccagaatatacccttggaaaatagctatgtcttcaaaagactaatttaataacattcataaagtgcattgcatggccaaaaatgtacagtgaaagccctaataattcctctcaggcaccacacttcatgtactcctggcagagagaatttaataaaattgaaatcttacttattctccacgcctacctagctcaagtgttccctcctctgtgaagcctggccctgatcccatccaccttctggcagaattaacccctcaatctcctttagccttctctagttgtgcctcctttgccatttatctccccgttttgtagttattcaactatagtaacttcctgccctagagacttgagctcctagagggtggggctgtgtcttggtcttctctctaattccagtgtcaaacatggtgcctgacactacagaaagaattaatttatatttactgaacaaaggaacaattgatgcattaatgaatcactctaaggatctgattccatgtgcctttaaaataagctaagaggggtcaaaagattaatccaaccagaaaaaaaggtagcaaaatcatgtatttggctttgattaaatggaatacatttttcctttaaaattgcaggatcattgtagacataacttcagtaatatttaaacactggcaacagttcttataggtgctgcgtctttcctcccaagtacgatttatgttaacagagagaatcttgacagaagaagtgtactgttttaaacctgtgcatgtggaactgcttgttacacatgagttcttcacttcaaaaagaaaatataagaaaaataaagaaagaaataattgaccagggtctatgatggtaaaaagaagatagatttctttcttgtttccattctctccctccctctctcctttctttttttccttctttttctttttctcttataattccttcctccaaaaacctatttatttcatacttgcatgtgacaggcacagtgtgaggcacttgtgacacagcaataagtaacgtagtgctgcaaccatggaaatggtcactgttgcccaaatgtgtcaggttctctctagcttggaattctctgtgttcccctctacacccacacctttctcagggcttaaatgcctctcctcatctgacacccccagttgggctttggatctcccctggacgctaacggaccctgtaccctcccatcacaacactacaaattgcagtggtttaattttccacatcctgccataaactaaacgttttttggggttgaggaccatacctgaaattattaacattggatccccagtgctttgcctaaaatgtggggtcaccgttttgtttaaaaggctggataaaagaatatgtaaaatgaataaattgatcactttcaacataatatcatagtttaatgagtaagccaatacttaagaatatagagtatgaagtagtgtcacctgacccaaggaaattttatctgaggagatggtatccaaatggagactaaaatataaaatataacaaactaaaaatacaaaaagtagttagttaatgtgtgcctctgtgtgtgtgtgtacacgccagtcaaatgcttttaaatacacagcaaactcattagaaaacattttactgattgcatattcattgacttacttcatctcccaccactttttcatccactggtctttgggaatttcccctttaaagaccatccacctccacttctctaacatgtaagtaaatggcagagtcccaacaatcgtgagtgcttgtttgagcaggaagtttatttctgtttctgaaagtaaaatagaaaaggataaatattacgatgaagatgacagtggatgttttgtgttaaagagaattttcctaacctcaaaatattattcctcaagatgtacttactataaggatacatgagaaaaattgacagtattcataatgatatgtatatatttattttctcagctaagggatttggagtaggttgaagccctggaacagaacaggtaaataaaacccaaagttacttctaatcctcattttcttcattagtttcagtttcctcccttaaatacctcttatcagagttcattagagctatttcatccactttcccagtcacactgtttattctggaaagctccatgaagtcagtgactgttaatgtctcatttaagactgtataacttagtcccatgtctgctacgtgatgccttctgtgagtctttgttaaataaacaaatactaaacagattcagtgaaaagcctgtaaaccagggaggggaaatgaaacaaaagagccctcctggagggcactatccactggatggtgaaaagtacaatgtactttaaatgtaaggatatcttccttaccaagaatttaaaatgctttaacaaatcatgttatttcattttatcctttattagtgacataaagaggcagtggagttcatctctagtgtatgaaggaaatgcattgaaatgtaagcaggggatgttatctacttttcacatcactgtgtctccagtgtctagaaaaatgtcttgcacacagtatgtgctcgataaatatgtttggaagaagaaagaaagagaaagagggagggaggaatggaaggaataaaggaatttatttaacattattcacaaatcaggggcagagtcaagaaaaaaagcaggagttttccaaaccggtggtttaaccatgtctaatactatcttttttataaaaaaaaacaaaaaaagcttttattttaggtttaggggtatgtgtccaggtttattatataggtaaactcgtgtcatggggtttgttgtacagattatttcatcactgatctaatatcatcttaagaaacatagtcatcaaccatttttacctgctgtcagggaatatttaaaaataataaaatatctgttcattgacttgaattaatgatattttaaaattaggaagcaggtatggttactgttaactacctttgtttgttactgtcttcatgggaggatgctgctactggtctgtaatccactaggactgtgcttacagtaactatttcaaacatgatgataggctttacactggctcactcccaggcccttgtgggatcaccaagtatctggaaccagagatcaaggcaaagtgaattgtctactcaaggatggagctcatgaccttgacctcatcgaccaaatgctccagacagaggagctgatctttatgtcacaaataactaaaaataggggagagaatatacagaagagaagaaggtattaggctctatttgtcctccatttatgaggaagaatcaaaagccatggcatcctcactgaagaaattggatctcctgaacatttgtcatgttccatcaagtccaaggcatctaaaaggaaatgggctgcctcaggcagaaatgttgaaggatagcacagatctaaggggatgttacaggggaaattcacgcttcagcaggatgaacaaaatgtttcaatcccttctaatcttgatattaaacacctgttctttaagaattccaaaatttaaagctacactttgctttgcataatattatggaaaagactttagattagggctcttgttctggttccgccactacattgcgttttgacttcgggctactttccctctcttgtcttcagtttactcctctataaaatggtttttagaatatattccaactctaaagttttgggaagtttttacctagaaccagaggggtctagttagaatgctgacactaattggacaagccatttcagttctgtgagactgtttcatcatctttaagaaaaaaacttctgttagatatttcacaggatcccaagtccattcattcagttacctctcttattcccttttcaataatacaaaaccaaaagttgacatgttctgatatatacttaaattttttcaccagtagtaatttccagttacccataaatacctcataccttatgtggcaaaaagtaaatatttcctacataataaataccttttcccatatcagattaaagaacctccaaaacaagccatgagaaaatgtccataccattgtcttcttgaaaatcgggtgacagaagaccaatggattttaaatgcttaggtgtggctgcagaaagtgacatgatttccccaacagcttcatggaatccttcattagctccatttcttagcagaaaaggttgtgcagcatatgccatatcatactggatatgccccatctcatgatgagctgtcaggaagtcgtccattgtcacctttgtgcacataaggatcctgcatgaaaatggacaagatgaaaatgaatctcactgactttcatttaaccattacagtggagttgtatggggttttggtagcatgaatcatctttccaagatttattcaccagtgaatcttgagtacccacctcttatgtcctagagacaatactagttgctcaatataaagcaatgggcacagctgaatcctgttctcttgctcatagactaacaggaagacagataagcagagttctccgctacaagaactctgaggcaagtactctataagtgatcagtacacacagccttgagcgtaaaaatgagtgaatgtaggcacagttccctagaagcaccaagaagggcatgactgaggatacaatgagcaatttggaccttaatcaatgtgcaggagtttgcccggtagatgacatggaagttgacgttctagtgctcaatgagaaaggcttaggggcaggggggtggaaatgtggcattcaggacactgcacgctgtttggtattgccaggatagagaaatagtagaaggggctgcaaattgaaacttgggaatcattagcatgtaagttgggaaatagatatgatgggccatggaacaggaatagaatgcaagaaaagaggaccaaagataaacctttagaaggtccaagtacctaaggagtggggagaggaagattattcaggggagacggagaaagtacaatcagagaggtcaaggaaatctggaaaagaatgacaatgtggaagtcggttaaaaaaaaaaagcatttgaaagacaacttgtaaatcttgtctaatgctgctatagcccagtgggataagaactgcatttggcaatgagatggtggtcctttttaacttagcaagagcattttcattcagatgggtgtaggggtcatacatcagtagattcctaaatgtatttcataccacttggatcatgtcaccaccccctccaatatcctgcgaggcctcctcattgctcaagaataaactcagccaccttttatacaccaatatgaccctgtaaaccaaaaactatttgagataggtctcaatcaattcacaagtttattttgccaaggttaagaacatgcccagaagaaaagaacacagaatttatagaaacagtctgtggtttgtgcctttctccaaaaataattttgagggcttcaacatttataggagaaaagtgagctggagaggatagtgggagggcatggtaattcacacattgcaagagaaagggggaaggtaaggaaatattcagttatgtattcatctcatgctcagtaaatctattttcctttcacaaccccaacctacttttctaatttggtttctctctattctcttttgaaataattataaaaataactactatatatttaccgcctactgtatgtaagattctgtgcttgaaaacttacttatactttctcatttttaagcctcactctagtactggcatcagtaaactatggcctgctggccagccattgtttttataaataaatttttattggcacacagccacatccattggtttgtgtattgtctatggctgttttcatgtcacaaaggcagagctgagtagttgtaacagagatctgcaaagcttaaactatttactatctggccctttacagaaaaggactgtagatccaatccctaccctagtcaatgctggtgcgggcctgccaagactttatccaccatcccctagctgcctgagtcacagctgataagggcctacagctgctcccttcactgcctttggctaaatgggggttatgctcccccatactctggggcagtccacagccaaagactgcctgatataaaaggctagcccccttgtcttgaggtgtggcctagtctgtggctcaagttatgctccagagagcttcatgggataaggctgaggccaagtttccagtaaagatcacattcttacttacctccctcctttgtcccagcctgcttccctcattcccctctgcctcagagctctcctcaatgaagcacttgtaaaacgatctccttttcaagctagggaatccaacctaaggctctcacaagcctgcaacctgggaattactattctactttataaaataaggaaactgaaaccaaagaaagttaaataccttgtccaaggttgcatagtcattaagtgacacacctaggattctgaagcctgtgctcattctgccacattacacaaactctccttcacttatttctcattctagcctaacttgccgacttcagtatgcaggtcaggtcctgcctctctgtatttgatcctgctgttctcacagcttgggtcctcctcccgactctgtgtatctgaatccttcttgtctttccaaacctaattcaaatcccacttgtaaagcacggtctgatcctatctcctattgcaaatgtggtcagttttcttccagttctccatagagcatgccctgtgtctctcttacgacatgtaccactttctcccttcgatccaagcgtatttattcacctattctgtctcattcacaagagtgaaacatggaggggaagatcaatgtgtgattcatatgtccatcttccaaaaatcttagcaccaaatctttcctgatatgggtgcaaccatccccattaccatacaacgccaatggatgcatgatatttccaagaaagcagattgtccacaggttcaagttagagcctgctggcaatcctcttttcctgggaaaacccaaatgtgctctcctggactcccagccttagttcaaggagaattaacttatcttttctgtgctcagaaaagcagagaaagaattcaagttaaacttcagcctgcctctgttgtctcccatttagtatcagttgtgtaagtatcagccccactacctgaagtcgcccttccccaggtcccaagctgtgggatggcagactgctttctgaacatttcctgggtccgttagcatggaattttcccagaatccttgagtcatattaggaagaccaacagatacaaagaacttctcggcctccttgaatattctctgtgcatcccaggcctgggaaaagagaacagtattaattccagcatcaaaacaacagcattcttaaattaaataagccaggcaccgaaaaacaaataccacatgttctcacttatgtgtggaatctaaaacaatggaactggtagaagcagagagtagaatggtggttacagaggctatggggtgggggcaacggggagatgatggtcaaagcgtacaaagtctcaaacaggatgaataagttggttttatttttttgagatctactgcacagcatagtaaatatagttaataatagaacattgtacattttgaaattgctaagagagtaaatttcaaatgttctcactgcaaaaaaagtatgtgaagtaattgatatgttaattagctttatttatttttcattgtattcataaatcatgaaatcaccttgtaccccataaatatatacaataataaatgtcaatttacaataaaattttaaaatggaaaaaagtgctaatgtcatttttaaaatagcagcattatttctgttggatatatacattggcataacctttccaaaaggtaatttgataacacacacggatagcatttgaaattcttctctttgtctcagtaatgctgtctctaaggaactaacctaaaaaattatcagaaattagattcaacaattacattgagaattatttttaatagagaaaaagttgaaacgaacatcagaatggttaaataaataatgatacctttgaaaaatagaataatgtgcagccacccaaattatatttatgaaaaattttttggtttatatccaaaagacaggcaataacaaatgctgatgagggtgtggagaaaagggaaccctcctacactgttggaaggaatgtaagttagtacaaccactatggaaaacagtttggaggttcctcaaaaaagtaaaaatagagctaccatatgatccaacaattccactgctgggtatatacccaaaagaaaggaaatcagtattttgaagagatatctgcactcccatgtttgttgcagcactattcacaataaccaagatttggaaacaacctaagtgtccatcagtagatgaatggataaagaaaatgtggtacacatacaaattggaatactattcagccataaaaaaacgaaatcctgccatttgcaacaacgtagatggaaccgaaggtcattatattaagtgaaataagccaggcacagaaagacaaacattacttgttctcacttatttatggcatctaaaaatcaaaagagttgaactcatggacatacagagtggaaggatggttaccagaggctggaaagagtagtgggaaggtggcaggggcaggtgaggatggttaattggtacaaaaaaaacagaaagaatgaggctgtgtgatttgtgactttgggcaaatcatttacctgagcctcagtttcctcacctatagcatggagctgtcacaatacctatcctgagtcagagatgacaatagaagagacgggtgtaaaaaccctttagaaagactaaaaatctacatcaagatggccctatactgctgctcaacttcaaagtggagctacaacagctacaagagtttagaggcccttgcagtttcactttttattctgcagtggacttttcccaggagtatgttatgtatgtgaagatgttcattgcattgcttcttacagatgtaaaactattaacaagcaaaggttcagcaatgcacaaatagtaaattatggtgcaattatctgaagaaattttataaggcaaatagaaatatgattagatattctactcagaaacgtagaattttagttgaatgaacaaatatacataattataactataataccatttcatcaacagaagggaacacagagaatttttttttttgagacagagtctcactttgtcacccaggctggagtgcagtggcatgatctcggctcactgcaacctctgcctcccgagttcaagtgattctcctgcctcagcctcctaaatagctgggactacaggcgcacaccactatgcccagctaattttttttttttttttgtatttttagtagagacggggtttcaccatgttggccaggctggtctcgatctcctgacctcgtgatccacccacctcggcctcccaaagtgctgggattacagctgtgagccaccgtgcccggcctgataattttttaattttaattttaattttaattttaaattcagggagtacatgtgcaggtttgttacaagggtatattgtgtgatactgacgttgggtttctattggtcctatcaaccagatatgaacatagtactcaataggaaggtttgtacttctgtgggatcagttgcaatgtcacctttgtcatttctgattgtgcttatttggatcttctctctttctctgttaatctagctagaggtctttccatcttgtttatccttttaaaaaactgacttttcattttgttgatcctttgtatgattttttaggtctcaatttcattaattctgccctgattttagttatctctttttttctagctttggaactagtttgttcttgtttttctagttcctttaagtgtggtgttagattattaatttgatatctttctaggttcttgatgtaggcatttagcactataaacattcctcttaacattgcttttgccacatcccagatatgttgttggtatgctgtgtctctgttttcatttgtttcaaagaattttttgatatctgccttaatttcattgtttactcaaaagtcattcagcaataagttgttcagtttccaggttatttcatggttttgagagttcctcctggtattgatttctatttttattctactgtggtctgagaatatgtttggcataattttaattttttgaatttattaagacttgctttatgactgagcatgttgccagtcttagagtatgtttcgtatacagatgagaagaatgtatattccatagctgttgggtggaatattctatagatgtctcttaggttcaattggtcaagtgtcaagtttaagtccagaatttccagaatttctttgttagttttctgcctcaatgatctgtataacactgtcagtggggtgatgaagtcccccactattattttctggatgtctaagtcttttcctaggtctaaaagtgctatgtttatgaatctggatactccaatgttgggtgcatatatatttaggataattaagtcttcttgttaaattgaaccctttatcattatgtaatgaccctctttgtccttttttactgttgttggtttaaagtctgttttatctgatacaagaatagcagccccctgctcttttttgttttctatttgcatgatagatctttctgcatcactttactttgagcccatgggtgtcattacacgtgagatgaatctcgaagacagtagaaggttaggttttgtttttctctccaatttgccactctctgtctgttaggtgaagcgttcctgtcatgctgttgttagctggttgctttgtagtctcgattgtgtagttgctttattgggtccatgggctatgtacttacttgtgttttgaggaacctagcacatttaaataattaaaccaaagtagtaataaagatgttacttaaaattgttttaaagattcttgtaatatttttaacactaataattttttaaatatgcaaaaatcccctcataatattcttgtttttactatccatagagattactggctggttacttagcaatgacaaactttggaatgagtgataccaaccagttgacaattctacatcttaccgcttaatggaaaactcaggtaatctccatttcaaatacctttcaatgagatcaatactacacctgcaattcaagttatctgaggccattgtaaactgcttttccatgaaactatagctacataagaaataaatttcaattagcttaaattttttatttacatggtttcacataaaaataaaaatagaaggatgacataaaaataaatgaagttgagaatttagatttagtttttaagggctctttttcctacctggtccaccattgcatcagtaacatctatgtttggtttctgtccaaagggaactgtcaaagagtacagatttgtccaaaatctaccccacatatcacctatatttaaaaaagaatctgttagtatatgacaacacagcagaaatgtagacataatttattaaatatatggaccatcattgacactgtaaattagaaagagatttctataatctaccatccatggtacaaaatattacaaattaagctgttagtaattcctagtgttggcttcaaaagagatcatataagatcatcattcaggaacttctactaactggtaactaaattccacttttattcctatattcgtgtacttaacttggtgactttgtaaacatctcaaacaaatgttaagttgtattccaaggccagggaccataaaaaagaagatgtatctagaaaaagtcaatccaagagcaggaccagaatcctggtgccaaaaaaatggggcaacaaacttcatgaagagtactcctgtaatcccagcactttgcagagctgaagcaggcagatcacttgagatcaggagttcgagaccagcctggccaacatggtgaagccctgtctctactaaaaatacaaaaattagctgggcatggcggcttgagcctgtaatcccagctactcaggaggctgaagcaggagaatcgcttgaacccaggaggcagaggttgcggtgagctgagatcagccactgcactccagcctaggcgacagagcgagactctgaaaaaaataaaagtactccctaaacttatattttaaaacataaaatttagtagtgatacatgtgaagtcctatgcttaaattttaaagaaaaacctatccatcataaaaacatatatgtgacatcaggctaaagcacagtccacatgtaaaagaccaaaaatgagccaacaaacagtatgacctggcttctaaagcataaatgtgaacttgagctaaatcaatagaagtatagtgtctagaacaaaggtagtcatggtaccatgtctttctttatgttggtcaaacctcatctggagtaactgttcatctctaagcatgataattgaggagggacattgacaaagtacagctcattgaaaggagaacaattatagaaaagtgaggttttaaggaatggttgataatgtataagatatttaacttgacaaaagaaaatagggtaaacatgacaataacaataatagtcactaaaatgtattgcaccaggtactatgctgtatcttatatgatggttctttatgaatatctggaaggtcatcttgtagaataggaattgacattctgggtaacctcatagcatggaaatagggctaatgaatggaaggcatcagaggggtgttgcttaagttccacataaggtagaattgtattacattggttccatgtagcagtaaattagtctatattggaatgaagaaattatcccatcacaccagacaggtttaagcagaaactgaattactaaataatgcttgccattgacattgtaggaaggatttccatattactttagagttaaaagcctccacaggtcctttctccgcattctctcctgctgacagacacgaggtatggctgtggaggagattagcttccagcaacttagtttgactacagtagaaatgctatatatgcatggcatgaaattttcaaatatttatattttatttggcctcagctgctgcggtgggagaggggaagatggtcactttcattcattcttcacttatacgattccaagccaagcacttttcagcaagagtaattggtgaagtctagaatgaacttaggaagctttcgctcaagctataaccttctgttacccctgaccacccccagccaaccaagctctgacaatatgatactaaaatctcaaattccaccttaagagcttagccaatcaacttgaatactaaaaattattttccccatttccactctcatttgagcctgtaattctttctctagttatcttaaataacccctttatcatttgaattgcagccaaaataataactctttatgtacaaaaaaagtaatacaatagagaattgtttaaaatagacttttggttgaagaaaatgctttcaaaatgcgatttctacaatgttactaaccacttacagaatttttcaaaagttttatgttaaggctcactcaaaaaggcaattttattgttagaaataacaaagagccaagtacacgaagaattcatggggcttcttaccaagcaaatgagcagggaggcatccaattggactgatataggaaggataggcattcatcaactttgccctcacataggcatgaagatgttcatataatggtttaatctgaaaagcccaggaagaaagtttaagacaaagagtaaccaattctaatttccattccacaacactagaaataggagattctttaaacaagtagaatttccccaaattataattcttcttctctcaaatttctggaaaatttaaaagtattccttcttcctagaacttgatgataactccactgcataaaccaataaacatacttgggagaacacaggtcccaaaataaaagcagatgcaaaaaatatatattcatttttaagattgttacctacttcctttgtttttacattgaggtataatttacatactataaaagccacccattttcaagtgtgtagttccatgagtttcaataaattaaaactaccgggaaaccatcaccactatctagttttttaatatttctataaccacaaaaggtttcttgtagtcagttccactcctatctccggctactttgagtatatcagagtctgtttattcattcactagttgaaggacagctgggttttccagtttggggctattatgaatattgctgctatgaacatttgtgtatgtctttctatggataaggacacatgttttcatttatttcatatagaaacctaagagtcatggtaagtgtgtgtttaactttttaagaaatcgccaaactgttttccaaagtgactgccccattttacatttcttcctgcactgtaagagggctccagtgtctccacattctccccaatacttggtattgtccatctttttaatcatagctatcctggtgggtgtggagtggattttcatcatagctttaatttgcatttccctaataactttttatttgcctatttgccatttgtgtaatttctttgatgatgtacttattcaagtcttcttcccatttcctttttggggagttgtttgtcttacttccatttttgatagctctgccaaactatggctgtgacaaggtaactcacatcagaagtttgaaggttcacgtaaaggggaggcatggggccaaaatgaaggaaaaacatccatgggacatttctgttcacaaaactctctcttccctatgaagactagcttactcaaagtaatagtatcaattgtcctgaggaagaaagcaaagtccatagctctgctaacacaggaagacagtgccagccccaggtagctcaagaagatcattcctacttataatctaaaggaccatttgttcttataatatttcattcttatagtctttctattggtaattaatggtcagtgactgaaagaaggaggaaagcagcgcaattctgatcatctgtaggggctgtcctattattctctaaaatctttcaaactctaatattccataactttatgaggcctgggaatggctgaccaatgtgttaagaatgagccagaatgcctttagtcactgtccctctttcccatacactgccccacaactgtttgtgtgtacagttccttgcttacctcttcaaaggtatgttccacatcttcaatcaactggccgcggctgtagtcatagccatctaccccatttacttcatagtctcctctccaataatccccatagtcctcataatctgtttgtttttttttttaaagagaaagggaagaacataagggaaagaaagagagaaagcacaaaatacatagattagccttgctgggaggttaaaagaaatttaaaggcttatcacatttttattgtgataaacatcaactcaaagggatgcaaatgaataataacattaagtaatctctgtttaagcacttgctctgtgccaggagtttaaatgtattattttatttaataagcacaagaaccatacaagattgtcattattataactcccactgtgcagagtaacagcctatgtttatttttaaataaattttattgtgtatatttaaggtgtacaacatgatgttatgagatacttatataataaaatggttactatagtaaaacaaattaacatatccatcatctcacatagttaagcattatcccccccatggaagagcagctaaaatctactcattttgcaaaaatcctgaatacaaaacattattactaactacagtccttatgttgtacattagatctttagacttgttcatcctgcatatctgctactttgtatcctttaacccacttctccccatatcccaccccgctccacctcacccctggtaatcactattactctatctctgtatatttgatttttttgtagaatccacttttgagtgagatgatgccatatttttctttttatgtctggattatttcacttagcataatgtcctccaggtctatccatgttgaggcaaatgacaggatctcctcttttttaaggctgaataatatcccattccatatacccaccacggtttctttattcattcatcccttgacaaacacttaggttgtttccctatcttggctattgcgaataatgctgcagtgaacatggcagtgtagatatctttatgaagtggtaatttcatctaatttaggtatatacccagaagagggattgctggatcatacggtaattctatttttaatttatttaggaatcctcatactatttttccataacagcttcaccagtttatattcccaccaacaacctgtgcttagagtggttaaatcacttgtccaagatcacacagctggtaagcgaaagaagcacattcctagtctcttaaccctgggtgtgtactctcttgatacatcagtttgtatctttagctttaaaatatgtgactggatctctaagtttttaaattcttcttttgttcatggccttttatttttagatcagacccaactcatcttagactttgccacagtgaacctgtgtttgtttgcaaattatatgtatcaatagcatgtttctatgtgcttcctttagtatctcaccatcagaaaacacaagcttgtgtcaggatattagctaataaagtttgtaaacataatttaataatttttatttttacattcacattggcaattaatgatcaggaagatgaggagagaaataaatatttggatgaaaggacatgcaggatattgttttaaaaatggtgataagctattgtctccagcttgcctaaggcttaagaatactgaatttaagtggcagtgaaagaaatgttaaaacaacaaatgcgggaaaaaaattcttccttactcaacctcagtgggcagtaaatcatcaaagcaaaatgtgaatcatgattccatgacttcagctcactattcagggaagagaataagttaagagatatggaaattccttcctatgttaagattttttatgaccacataatctgagatataattacaactgcagaaaataatacatttccagcctaaactaatctgatattttttctttctggggtatcaccctaaggtagacacacaaatgacctttgaaagtgaactgtgggggctttagacaaaaggcagtgactctgtctttcatcctgagaaatgggattcccccccttaatccccagactccctcgggaacttttaggggcctgagatcttcctagattacttataattcataattcctggataatttactttaggccttgtagttgagtctcattcttgagcttcttgaattgtagaatgccagtgcaccttttctttttccccagtaatttcttttgaaaacaggtaatctgaattgttgaggacatgattgttaattgaggggtatccctgatatcaaagggcaggcttggtaatgcagaagaaatagccccgtggccacacagagagcttcaggacctctacagatcagcaaacttacgatttgctcttgccatctcatttttcaagaccacatactcttcatataatggcctcagctgcttgccgacctcagatctccagctttcccaagcccagagcctctcattgtagtctaaactgtttgccattatttcattcaaacctgttatcccaaagcacacaaagacaagaaaagatgcctttgtaaaaattttatttgtaaagaactacatgaactttaaagaattaaaagtaaggttggcagacatcaggtcataaagtggttaaataaaatctcatgattcattcatgtccttgcccttatagttccaaaatatgtctgcagagaaaataaaccactgaaatgacttacttactgacttgatcaaattaagtaaatgtgatacaatttacaagaaagttttactaaaagttaaaagagcatctatgtgttgaaacacacatatctgcaatcatttttaaaatctgagagaaaagtaaatttcataatcactactaaaaattagtagcctacctggttcaagtaataagcattcttgtggattatctgggttacaaacttttccagtactgtagatggtgctcattgtatttagaattgtgttcaactgcaaattaaagataataaacaatgttaacaatggaaattttgctgaagagaatgctaatataaagatatccttttgaccacatgattttttgattactcaaaatacagcaatttacttctttgccatgtatctttctgtatgtggagaaggaatagcccagttaagtttccccactgtcgactagcacaaagtactataagcacataataaatatatatggagtaattgaaataaccagatctaccaaaacccaaagaagttttcttatccacacatacacagagaggtgcattttttgtttcattcagcatttattgaacctggaatatgtcctacactctgacaattctgaagtgaacaagtcaaagaccataaagtcataggacagtgaggcagccatgaaatcaataactattaatacataacagaatgacaagtgctataactgtcaccaaaaagtgatgcggtagtataggagcagggagaaattaataactaataaccaggagattcaagaatgggtccaaagagaagggaagataagagctgtgtcttggagaagaagtaggcactggtcatgtagagaagggaggtagagggaagagtctaaaagatggaaggaggttggaaaagacaaggcattctcaggggacagtgagatgttgaatgaaactggagcaatggtgttcattaggggaaatgaaagacatgagaatggagagacaagcaggggccagatcacgagggaccgtctatgccataccaaagtttttaaactttaccctgcagataaagtgaaggtgatatagtgaagcagtgctactccaggtgtaatccgtggaccagtgcaagtgacagtttgtttccattctgtgataagtacaggaattaagagaataaaagtttataaactttggagaacaatttgatatttccatgacatctaagcatgtaatcaatgaacttaagcaagtattgatctgcaatgtattggaaataaaggaataaaggagggagaaaggaaagacgggagggaggagagaaggagggaaggaagaagagaagaaaggaaggaaggaaggaaggaaatggttctctccctcagattgatttaagaagcactggattaaaggatctgtttctccttctcctatttccctttggttctgccttgagagtcatcctaaaacatgaaatagatcctatgtttaaaacttccacacgatcccatagtccaaaggaacaaacctaaattccttaccatggcacaaaacccctcatggtctctctccagctcttcttcaatctccacggcttcctctccatcaaatctaagcaaccttgagtccctcctcttcccaaacactttaagctcttacatgcatttcagtggttttcagtcctggctacacattagaattatctggggattttttaaaaaatagaatttctaggttccacctaggctagaccagattgtctatatgcgaatgggcaaggtttcttatagtgtccttgttgggggaaaaaatggagaaacatagaatggataaagtaaagtgcattgataattagttggataattggacccaaagaatgcagaaaaataaatgttaacttgtagaaagatacatttcacatggttttatctttgcctttttgatgcatttttatttttatattcacagattagaacatacaaagttccagaggacaagcaactgagaaagaagactttctttttaaatagctaaatattttaggttaaaaatatttcaataggctatatcagaggtctgcaaactgtgttctgcagaccaaatcctgtctgctgcctgtttttgtaaagttttatttgaacacagccatacttgttcatttatatattagctacagctgatttcctgatacaacagcacagttgactagttgcaacacagacaatacctaaatacacaaaacctaaaatatttactgtcatctgttcctttacagaaaaaaaagtttgctgttgacattgtggacaagatcattctttgttgttgggggccatcccatgcattgtgaaatgttctgcagcatccctacccactagatgtcaacagtatccccatttgtggcaaccaaaaacgtctccagacattgtcaaatatccccggagggctaaatcacccccagttgagaaccactgacataaactaactgtattcttcaggctgcctgatccttcaggaaggtgacctaacactagggggtgtccatacacaccacagtgccagggacaatctcagtttaactctgtgtttgaatataataattaccagtgtctttcactctcaaagattccagtttgaataataaattatatggacaccttacctaggcatagagagagatttttctaacatcagcattactattttttcaaataaaggcagctgctgtgggtgatattaatgtttaatatttcccaaatatttcaactcttgggatcaatgctaaaatgttcacaaacgtacccgtttgctcttgtcttctgagagcactgaagacccattttgctgaagagcctgcagctgaagcttgactgtgagattctgaatttcttgtagtggatacatttgggcaagtgtggactgttcctttaaaaaggcagaccatttgtccccagcattattctgaaatgacagaaaagaaaattgaagttggaatggcattgcttgaagagatagaacagaagatatagtccaaataatatctggtgaaacatttaatatttcctgagtgatttagtcctctactccgctgaaggtcaaggtttaggttaagagtgaccaggccacttttgaccactctctctctctctgtctctctctggcctattgcctggttttcccaagggtcttgtccccagaactggaaatgaattctcacagataatccacattgtggggccctggaatttatagccttagtgctgtgacatagatgagttggccaagaattcaaagacgagtgctctaaaaagagaatccagtagagctcagagtggacttaatgagaatacagccccctaataacaatggaaaccataagaaatgagaaccggttcacagtaacctcctagctgccgtgacttagcccagggattttgatcttaagttaggattcccaaaaaaggcttcccagaaaatggccattggtagccatggtgattttctaccagcaaaagaaatcatcaagcaagtgatgatgccaggacacatttccccccctcctgaatcttgaacatcagttggaaagtggacttctccaaactactgtagtgtagtcttttctcaacttacaaattcatttccatttaccaaagaccaaaatgagcaactacttggtatattgtactgccctagaccacacaaaagagataacgtttgaggaaagtaagaattctgctcctggactcaagtaccttagcctctctgagccacagttgtcttatctgcaaaatgaaagtaataataggacttacctccaaggactgttgtaaggatttgaagaagtaacaaaaaaatgaaatgcttacaagagtgcctaacacatcctaatcattcaacaaatgttagttattttattatttatttattatttattatgttatgatttattttatattttgttatgtataggggaaaagtcgttgtccttagattgctttccattttatcagacagataagatatgcattataaatgtttcattaatgaaacataagagtatataataatgtataaattatgagtgggccaagcagtttctgttacaagaaagaggaaattcatgcaggtgaccatacttggccaagccctcatgcagaagttgcaacttaagacagacctgaaagtaggtaggagtcagatgagtagagaatactttgcaaaataatttacctcatttgattttcttaacaacactatgaggtagaaaatcactctctctccttttttgtacatacagaaagcggctgagagaaataaacagtggagctggcaatcagccaccagcatttgatcctggccctgtggcagacagactctaagaatgctcccatgatctctgcctttggtggtcacacccttgtgtgatcccctccccataagtatgagcagacccgtgatttactttcaaccaatagcatacaacacaggtgacaggatgtcatgtttacgttacataagattttaactttaatcttgatagaagactctctcctttgctgacttgttgcagcaagatgccacgttgtgagctaccctatggaaaaggccacatggcaaataattaaagacggcctctgagtaattgcattggcttggaagtatatccatccccagtcaagcctcagaagagaccatagctctagccagcaccttgaatgcaaccatatgagacttagaagcagaagatccagctgaactgtgcctggactcctagcccacagatactgtgggatattaaatatgtgttgttttaatctgctaagcttgtggtaactttttacacaatagataactagtacagctcccacaggtagaacttcaggcatgattgcactttccaggccaaggaatttcacttttaccctctgagaattaggcagtcactgagggttttgactacgcatgtgacatgatggaaatggtgcacagaagtggcagtaatgagccacacaagagacagagaaaataatggcagtgaaaatggaaaataggctgtgtgtagtggttcatgcctgtaatcccagcactttgggaggttgaggtgggaagatcgcttgagcccagaagtttgagacaagcctgggcaacaaggcgagaccccatctctgcaaataatacaaaaactagccaggtgtggtggctcgcacctgtagtcccagctactcaggaggctgaggtgggaagattgcctgagcttggggaagtcgaggcgcagtgagccatgatcacgccactgcactccagcctgaatgacagaatgagaatctgtctcaaaaaaaaaaaaaaaggaaagcaatttctttctttactgaacactcacaacctctcagaaactgctttttcattaatcttcacaacaaccttgtgagggagttgttattgtctcaactttacaaataagggaaatgaggcacacagcaggtaactttccctaggtcacacagctagaaattagaagaaccagggcatcaacctagtgtttacttccgaagctaatgctctgaactattatcctataggttgtatttgacacattctagtcttctctctaacatgcaggagtgggaagaagtgagctatgggaagaggagtttggtctgcagcacaaactcatctatgcaacccacctgactcacttctcaatccctacctggcttcacccaatccagatgatttactgtgaagcaaaatttctggtaaaactttcataccaaattataggaataattttactctctatctataggaaataactcactacctcccaaaggcctcagtcttagaacattgtttatcatactacatgtaggaattttgaggctatccaattttattttagttatcactaccatactacatgtgttataattatatcaccaaaaaaatcactttgtgttgccttgcattttggcccctgaggaggtattattccttgccaagctattcttttaatatcatttacaatttattccgtatccttaccctagggctcccaagcctaaataaaacagatagcttagtagttatgcaaagaatcagtcagttcatgcatacctatcagataatttagtggttgatagctatatttagactgaatgatgaatggaatgaagcatatatagcagcttacatagccccaggcttgaaaggaaccattacagataaaattggtggcattccacactacctctgggcaaaggcaggggagaagcaactaaaactgcaacagtttctgtagccatacaagggagttttgggagtaaggaacacgttgtttgagataatcacaagaaattaaaacagtctctaaatcccatccgtaactgcaatggatagcatattcccaacttgagagagatcctttgtaatttcaaggactgtaggcataaaatcctagattatattttaaaacattcaaaaagatactctgctctttttggccctaactatatgcataaattaaatacatgatttatcaggccataggtctggttgtctttacccaacttgtgataattgtatttaaactattaaaatccttttgtaagaagttgtttgagatttaaagtattgacaacttattttctctttttctatagctcactatcacctaaaccaggctatatacttttagtaacctctaaaccatttcttcccctgtaggtgtgagagttccatgaagacagaaaatgaaaaactgaatggaatctttagcatctatccagtaccttggagcccaaatctcccaggaaaactttcacccttggctcccatatgctggctcaatttccagatagagctgtcaaaaccgcatcaggttcaaagacaaaagctgccttggttactttctaaatatgcccaggtacttgcatattaaaaaaaaaagtcttccatttaacaaaataggtaatgtaaattataagaatgtgaattccataactcaagcttaggatttaagaaattattttttctttattttagattgggggtttaatattttaacatttaaaatttttaatctgtatgaacatttttattttttcctaactttatctcatgggaaaaaaagtgctcgcccctgaattttattttatgtgctgcacagtgatcttccccgacttgtacctgtgtgtaggtgttcatgtgtattaaggggcatgggacagactcattagagacagggatgaaatttccttgggtatatacagaatagcagtttagaattaccctggtctgagttcactgtgactctatccctggagacaggaataggttcagaaatggggcatgcccaagaccctagggaccctggcagcaggggggctgaagaagctctagagaccacgcaaagagtaagtgtggtaggctaggtgcagtggctcatgcctgtcatcccagcactttgggagcctgaggcaagaggatcacttgagcccaggagttcaagaccagcctgggagacaaagtgagatctcatctctacaaaaaaaaatgttaaatgatgcgagaggatcatttgagcccaggaggtcaagctgcaatgaatcatgatcatgccactccattccagcctgggcaacagagcgagacccttcaaaaaaaaaaaaaagtatgggcctcatgctctctcttcacagcttctggtaactcaccaagaaatagctacaacgtgtccttgattttgttttttggcgaggaattgcttgatcctgaaagtcttgtaagaaaacatgatgagaaatggtcaaccacacataccacaatggcagagaaagggagagaactttggaaacctgttttaaccaagcttttttttccatatctctatctgatggacttctccacacttctacatcagcagctttatgacactatactgatcaagtttggatgccttctattattttgaggtatattctcacagcttgacataaggatcaccacttaaggatactgttttgggatctgtgagagaagaaattcctaaatccttgcacttgttaaagcatctggctttcccagagcattctgatatttgtcagaactggtttaatcatagtttttttgttgtttgtttttgtttttgttttggagggctctgcctggattctgtgaccttttggagtcccttggaggtctgtgacaaagaggaaaggaattcccaagtccagcctcacccaagccctgattagcttaattactagttctttcactaagcctccagttgcatttttcagttaatatatcatttgtagagaatctttagatattcctattgatattgtaggctaaaggaaattattaactcaataacttatggcatttccatgaaatgctttgaaatcctgactgtgatgagaattatggtggtaactttataaagaatattctcttgtttccaagcatctggattgagaccagtgaattattttgtaacaattttctgaatgaaccccagggtcaattaagtttagttatctgggactccaaaatcagggatatggaggcaaacatccaatctcacaactcagagcattttttttgatttcccttttcagtttcacgggcagtaatctaatctttaagaggcaacaaatagcccaatagagccatgagaactcaccatgttttggacattctcttcagtaatattggtgttataattccaagaagcaagtgaactttgatagaacaggtcttcggcttcgtggttaaacttgtccaaaaatgtcttggcctgttcctcaatggtggactgagcagcagttacagcaacaaggctgagaaggagccaggaagagcttgacatcgtcccctgtgagccaagatcacatccactgaatgactttccctagactaaaacctcctcatgagattttctctcttatcagcctttgaacttgggttgggcgctgagcaggaaagaccaaaaaaagaaaaagaagaagaacacagtaaacaatctgctgagccaatataaagttcatcctggagaggacagatatgtaacagattttagaataattttttaaagtgaatcaaataagaatacgttattctttaatcctagagaaccttacctctcctgtcactttatggccaaatcaaaaccggtacttttggttaatattttcctagaaagctgttaaagatacacggaaaatgttataattttacagtgaccaaagaggtctagaactagggatcatgaagataatgttggtgtttgtatggttttcagacaatttcattaataggttatctcacatttatttttatttcaagatcatattcccagaaactctctacttgggcaacattttcccttccaaatacatgactttgcccttgtctttatggaattcatatttctgatcagttttttttttttttttttttttgagactgagtctcggtctgtcgcccaggctggagcacagtggcgcgatctcggctcactgcaagctctgcctcccaggttcacgccattctcctgcctcagcctcccgagtagctgggactacaggtgcccaccaccacgcccagctaagtttttgtatttttaatagagacggggtttcaccgtgttagtcaggacggtctctatctcctgaccttgtgatctgcccaactcggcctcccaaagtgctaggattacaggcgtgagccactgtgcccagccatttctgatcagttttaatttccatggccattttttaaaattatgactactctccactccacaggtcaactctcctgatctgcctttgcaaaacttaaaaaagctcatttcctatttctcacactggttctgtggctgacttctttgagtgcctccttctccttcacttacctattcaaaactcagtcaaggtcacgtggaagtaagaaagcctccacatggtatgaaatccaaagagtatctatgtcaactcctgatcctctgtagccatgggatcacaacaacatagaattcaaagagattttagtggttatcttgtcaaatttcagaagcgagctcagtgtcctcattgccagagtgtatgtatgagtgccacagatcaaagagaggagcactttaaatggcagggttcaagggcctacctgacgatgattgtgaaactctgacacagagaaaatatttcttcacccagaaaaacaagtcttccaggttcaggtgacattgcaataatcaagcctttaaaaaaatgtccactgcttttccttattccaaagttgtgtatattattgtagaataggaaaaaaacaattataagtaactattcaaagtgctttgtgttataatatctcatttgagcatcacaagaaacctataggcaaatattttatcaccattttatgaattatgaaactaagtttaagtaaattgctatatctcactcagctaacaaatgatggaatcagaacatggatctatgtattctgattctagagtataggctcttaactaacttgtagtcaacagtctaaaagcaatagtggaggcatagataaaatgtgacagagggccttgtgcctcagtgaagatgacagatttagttacactgcatcaaaaagaggtggactcttacttcccttgatgtgaatcaaaatatactctccttttaaaaaaataaagcagctcacaaatataagtaataataataaagaattttaaatgaaagtgagatgagggtaaaaaaaaaaaatcagtgcagaaatttcagaaaagctcctcccacattccaggaaacctagatccactcactccttgcacacaataggagaaaaaacaggcaagaaagaggacagcacacgagtatctgaagaaaaggttgaaatgttactgtaataaaagcggaaataaatttctacacaggtaagttcctaaatgaaacacgtgggtttagtggaaaaaatgggagtagtccaaattcaattcgctgaggcagaaaatacgattaacttgatcaaactgaaatggagaaagcaagatataaaatctgaaagctaagaataaatgaacaaggagcctgggacagcagtgaggcaggcaggaaaatgctagaagccaagaaactttgagaagcaagggaaaagggagaatagtctacagtgattctgtagaaaaactagcccagaatggccaactgcaagcactgactgaattattggaatttttgttcacacttttttgagaagatatcaatgttctgatagttccccagaagcgttctctctgagcgcattccgagaatggaaagaattcactgaagactcaggagatgagacccagaaaaacaattggtctaaaggaatgtattgtctttgagaaaaattggagaatcagaaaaaattagaagaccaaagatgcaggaaagatgttctatgtttcaaaaagattggaggagggggtggatttcataatggtaaagggaagtttgaccttaacacctagtaaagctataaagtaaatttttttttttttgagacggagtctcgctttgtcacccaggctggagtgcagcggcgcgatctccgctcactgcaagctccgcctcccaggttcacgccattctcctgcctcggcctcccgagtagctgggactacaggcgcccgccaccatgcgcagctaatatttttgtatttttaatagagacggggtttcactgtgttagccaggatggtctcgatcttctgacctcgtgatctgcccgcctcggcctcccaaagtgctgggattacaggcatgagccaccgcacccggcctaaagtaaaatttttagaatgtgatttgcacttggaaaaatatatctctggtccattaggaattcactaggaataagtcagatgctgcctgccctatctcctctctgatagaatacaatagtaaaaaaatatatccaaagacgtagtgtatcttccttttcaataagggatttaacagaatgtaaaatgctatgactagacccaaatgtcccctgaaacaattacacagtacaggattaggcagtcctctggtaaacaacaattcatgtccaaaacaacaagaatcttgcttcaatcattgtttattgaatacctactatatgccaaacactattctagattttgaatgtaagctaataaatattgtattatatgaggtgacaatagaaggaagacaaaaatagtgataaatgtcatgacttataataagcaagaaatggaggatagagaattatggggtggggagagggattttctataaggagggcctctctgagaaggtgacgtttgagcaaagaccggaaagaagtgatgaaagttgtgcggatctctgggtgaagaagttttcctagggagagggagcagcaagtgtaaaggatgtaggcagatttcaagaacatcagaggtctttgtgactggagctcagtgtgcaggggaaagtggcaggaggtgaagtcaaggaagaagctagggtcacaccagggaggtcttaaagacaattaactgtgagacttcagctttactctcagcaacatgggaagacactggaaggcttcaagcagagaagtgatctagtagaagctttagcagggtcactttggctgctgcttagagaatggacactaaaggggtaaggatggaagcagggaggctagttaatgagctactgcagcagcccagtcaagctggttgaataaaagcttagtatgagcttcaagatccaactaggaggcccagtaaaaattactgggcctataattacatcttatactatattagactttgctaatataagcattagatacaaaataatctagactataacattcatttctgtgaaccacaattttagagacgcacaagagagcatccagaggaaaataaataggagagcagatggatctaaaataatataatttggagaatggtttagatatggaagagaagacagggtggacagctttcttccatcatggtactgccatttagaagaagacttagcatagtggatttactctgccacttgttagctgtgtgaccttaggcaggtaatatcctccctgcacctaatttatttcaaggccaatgatagttttatatccatttcatagggatgtcatattacttgaattaatacataagaacacagagagtaatgttgtaagcctagtaataaaagccacagaaaatgaaaggagctgtgtaataattagagaacttccacactggaatgtttaatcaaaccatctgcaaggtcatctttcagagacactgcagcagacagagactggctgggagtttgactcaaaggtctgtttggactataggatcctgcattgtaggagaagtctgctagtttgtgctgaaacagcaggatggaggagctcaccaatggaatgagtagagtcatatatgaaaggaaaggggagtcagccagtagtctacatgagcccagccatagagaacctctcagcgtgctttcatcacccagtcatggtcaggtcctggtataaaacttcctacatacagagaagagaaaacttgagtctgtcacgctatcttgaggaagaaggggaaagtcataaaggtaaatgactccctctcaatatttacagatgttgtatttgttggttgcatatgctttgtacctgctcctgtatataaactcttcacaacaactttacaggtagaaatagtgagatccattttataattaaggaaaccaactgttcccatgattaattcaaacttccacaactgataggcaatggggctacattttgatcccagattgcttaagagaccttttctctccacagagtcatgggttcagttatctgctaacttcatgcatgtctaataagtcctcatcaatctgtcatattctgagaataagcaggtccccataagcaaaattaaaatgtactgctttgattacaccagttatacatttttaaaccgttttagttagaaatttttcttcaatatattccatcccgatcgcgatgctgcctggacattagtttagggttatatttcagatgactcagtgtcatcatcttaaataatatttactggctaagctataatgtgacaatgtcttcaaggctttacattaaatgactcaacagctttattgctattaattctgctgtttctgcacattctgagttcacagtcacagtatcaactttcagtagccctgctctccacaagtcccctccctgtttctgatctgctatctgctaaaacctaaatggaaactagataaccatggagttcaactagaaacctcccttttcataggctgaaatccgagggtgggtctttattctgctagagcaaagtacatagactttgaaatccatatttcccttactgttcaactttttatatccttccaactgagtcacaaatgctgaggttgccaaatagctataggagaaacctcttccagttccccaagttgggtggataactttggtaaacatcagaaaagaaaggatgttttgttcaatttcttattgattaatactgctgacagaacaaggaagggtatcaggaacacaatgcatagagaaattcaaaactttgcatggtcaagaactatttgcattcagtacaattgattttgaccacatgtttatcacacaaagtgaatttataagtgctttatagaaaataaataactagttgggctttcagcccaaaggaaaagctaaagctctttcctgtttacatttttagttgcatagcagtcccttttttcctaaatgtaaaaagtaaagtagaggttcctcttcaaagactttcctccctgtctaattaggaataaataatagcttctcttagaagcaaaattcattcaaaaacctgtgctaacattcttaaatatctgctagccataataaaaaaaaatcaatgtactttatgttcttagctcccacaatttaacctaaatatttgccctggcatccttaatactgctccaaacaagcattaggtcatagcctgttcctcttccttatttgaaggggtttttacctttctcaacattccacaagttacttcctccttcctttgttctcctctgcctttgcctcttttaaaaagttctaagttgctagccagtcaagacaaacacaaaatgtgaggtcccgttccagccaataagaaccagacacaacagtagggtagacgcgtcaagttataaataaccctatctcctttgttcggtatactctcgtaacaaaactactggcaagtggaccctttctacagaaagtataaaaatagccttactaaaaaaaataaatctatgttcaaatactatttatttatggcaccagaaaacaaacatttcaaacactaaagatacagcaaagataatcttcattaaccaaactgataaacagtttcaatagacagagttcaaatttgtgagaataaacattggattccaagaaggttatactgattgttactggcctgaatttatgatagtacagtgcctgccacagtaaccgtaatttattttgatacctatactgtacaaaatatcagatagcactagagcaaggaactcactagtataaatttacatctaagactttagaagcaaaacatgagcatttatcctaagtgagatgggatgcatggtagaatttgaacagaagagttacacgatatcacttacatttaaaagaaatcctgggccgggcacagtggctcacacctgtaatcccaacactttgggaggccacggcgtgaggatctcttgaacccaagagttcaagaccagcctgggcaacatggtgaaacactgtctctactaaaactacaaaaaattagccaggtgtggtggtgtgtgcctgtagccccagctacttgggaggctgaggtggtagcatcatgtgaaaccaggaagttgaggctgcagtgagccgtgatcgcaccatggcactgcagcctgggtgacaggagtgagaccctgcctcaaaaaaaaaaaaagaaaaaaaaaaaaaggaatccctctggccactacatgaagaacaaaccacatatggggcaagactacagtcagagagaccactgaggaagctgttgcaataatccagatgaaatataatggtggcttggtggtaacagtagagttgatgagacgtgattggatttttaatacattttaaaagtaaagcaaacaagctttgctggtgaattggatgtaggctatgaaagaaagagtcaaagatcactccgggtttttggattaaacagctagaaggatgaaattaacatcaatttagatgagaaagattgctggtaaaataggcttaaagggaagactgaaagtttagttaagtttatgatatctattagcaacccaagtgtagatgttgagaaggcaattggatatacaaatctggagtttggcagagaggtcaaggatggagatacaaatttgagaattgtcagctagagatggttactcaaatattgtctctcagctaaaactaaaaagaaaatatcttacctcttcaaaatcccagtgtactgaaaagtattaaagtctagacctcaggagggaaattggaaggataaatagtgggggaaagttacttgaaacaactctccttaaaagagacatctgtgaacagagacctcagaaataaaaccacacatctacaaccatctgatctttgacaaacctgacaaaaacaagcaatggggaaaggattccctatttaataaatggtgctgggaaaactgactagccatatgcagaaaacagaaagccgaccccttccttacaccttatacaaaaattaactcatgatggattaaagacttaaatgcaaaacccaaaaccataaaaaccctagaagaaaaactaggcaatacaattcaggacttaggcatggcaaaatatttcatgactaaaacaccaaaagcaattgcaacaaaagccaaaattaacaaatgggatctttttttttttttttttttttttgagatggagtttcactcttgttgcccaggctggagtccaatgactcgatctcgactcactgcaacctccgcctcccaggttcaagtgattcttctgcctcagcctccctagtagctgggattacaggcgcccaccaccatgcccagctaactttttgtatgtttttagtagagacggggtttcactatgttggccaggctggtctcaaactcctaatctcaggtgatccacccacctcagcctaccaaagtgctgggattacaagcgtgagccaccatgcccagctcaacaaatgggaactaattaaactaaagagcttctgcacagcaaaagaaaccatcatcagagtgaacaggccatctacagaatgggagaaaatttttgcaatctattcatctgacaaaggtctaatatccagaatctacaaggaacttaaatttacaagaaaaaaacaaacaaccccatcaaaaagtgggtgaaggatatgaacagacaattctcgaaagaagacatttatgtggccaacaaacatgaaaaaacgctcattatcactggtcattagagaaatggaaatcaaaaccacaatacgataccatttcacaccagatagaatggcagttattaaaaagtcaggaaacaatagatgctggctaagctgtggagaaataggaacgcttttacacgctggtgggagtgtaaattagttcaaccattgtggaagacagtgtggcgattcctcaaggatctagaaccagaaataccatttgacccagcaatcccattactgggtatatacccagaggattataaatcattctactataaagacacatgcacacgtatgtttattgcagcactattcacaatagcaaagacttggaaccaacccaaattcccaacaatgatagaatagataaagaaaatgtggcacatatacaccatggaatactatgcagctataaaaaagaatgagttcatgtcctttgcagggacatggatgaagctggaagccatcattctcagaaaactaacacaggaacaaaaaaacaaacaccacatgttctcactcataagtgggagttgaacaatgagaacacatggacacagggaggggagcatcacacactggggtctgtcgggaggtggggggtaaggggagggagagcattaagacaaatacctaatgcatgcaggccttaaaaactagataatgggttgataggtgcagcaaaccaccatggaatatgtacacctatgtaacaaacctgcacgttctgcacatgtatcccaggacaaaaaaaaaaaaaaaaaaaaaaaagccatctgtggaatgaacaggaaggagaaacgggagtttcaggatcttggccagagcattgtagtcctcactggtttatggcaaagtagaaacatctcagaagaacagggtggttaagttgaggcaaggtgccagttcaggaaagtcagctgacatgacagatagtcaaagtcaagggcttagacgcaatccaggtcaaggctgcaacactggtgggcatttaaggcatagaagacttattgtggaaccagctctggcatctcagctagagtctgagggtgaccgaagaattttagactttggtcaatgcttcctaattgactctaaatatcttagaaaacccctttattttattggcctccacctcagtctatggattgtgtatgagtcatgttttctgatccaactggaaatgttcaacagtagttgtcttcttgaggtctagcaggctcatcttggacacctcattgtattcctccctcctcgtcttctaagggatttgtctggtctgagccatcagtggagcttggtcaaggttagttacagactccaacctcaaccttcctattcactcgtagagtcccttctatcaagttggaagaagagacctcacagagaactaacagaacaataactcaatagagccagttttactaagtccagcattggtcccaggaatgctggtcaacgttataaagtcccaattttactaaacactgtttttgcctcctgtcaatctgacgacttgaatttttttaaatattatgattctcttttttaatgagtcaagagtaaagctcaagctacccaatcaactaattaaaatttatcctccctatcaccactacatacacatatagtggcactatttatacaacttccatcctttattttttttcatgacaccaccatctgctacacggtactcataattacatgttttactaatgtattcctttattatctgtctctccccactaaaatataagctccaagagggcagaaacttttctctattttgttcactgctatatcttcagctgcttagaaaagtggctggtgcattataggtacacacaataaatatttattgaatacagacattgttcagcaactcagtagtaaggaggaagaagagggaaagctcagttgtctaccctgtgtgtagcataattcattttcatatggcatatttcatctgtttatttgcccatccacagaatgtgatggatagagattagtatcaactgaaaaaaaggtggaaaaattttctggaacaaaatgagatttggaagctatgattcaagttactatggtaaaagacgtgagagaaaaacagcatgattactgtaagtcaggcattgggctaaatgccttacatatgttgtcactgaatccaccaaatgaccctgtaaaaatggtattgttactaccttctcatagatgaagaaaatgaaaggcccaggcgcggtggctcaggcctgtaatcccagcactttgggaggctgaggagggtggatcacctgaggtcaggagtttgagaccagcctggacaatgtggtgaaaccctgtctctactaaacatacaaaaattagccgggcatggtggtgtgcgcccgtagttccagctactcaggaggctgaggcagaagaatcgcttgtacccaggaggtggaggttacagtgagccaagatagtgccactggactccagcctgggtggcagagcgagactccatctcaaaaaaaaagcgggggtggtgagagcataaatgaagtttacctcaatcaagctgcttcttctcgcaaggtcatactattatttactaagtagccaagccaagtgttgaacactggttagtcttttccctgagccagatatctcagcccacagttaatgttttaggcaacaagagaaatgaggaccctccagcattgtatgaaaagaaccatatttatgttgcaactaccatgatgccaaagctcactgatgactgaaagtgggtgtcaaggaatgaggtcacagcaatggaaatccctccagttggtttcactaataatttttattttataaaaatgtattctgaaatttattcacctactttttattttaatatgacattaattcttcactcctacccaatgctggcccatctgtggccataaactagaactgattttcccatagttgtggttatcagaatccctagatggtgagattgttctaattgggatatcaaagtggaatattccataaaataatagtattctaggatataaatataaaatggcatataaaaataagtattgtagatcaagattcaggacatgtaaacactctttaaagtgggtcagcaaaacatagggctggtaattctagcactgctaatttattccacaatctggagggctctgaactcaagaggttagaatgctatcaagagtccatgccattccttgaggagctgctatttattaagtgtggtcctaataaccagccattaacttcagcaaagatgagatagtcaagtagtcacagacacatgcaaagaggccagaatactggctaaaccgagaagctgttttggcagccatggtggatgcatttttttcccaaacaatgtatcaagagaattaggataagatgattatgacttggagttctcagacatgccactcctgttaacaaattgttatattagtacatcacaaaaataatatgccaaaagtcctgagagagaaaaaaaataatgattgcaaagacagaatggcatggcagaatatatgataattattctacaaagtataaaattctctttccatttgtgcccctctatgacacacaatgtcccagataagaacttattaacaccagtggtgcatgagaaattgtaagcttcaaggctgggaactactttggagacatcagatctctggaaaggtagaaggacccgggtgaggctcagagggaagcttgctggtctggtctatagtaagagaagggatcttaattggggctttgaagttttgctctagattattctataagactggtcccctgcccaaggatgctattgtttatttgattgaaggactcctttgttttccctgtatatagaacctaagcaagtggttagtgagggagatgtgggggaagatatcagaggtcatagaaccatctcatttccaaaaattacagacatagggaatgcgtaagttactttgtaaattttcaggtgcttaatatctgaacttcaaagaggaccaatctgaaagtcaaaagtcaaagggtaagggctttaattttatgccacatgaatacatgcacttgaaattataagaacttttctgaggtcttatcgtgtatcatattttaaataaaaatcccttggtttttgatgatgccagagatgtaatgtcacaatgataatgtcacaatgaatatataaaaactagaagctaagttgtgtaagagctttactcctacttcattctttgccaccaaagaccctcctaagatttaccaacttgtcttcaatcccatcaggagtgttctttggctgcaaaatatgttcagtgcctagaaattacacagtgcaaattctagggaagccttgcatcttttctggggacagtcaaaatgtggtaggtcttaataatattaatttggattcaatgcagaaaggaattggggccctgttgccttgaaatttggatattgccatcatgctacaagatgttatttttagatcttggtgattaccagtgtttttcaacattggttgaaaggcaaacaaggactgagcaacctctacaaggatgaagtaatgaagcaattataaaaattggaaatttgagaacatacctggaggaactctcatagtgagtgtctttctctgcttagccttttcactggatttggtagttggtattgtgcaaagcttttttgaccttcctagatcatctttatgaattttgcctcagtcttcaggggagcttccatgttagtaccaatatcatgctgatgtctctacctactgactacatatgaaataaccagataagagaggacaagaggaggaggaaattctgataagagaggagagagttccccaaaccactatccaattttgtataggtatatagacccccccaagtggtgttaacaactatttacccaatttatgaggtggatgagaaaatgcaaatcatgtagaacatgtaatttatggctcacacatccttgtgctattgggaaattttattcagatggcccagataaaagataatgtgaataagctttgatctataaaattataagaacttctatgatttcagagataaaagaggtcaaagcgggctcatggagtccggcaggctttctgacggagatgagactctgaattatagagactactactacctctagcaataataatatccaaactttgttgagtgattattatgtgccaaacagagtttaactgctttacatgtgctcccttattaaatcctcacaaaaccctatgaggtgagtaatagcatcattcccattttttagatgaggaaaccgtggcacagaatcaaggtcacacagctggaaatcaatggaactgggatttgaaccttagcaatctgtcctcaggcccagaatctttgtagtcagaaagggctttttgagagaattcttatcagagacatgaaggagagggacagttaaagcataaggaagcataaaaatctttggttccatgataacatcaaacttacatgaattacaaatatagtttgtccttgcatttcttatactgcattttttctttttgattttcactgaaaggagacaactggtgctctattctatcttggtaataggctatgtttttctcagtagggtcagaatattcaggatagagagtaattagagatcacagactcacagatgacaacctcagttggtatggcagtaatttatgctcttcaaagcactatatcagagatatagaacaggggttctcaaccagggtgattttgtctcccaggagacatgtttggttatcacactgaggggagagtactactgcatctagttggtagagaccagggatactacttaacattatacaatatgcacgacagcctctcacaaccaagaattatttggccccaaatgtcaagtaccaagattgaggagctctgatctacatagtggtacaaacatagtgttctcaggaactaacgtgtgtgcatgattccacctccccacatctcagtcagggccaaggagaatagtaaatcacctattcctagtagcaaagctcccaaggcattcaagcacgaaatagctaatccttttggacacgtatacgtatgtataagctgtggtctccataacaagtagaagaaatcagaaataggccaggcacggtggctcacacctgtaatcccagcactttgggaggctgaggtgggcagatcacttgaggtcaagagttcgaaaccagcctggccaatatggtgaaaccctgtttctactaaaaatacaaaaattagccgggcttggtggcacatgcctgtaatcccagctacttgggaggctgaggcacgagaatcgcttgaacctgggaggcagaggttgcagtgagctgagattgcaccactgcactccagcctgggtgacagagtgagactccatctcaaaaaaaaaaaaaaaaaagaaagaaagaaatcagaaataactaaataaaacataaaatatcagtccaggtaattagccctgactagaacaacacagtggggataactaaaacttcaagtatttactacattcagggcacaaatgtaccttacctcactgagtgttcacaaccaccttagaggaagttgttatttttcaaatcctcagcaaggttagtaactagctctgtgtcatccagtaagagaactggggtttaatctgtcagtgtgttttcaattgcaacccctgcctctttctatgggatgtggtaaaggttccgaagagctagtaaggttattaaagaagaaaataattatcattttaaaaaatagatgaaaatgacagagtacttttgccttgaaatttgttgacgtcagtacataggagatattgcccagatagctgtttcttgcaagaaaagaacaggaggaaatgtactgaaagaacacagtgaaacctcatgtttagtcttcagggagaatcacttcacagtttgaaacattgacgcagactactgaaggatgttgtgtaatctgcgtctctggagggtttatagaatagatgctctgctggggagggtttgagtgtggccctgaccaagggcaaggacatgggctgccagggctccactcaactgcttctctggtaataatccctgaccacagcccagtgtggcctcttcccccgcccctccaccatgcccactcccactttgtgaggaactcagttcaataggcagtctagcccaccttgcattccatctctaacagtctgatctggtaggtcctctctcttttcattcccaaccctcccaggactccatctctccaagccctttataatgttagttttgaagcgttagatcaaattggtagatatatgggtgttcattgtactgttcatccaacttctctttatgtatgacaacttttataatgaaaaatagtagggggttcacaggggttgagaaaagattgtgtggggcctggttaccatttaaagacttcggcttctaccctgggagagatgaggagatatggagaagtttgagtaaaggaatgatatggtctggttttctgttttaacatatgtcagggctttctttctctacttaaacctggctcaataccaggaggatgaggagtgttgtagttctcgacatagtcttgccagagtctctgaaatatgtcctgcattactcacaagaaaagcataaacagccgggcacagtggctcacgcctgtaagcccagcactttggcaggccaaggtgggtggatcacctgaggtcgggagttcaagaccagcccggccaacatggtgaaactccatctctactaaaaatacaaaaattagccaggcatagtggcatgtgcctgtaatcccagctactcaggaggctgaggcaggagaatcacttgaacccgagaagcggaggttgcagtgagctgagattgcgccattgcactctagcctgggcaaccagagcgaaactctgactcaaataaaaaatgaaagaaaagaaaaaaagaaaagaaaagcataaacaagaaatggcttcaatcaaggtatagcacaggaatagccaacaaacaattgaccagagtgctatgtaaatgctaaggcacaactataatctgcattttaaaatgtccagttgtgaaatacacccaaattgtctaagattctgatttctctctatgccactgcccatggttctgtgtttggtttggatcaatactcactctggcaaccacactgcacattattcagtcatgagtttgcagacattccaatcccagttcttattctccattgagtatacacctggtatggtgaagatgatatcttcaagttattccaggaagaggagttgatgactgccttagtccattttgtatgtctataaaggaatacctgaggcggggtaatttataaagaaaagaggttttgttggctcatggttctgcagactatgcaagcatggcaacagcatctgcttctggccaggatctcaggaagtaaaagctttttggatcccgacccaaatggtggaaggggaagggtgagcaggagtgtcacatggcaagagagggagcaagaaagaggaggaggagaggtgccaggctctttttaataaccagatcttgcgtgaattcactaccatgcgggaaggcaccaagccattcatgagggatctgaccccatgacccaaacacctcctactaagccccacttccaacattgaggatcatacttcaacatgatatttggaagggacaagcatccaaatcatgtcaatgacaaagtattttttaaatgggcataaggtaaaaatagaacaataataatttaaaatagaaacaaaaacaatcaatcactatgaatcctataacacaacctatgaacatttttaaatgctgtatgatttcaggcaacatatttaaatttgcttagcctctgtttcttcttttgttgaatgcaattagtaatacttgccttatccctttggatggagatccaaagagatatgatatccatccaaagggataaggcaagtattactaattgtagttagagttaaatgaaataatgaaaaacagtaagaattaatgaataaaatgagacctgtgaacaatacaaagtaatattgaaactactcaagtccacaaactaaaggaaaaaaaagatttatttaggaaacatattttactttatatataaatattcatatcctcaatgactaaaccttggaagttagataacctatccatctggaaagacacatagatctcgcaggaaggtggtagaagggaatacgtagatttatcaggtatctatttgaattcttagcacaaagataaaaagaactatgaaactatgaaaaaaactgccaagtacattgatttctaaccccccacaataccctcaacttcccacctctctccccacaaaaggactctagcataatccttggggaggttttgtaaattgtgttttgtttgctgatctattgaaatgtgctgtgtcaaagcaatgcgttcaaaactgtaacctgaggctttctgcaatcattgcactactaaaatgaaccttggtattccccctttatagctgtacagatgataatctagtaaataaatataatatgtgatgggaatttaataagggcctcgatcgctcttgcaatgatggcagagacattaacattgagaaacctctatcacttttgagcaagcagattttagttcttacattcattggtttaaatttcctttagctctaaaaagagcacattatatcacctggaattgtcccaagtgaaagccaaaaggcttgtcatagcaataaattgttcccctgctggcttatggctctgtcctctcaaggacctttgagttcttgcttacaggagccccaagcaatgaagaaatagaacaggtgagtcatcccccacatacctggcagataagtcagaggcaccaatcctcagtataagagagtctaagtagcattagaatttgaccaatccacaaagttttaccatgttgactagttaatttaacaaaatagcttgtccatccatcagataaacttttttttaactgaattgattgggaagccagttgattcaataaatgtcaactggtgcaatgatagtcatggtcagaaaaaaaagtaatcattttaaaacatggtcatcattacctgattggatggaagttaatactggtgtaattagcttttcaatctctcttgcacgtgctctctctctctctctgcagtttgttttttgcaactatactagtagagttttgcagtgtcttgtttaatttctttgtgttgaaaattcaaatagatacattacgctccctagtagagcagatcaatgtgtggttgcatttttccagatggataggttatcctacttctaaatatttagtcatgataggaacaattatatattcatatagcaaagtatttcccttaagtaaaccctttccttacttctttatggcctcaggttgaataatttcaatatcaattttaataaagaaaaacttcacttacagatcacattttctttactaattttatggtttaatattatttcattctactctcacaataactctttgggcatatagaacaactattagttcctttcctttctaaagacagtctattgatatcaaatgggaactagttctttcactggattgccttctctccgcttttatgaaaccttgctcacctggggccactcagttagtaaatggtactgttaggattagaattcagacagtgcaaggtaatgctgtacatatgctgtatattcatctactccagtgggatctgggatagcatcctatcaccaaacacttgaatatttctgcattcagtaatatgatggtatcatttactacaataaataaagaccattacacataataaatgaagataataaagagcattatgtctgctcaggtcaagtgttgccaccaaatagtttttagaggtttttggattttagagttgcatataagggattgtggatatgttttcctctggtcctcatgctctttttcactatgtgaagcaaccagtcatttaatattcaaataactacctacatactttttttctcttacttcaaagcttctctggatagcaatcaagctattggtggtcagcagacagaaccattaaccccaagtattttttccattgtcttcattatgcacaaaatgcaattctgttctttctttcactactgagagttcaactacacttcacacaatattactcataatttttcacctgtttctttctttctctttcaactttttccctagcttctttagaaatggtccgggagagagacagaagaagtaaaaggatgaggccatatcccagaagccaagaaggcagattctgtcgaagagggtgacagggtgccctacactgtaaaatgcttcaaacagatttaggagagtgaggaccaaaaagctgtgaccttgacaaccagaaattcacagtgacctttgaggaaacagttttctcaagatgtggaaatggaagtcagaatgcaaagagttgaggagcaagtgcatggtggtgaagccaacctattttttaattaaccagggtcaatgtactttaaaagtcttcagaatgcctgtaagtttcctttactagttccatgtactttcttgttttcccataaaaatctggatttgtggcagaagagaatgaaaaaaattaaaaattaaaagcgctgcttttccttaagcactgacaaaatacaataaaagctgattcttattaagttgtgttctcttttgcttgttttcattacactgctggcattataacagtttgtattctaatattttatgtatagatgtgcaatatttcagatatattgtgagataatatgttactgtgatttggcctgatggctgtatcagcataaacctatttatatagggaaatatctttcctaaattccaaaggattgaccagcaaactaatagcttgaggcattgccattttgtgggtcaaaatgattatatagcagtaattttatatagttctacctcacaagttttcaaatgcaaccttgagacaaactgaatattgccaaatacttcataaatcattaaatgtggcaggctatgagccaatggcttaggatgacaaatggagtccaggggactccaagaaccattaagacatgaatcttaattaaacttttgctaaattttgcaaataagggccacctgttcactgtagcaaggcactggacaatggcaccttccaggcttgcttgcctgtggtggctagcgctcacctctgctctatgccatgcccaagagttcttgttccaccctttccaaaggtcttgggtatgccctagctctgttgttctgggatcctactgccagattgggtcacaagacatcagagagttgaaaaatgtaccctctctggatctgattaaatgtcttctttcatccaacacctcacacgcatatttatgtattcaccagttttcaaaaaatataagtgatatcaaggggtaattatggaaaaattacatctagagacacaattgtcatttttttattggccaaactctcccctactggcctgtaccactataaagacttgcacaaactacttgcatccccctactgcccctactgtgttataataattttttaaagatgaatgtcgtgtattataaattggctcttattctgtgctcagaataaaagtccttttagaacaatgttatgaaaataaagagcagaatgactcagtaaatgacacctaaaaattattcattcattcaagccaaaattttttttaaataatgatattcttagtaattaacttaattttatcataattaatgaatgggtcccttataggacattctttctctatattatctgaatctagcatggtgtcttcaataaagtagtgggacattcaacacatttttaaggaagagaagaagaaaggaaagaaaatgtgcatttacttatgtaactaaacttgagaatattttatacaggaaaataagatgtaaaatgggaaacaaaatattatgctaaggggccccatgaattgaaataaggactgagaatttgggctctgggtttctttttgctttttggtttttaatctgtgtcctctcctattccctatttctcatccaggaatgatgataaatgtgcataatctgtgtagtgatactcgtatctggagtctgatcattatcattctatatgcaataacttgcttaattcttttatattatattttctaatggttagttcttgtgaaaaacatagatgatgaaactacaccaaaaaaaaaagttatctgcatttacatttcttctgtgaagcaaatccagatatcaccatcccagtgcattttctttccgtagtgaattgattttctgtccttccagtttcatcaagcagtttttgccaggaacttggaaactggaatgacagctttatttccacttcctttacaacattttgtttccagtacatatcacctcacaatatgttccctcatggcacattactggatcattaaattaaaagtgagaggtgtggttgatgattgactgctctctaattacccagagtgtttgtcaaaggcagtaggcaggagatataagctctattttgctgttacattgattgtcaaggttacagaacatctctgctagcacagaaaacttttccaataaggatatttagtggaacagaccttcccccagtggaatacattccctccgcagcagaataaatagtgaagaaaatggtctcgttatcaaaacaggtttgtctcatgccttcaaaataagaaacatctagaatcagtgtttctcaatcttcttttcgttattgtggccttttagacctttttcttaatagttatcccatgaaattttaatatcttagataaagtttatctgcttacatactgtgatcatttggaggactactgatatcatctggacctgtgtcctcatcaaatctcatattgaattgtagtctccaatgttggaggtggagcctggtgggaggtggttggaacatcagggtggatatctcatgaatcatttagcaccatcctcttggtcctgttctcatgagagtgagtgagttatcatgagatctggttgtttaaaagtgtgcaacacctccccgcttggtttctctttctcctgctcctgccatgtgagacacctggctccccctttcccttccaccatgattggaagcttcctgaggcctccccaaaagcagaagtggctatgcttcctttatagcctgcacagctgtgagccaattaagcctcttttctttataaattacccagtctcaggtatttcttcacagcagtgagagaatggactaatacaactacaaaccactgtaatatctcgaattttttctccccgccaagaacaatttacaccctgttgagaatgcgtatcttggattatgcttcctagcacacactgattgaattcagctgatgtttcaccagttaaagacttctctatgcaaagtcaaactactctcctgaagtacaccactcgaaagagcgtaagatagagaataattatttagtaagtcacgtcttgtcaaccaacaggtcaaatctcattccttttctaaaaataaggaagcctactaatattaaataccatatggttcccaagtcaaaatggtgttcaagtcaaaaatcttctacccacatattcaaactcttccacttacagagagaggggcaggctttgctcccagaagggataaaactatgagcttgcaacagctaccacttcatgtgctggtttattagcacacatttattgagctctgactacatagactttcagcttcacgagggcatggattgtgtttggattgtgtttggttttgctcaacattgtaggataaaggaaagaaagaagggtccaacaatgatagactggattaagaaaatgtggcacatatacaccatggaatactatgcagccataaaaaatgatgaattcatgtcctttgtagggacatggatgaagctggaaaccatcattctcagcaaactatcgcaaggataaaaaaccaaacaccgcatgttctcactcataggtgggaattgaacaattagagcacatggacacaggaaggggaatatcacacaccggggaatgttgtggggtgggggaggggggagggatagcattaggagatatacctaacgctaaatgacgagttaatgggtgcagcacaccaacatggcacatgtatacatatgtaacaaacctgcacgttgtgcatatgtaccctaaaacttaaagtataataataatttaaaaaaaaagaaagaagggagaaaataaggaaacggagagaaggcactctactaagtgacttgaacactacctctaagagtattatatttagtgtgaagatacaaacatataaacaagtataaaaaatgaagcgttacaatcattataaataaaaatgtgtagacataatcaaattacaaagcaatagttaattctaactagttggaggtcaagggcaaagtgaagtgcgttacaaaaatgttatgaagacaagactgcattaggacttttgtgggccctaaaacactcttgcctttgtggtccccttcctctatagaaaatatattgaaaaataataattacagtacaatgagatgagtataattatctggctgttctagcagcccatatcccggatgtctggcaaagacttcctgagatcaaaatgtttatgtgagaaagaccctaagaacaaggtacaagagtggctgagaggtagggtagagaaaacagcctgttcaaaagctgggaagtgagagatctatgtatgactggatggaaaagagagagaacttgtgagagatgaagatagggagggaggtggagatggagggggtgtcaaactttagcaggccctgtgttaaggggtctggctttagcctaaggataatgataagccatttaaaagtgtctgtgttaggaactaacaggaccaggtttacatttggggcattcattcaggctgtatcacagacaatggaccagtagatattctaaggggacttctgggctccctcttctaggccaatacacccatccctagcagctaagaatattggctattgaaggctcacagctgagtccttcaatgggaattgcatccagccacagtgaactgcctttttcaaggatagaccctctcccagaaggcacccacaggcatgcctggccaatgtggaaatacaaaggccctgctcccttaactcaatcaggaatagccccagctcctgagcttcctgaaagattggctgaggcttctgttgtaaccgtgtttctggttgtttctccctctgcctaatcctactctatttgttacctgttgctgccacaaacttaaaagcttaaaaaaatacacatttatcatctcacagtgtccatggtcaagagtctgggcacagcctaactggttcttctgctcaggctgcaaagtgtaggtcagactgcattctcatctggagatttgaatggggaaaaatctgcttccaagcttcctccagttgttgtcagaattcatttccttgtaagactgaggatcccagcttcttgatagctgttggttggaggctgtccttggtacctagaggtcaccagcaattcctagagcaagcttgtctaacctgtggcctgtgggccgcttgcagcccagggcagctttgaatgtggcccaacacagattcgtaaacatttttggcgaattttgtttagctcatcaggtattgttagtgttactgtattttgtgtgacccaagacaattcttcttcaaatttggcccagagaagccaaaagattggacacctctgtcctagaagctgaccacagtttctttcacatgggctttcccaacatggccacttaccgaatcaagacagcaagaagatctcaaaaacaaatctgctagcaagacagactcagatataatataaagtaattgcaggagtgtgacatctcatcacctttattgtattctattcattagaagcaagccacaggtaccatactcactgaaggggaggggattctatgaaggcatgaacaccaagagatgggaatgatgcgggccaccttaacagctgtccgccacactttgccttcctcacttcttaaaggtgtatctcctgagcgcatgccccaataaacctgctgtatgcagctacctatcttagagtttgtatgcaaggaggcacactggaggcagggaagtgagttagagactactgctgtaactttaactatgagtgatagcagtgggaaattgagtagcaaattttattttcattaataaatgtataatcattgttcctagaatttagaattattcatggcctatctggaaatagaatcaacctaaaaactacaaggtgtcttcaaacaaggatacacacaacaaaaataattcatttctatggttgtagagcagattaaagataactaataaaaacaagactatgttccacagtgtgaaaataaattccagaccacaatcagtcacacaatcaaaaagagatgattattactttattaagttagcacagattggacttttacaaattgtagaaatggtcaacaaatagaattgtcctattaggggctgatattcagaaaatatataatcaactgttggtgtgataacaggataaaattccaccctgtatatgagtaattccatttttatccatccatttacaataattacttctcacttttgtttacttagtcatatacagagtgatataagtgatcgtcaaaaaggatccattttcaatgatttctacaccatattatatgtattctccactggaaaatttatttttccttaggtctttgaagtgtgaaaatatatacatatgcctgatcttatttctaaaaatgcttaaatcaataactacaaataccacatgaccacatttatacactatactgtcagaaaaatattttagaatattttgagtcgtgaatagcttatgatttcagtggtgttggtgggtataattgattgcttttcactttcaagcacattcaaaatttattacaaaagaagaatggtgaaacaaaatatatgatctgctcttggtatttcaggatgctcagcagtcacacagaaacaaatgtttaatttcttgaggaagcagaacaacagcccttcagagaggggtgagcctctcatcctctgtcatgaaggcatcattaatatgccctcccttcatgtccaggggatcagaggggatgccattttcaattgtgatcatgttttcacacttatcttcagcgtcatccacttcagatggttctttgttctttctaaaagcacataaaaaagagtgattggcatctagaaggaccataaccatggttgcatatggtcttctgaacgaacatggagaacaggaaggggaataggaaccttagaacaatgaaataatttaatgatattgtgtaattttcaaacgaatttcaaagaccataaagagttggtgaggtgaaaagatactatcaagatgagaagtctgtatagatgacatatacatagtgatcaacacaagtggtcttattcagaatactaaaatcaatatagatgaatatgtatatgaatatgagtgtatatgcacatatatacacatagacactcacacacacaaattgcatgaagtaatgtgaagaaaatgcatagtaaattcgcaagtttaaaatccatctctaggagaacttaataacaattgaattgctaaaagtaataaattcctctcatgggatttgacaaattaatggtctgaaaatgttgagtgaaaatcaaatagaaatgagctatcagaaagaaaattaacattactttgtagaaagtaagtgctataaacttcaaatattgctgcttggctctactcattacaaaataattgtgttaatttgcaagtcacgattttggaactcagaatacattttccctaattactttacaacttgtagttataattccaggtcactccaaaaattccatatgacaggataaattcttgagtttctcatagtttcaccctttgtagaccttgctgaccccaaccgaagtaatatgcagatctgtaatatttctttggagtgtggaaaacagtagactcaaattcaaaggtttttcctgtcttttgtgaaagactaaaacaatgagacaattatgcttgatatcatgcagtaaaagaaaaaagagaggtgggtgcctctaggcaaccagaagaaggaggggtttccctaaggcttatcacaggttggatgttggagcaccactccatggtgacaccacggaggcatgatgttaggcatgaggctcctggacttgcaaaggattctcttgtcccacgaatttgtggaaatgccaaatagcagaaaagaatagatcatctggctgagatgttgggcactgcagtggtgaccaggtagagtcccaccactatgagagtcccttagaaccttggtgagtctctgacaggtgaggagatggtgaaggtgccccaatgatgaccgagatggaattcctattagtcctgcgtgagaatgtgctttaaaggatatggtgcacatgtaccctagaacttaaagtataataaaaaaaaattttttttaaatcatctttcccacccacatgattttcctgactccattcctgtcctctgtatcattttcccctatcagttttattgaggtataattgacaaataaaaattgtatatatttcaaaaaaagaatatggtggaagaaagtgaagaaaagagaaagctctttttttatagaagaatgccaacgaatatagaaagagtaataggaacagaaaatcaccatataataataattgattctgatgaggattatcaatggatactaaaccattatgtgagagacggttggagaacaggatattcacatggtttcaagatatcacccccataagcaaaatattaattataaaaggacacttgtattttgctaaaagagaaatctagtgaaaatttccaacaatgaaagaaactgacaagtctctcctgatgtgatacactgagtagatcacatatatgtttttcctgtgttccagccccgccccctccaatttgttttgacctgaatctcataataaggagcctaatcagaaaaatccaaatttaaaaatgttttgcaaaacagctgacctggactcagcacagagtaggcattcaactgtatgggtagatgaatcaatgaatgtagattaatggctgactggctggataataaatacatggatggacagaagatgggtgggtggctgaacaaatgatgaaaggtggatggacagatggataaaataatcaatgaatgtagttcaattgctggttggctagatgatatattaatggctggctggctgaatggatggatggatggatggatagatggacagaagatagatggtagattgaacaattagatgtatgtatgtatggactaatgttgtaggtaaagttactcaggcagtagccctaggtagaccttgaacgggctttaccacaagaaagaaggaaggaaggaaggaaggaaggaaggaaggaaggaaggaaggaaggaagggaattttacacacaagaaatttcttgtatctcttgtattttaggctttgctgatggtttattaaataatttcaaatagttgttcatttaaaacaaaggtaaagtagcattccaattctgtagatcccaatgtcatcatttgaaagtattttaccattgcatatgccaccatcaaatatcacaattaaacacaataggcaatcactgaattgcagatgccacattttaaacatttattaataaaacttctggcccaatgctgggttgaaagtcaggagttgtggtcctagagacctagggaaagataggctgctatatttttccatccttggagtgaagacaccacactggtcatggcaagcatcagcaatcagcaatcagcatgggttggggtggacatagattttaatgtgatgagaggatccttccaggtgaaattacccaccagaggattagaacactttggttcctcttcctatagataggtgtattgttcactttccacgtcctccagaaagcaaaggaaatcaacattctataaccatcaatcacatcacttccattcatagtatccaacattcactaacagctacattttgagcgtctactatgtgtatggaagagatacagtccttgtcctaaaatgaactcaatgaaagggaaaaatgccatatatactcatcctccctctccccattttaatgctttataagagagaggaatgtttcttctaaagatgaagctgtaagtagcaaatgtctatttataaatcatcatttaaaatggctatctcatgtaaattcccccaaaatcactcctcactgggcttggagtgaatgataattttccacaacaataaatagattgtggacagccaaattttaccctgatatttgtatatgttaagtatgaaacctgtattacaaacattttagtaaaggaagcattctgaagtaggtggcaatgcaatagcagtcttagaaataataattgccagggcctattttccagtttcttcagttaataaaaaaagtatttatggagttagaagaaaaataacaaagagctagacgtatgtgatgatcattacaaggaatctcgcttcccccttcccagcaacaaggaaaaatgattcatcaggcatcacgaaagaatggggaaaaactaaaaaggaagatgtaaacaaatgaggacaagtttttcttctttagaataagaataatatctcaaccaaaaagattccaaggggaattgctgtagaaatttatcaaactgagctgtgtcagtggcaaattaggtgcatattgttcttttacaaccatagatccagttgcagagtcctggcattgctgggcttcaccaattgcagtgtcaggaacttgctgcttggtggacatgataagcagctcaaaggctatctaacagtaatatatcactttgtcacatttcatagtgtttgctgtaataaattgattcactacctgtgcattgcttttactaagaataataaaacttaactatctttctggatcattctgatttgatgttctgctaaaaacatgagttctttttcctgaaaactaaaatcaagtgttaattacttctgctattcctgcaatgtcagggggttcaggaagaggatgaaaaaactgattaaaattcctggaacgagctcctagaagccttgagagtgaatatctctcatatacctcataaatatagagagaagaggggcaaaagaggggaggaaagaagtatcaggtgtggccctcagagctaggggatgttgaggaacggggtttgctctgttctaagataaagtaatggtgccaaaagcaggaagagcatttctgtcccccttcaaacaaaatagagctgactgccgggcgtggtggctcacgcctgtaatcccagcactttggaaggctgagacgggcggatcacctgaggtcaggagttcgaggccaggctggccaatatggtgaaaccccatctctactaaaaatataaaaattagccgggcgtggtggcgcatgcctgtagtcccagctactcgggaggctgaggcaacagaattgcttgaacccgggaggtggaggttgcagtgagcagagttcgcaccaatgcactccagccttggcaacggagtgagactccgtctcaaaataaataaataaataaatagagctaaagaggctgggtgtggtggctcgcgcctgtaatcccagcactttgggaggctgaggtgggcagatcacaaggtcaggagatcaagaccaccctggctgacatgatgaaactattaaaaatacaaaaaaattagccgggtgtggtggcgggcgcctgtagtcccagctactcgggaggccgaggcaggagaatggtgtgaacccgggaggcggagcttgcagtgagccaagatcttgccactgcactccagcctgggtgacagagcaagactctgtctcaaaaaaaaaaaaaaaaaaaaaaatagagctaaagagccaagacccaagaatagccagaaagacaataaaagacagacaaatatgattttcaaacagtacagaatcaattatcggggaattgagaccatcctcagaattgctctggatgattctgggggtaaatagggttactggaatgatttgagtgggcactgtagcacagtgagattgatggactttgaaatcaaacctacctggttttaaatcctgttactattactttctaaccatgtgactgtaggcaagttgctttacatgtgccatataatagcaatgataatgctaatgataatattaagtatttattacatggtagaaatcagactagatgttttgtatgcatcatctcacttaattcttactgcaatattatgcatattttattatcactgtttttcaaatccatcgttttaaccactcagccacgactacgtgcctcatctctgtttttcagatgaaggaattgacactcaaatacgtagagtaacttgtctttcagaatgaaacaagactggtgaaaggagttgacctagaactctatttactctccccaggctttactcaacacacttacattagatttttatcaggtatgtatatttaagaacagcaaagaaaaacatttgttatattcgctatgacattactcattttatttacacctctatttttaagactattcatttaattaagactttataagaatgtggtttcaggatataaaagtgttgactgagccacatccgcttgtgtgaaaaacaagatctgtggaaatccaaatgcatttttatttactattgaccttatgggaatataagtataactagaaacaaaccaagcaaatttactaatgactctactcagctgggagcattagctagggttctatgtcctaagtctttgacctggctttgttactataagattacaatctccttttaggcaaggaccatccatgttatttatgtttgtctcatccacaatacatactatagctcctatcacagaatggatggtcaataaaacaataaaatattcttacttatctgggctttggtttctggagggttggatttggatcattgttaaggtcccttcctaagacccagttgtgatcttagatacaactaaggtctaacattataacagtctatttatatactggattcaacatcaattctagtatatacatgtaaatctgaaattgtgctgtgtccatgactgtccttgtaaactacaaagttccaggttatataaaattagcactttataactgctttttatggtcatgctagtaacttaaattgatatagcactttctagcatgtaaaccactagatatattctctgattttgtcttctcatcattacactatttaagaaaatattatcatcattttccttatgtgacctgctcaaggacacagctaacaaatgccagagcctgagactggaacccaaaacaaagagtcttagtttagggctctttctattaaaacacacatcacattatcaacttcatcaccatcaccatcaccatcatcaccatcaccatcactatcaccatcatcattatcactaccatcataaaattgaccatacaactaacacacctacttctagcctgtggctagacactaaatctagtagagacattattgtgaagtatatgcagttcatcctggttgccttcccacttgttctgctccctaattgttgccccaaattttcaaaatcattctcagtaaactatcgcaagaacaaaaaatcaaacaccgcatattctcactcataggtgggaactgaacaatgagatcacatggacacaggaaggggaatatcacactctggggactgttgtggggtggggggaggggggagggatagcattgggagatatacctaatgctagatgacgagttagtgggtgcagcgcaccagcatggcacatgtatacatatgtaactaacctgcacaatgtgcacatgtaccctaaaacttaaattataataataataaaaaataaataaataaataaataaataaaagaaaaaaaatcgcttttccaacttctttccttcaacaaatctctcattttcacaaactgctattctcatctagagggcaatagagaagcaacctcttctaggtatttcacaaagaggtggcagctgtaatggtgtgctagatctggctggtacaggttttcaagggctgattgctaaatattcagaatttttcagccttgatgggaaattggcaaatgctacaaattagggtatttattcagaatttttcagccttgatgggaaactggcaaatgctacaaatcagggtatttattcagaatttttcagccttgatgggaaactggcaaatgctacaaatcagggtattttttagagagctggttaaccaattcaccactattgtggtgaccagtagacctcatagaattatttgcatttttaaaaagtgtttattcagcatggtagtggcatcaaaacagacacatagacaaatggaacagaatagcaaggacagaaataaatccatgcacttatggtcaacagatcttcaacaaagatggcaagaacacacaatgaggaaagaacaatctcttcaataaaaggtgttaggaaaactggatatctcgatgcaaaagaatgaaactggattgttgtctcacaccaaatacaaaaatcaactcaaaatagattaaagacttaaacctaagacctgaaactataaaactactagaagaaaacataggagaaaagctccatgacattggtctgggcaatgaccccaaaagcacaaaaacaaattcaaaaatagacaaatgggatttacatcaaaatgaaacgtttctgcacagcaaaggagttaatatccaaaaatatataagaaactcaaacaactcaataacaagaaaacaaataacccaattttaaaatggggaaaggatgtcaatagaaaattttcaaaagaagacatacaaatgcccaacgggtacatgaaagaatgctcaacttcactaatcatcagggaaatgcaaatcaaaaccacaatgagataccacctcacgcctattagaatacctattatcaaaaagacgaaacatagcaagtgttggtgaggatgtggagaaaagggaaccctggtacactactgcaggaaatgtaaattagtacagccattatggaaaacagtatggaagttcctcaaaaaataaaaaataaacttccatatgatccagcaatcccactctgggtatatacccaaaagaattgaaaccattatgtcaaagagatttctgcacttttatgttcaacccagcactactcacaacagccaaggtatggaatcaacctaagtgtccatcaatgaatgaatggataaagaaaatgtggtacaatgaaatactattcagcctttaaaaagaaggaaatcctgacatttgtgacaataaggatcaacctgaagaacagtatgctaaatgaaataagccaggcacagaaagacaaatgccacataaataagttgaatttatatgttaattatttgatttagccatttcataatatatacatatatcaaaacatcaccttatatgccataaatatatacaacttttatttgttaacaacaccttaataaaataaaacaagcatttaataaaatcccaagcaatgagttggtgaattggagaagtttctacagtatgatggaaaataccaagatattttccacaatatcttggtggaaaagagatcctttcccagcacctcttaatcatagcaatggcttaagccgatcttggataatcataattactgtttatttagtgcacactatatcctaggtactttatacacatttatgtcagtcaatcctcatgaaagccctgtgaaacatcatctccctgttgcagatggagaaactgagatccctggaaatcaggtgactcaactaagattatacaggtaaagggcacagctggtatttgagtttacctagtttgggctccattggttgcatacttgccactcactgtccctgaataattaatataatggtgttattggcaaagataacagaattgttaaagctttgctgagaaatttcctcaatagtaagtttaaatatatatatgtgtgttagatgactctggcactcttctccatagaagcagaatggtgacttagataatcccatggtccctccaggtcttctaagtttaagattctgtaccacaaaaactatgttcattattatctaatgtatggattagattgttgaacattcctttgactgtcttcctcgaaactaaaggttttgggggcaactcctatcttttccatgattagaaagggctttcattgcaattttcagggctctccccacttcaaactgcaccctctcctcacatttgacgcaacattttgtccaggagaaacccatcacaaattgtgtcaaacttaaaacacaacaaacaatttatcttcagaaggttgtcataattttcctgactatatttgctaattattgatgctctcccggtttacacaagagatgtgtccatctgctttcccagtttgaacatgaaataaatttgtaaaggcaaggtggtgacaacagcttcacttctcccaggcaacaaattatgatgctacacacccaattattatattactgcagaatctgctcagaaggaaagagatagctgatcccaatacaaactagctgaaaggccagcaaatggcaagatcataaaataatagtaacagctaacacttattgagcactcactgtgtgccagataccactctaagcactctatgtattaactctttttatcccaccaagttaattatttccagtacacctcactgtcactctagaaaagttatctattcacaaacagtaaagataaacttaaccagcttgagtctagcaccacaaattatattctcctaagctcagtttccctgactcactgtgcttcctgatatccatacagttaatggattatatacaagggcagaatctaagagataaatatgttgagtctaagcaatctatctccagagtccattcttctaactcctacactatactgtactagtgaggaaattagaaaccaagtagatggagtgaattcactaatgttacagttgttagaacacagaatcaaagcatctcaagattaatacaaaacaaaagtattaaacacaggtattcaagcattgcatgagaatatttctcaatattttcaaaagaaaaaccaaaatgcacatcttgtaccaagtctctttgcattacatgccatgccaagatcatcaaaaaaatcaggtaagtgtaacttgatcctaaatctttgaatttaatttgaggactagacataaaccatatttatttcatagcattttacttatcatttgtgaataaaattacaaagcccaagatttaaaattattaccttctgttagttactagggtgaaacatatggaaagtagtaaacttcaagaggagcatttagtcaacacatacttacttagccaaacacatcccacatgtcccatgtaagaaccaacacttttaaaaaccatgtccctgttattttcaaatgcatgtcactgtaattaccacttaccagaattattcttccttagtatcagaaaggaaggtttacaagcattaaagtctagtgaaaagctgaggatttttccatcttcccccctgcattagaggtactggttaacaaaatcatgctgagaaatcctgtctcctcttcttctccactacctcagtaacttccccacaggtcttaaattccctcttgaagcagtatcaataacttagacatcgaagtttgcaaatgcctccagaatctaggtaaacgaactcaagaagtgaaactctacctataaattgttaaattgaaagctctcaaactcaatgaataaggatgacctgagtattcattaaaatgcatcccttcagagattctaatttagtgggtctgcaatagggccaaagaacctacatgttaaacaagtgttccaggtgatgtctgatgctgagagttgatttaaaggccacaagcaacacagctctattcaatatcataggcacacaagggatgagtgtccatcaaagggaaggaagtataaaacagtacaaaggcatctgggacaagatggtagcctgcatgcactggactaagaagaggtaagccaaagtagggaggcatgcaactatgaacctgctggcatttggatgtggatgactaccaaagattaactctgcctacccaaaaagtctgtttagctccttacatctagcttacaaaatcacaacacagatattaaaatcaagcctggatatgaaacatttatgtggtacagaatagagggaaaggtagtcgtggaaggagcctagttaagtaagggacgctggactctaaaatatatctaaagaaaagagcataagtgatatttttgaaaatcaccaattttttcaaagtttcaaatttaaggcattatcttcagccagaggaaaatcctctcctgatttgtccaagtcatgaggaaataagaaaatgctctttcaatcactccttttaaatatcttaccttctacgttgccagatccctgataaaatcagtagtgcaattgcaactatgatgatgcaaaatatcacaccaaatataataatccagatgggcacagatgggtccatgggtggtgcaagtgtggaagggatttttaaaaattccagagtttggtcatttagaaagaaggcattgttgatccggttcttgttcattctaaaatgcaatgataattaaaaataaacaaaataagacagaaaaaaaactattaagacaaagtacaaacctgtttctccatgattataaatatctctataaacaaagcatcctcctggcaggagacttcaagttgactaaaaagtttgctgagggcaatcatgccatagtttctcttaagttacaacactagctgccagagggatacccatgtatccactgctgcccccattgttgtgaatgtccagaagtcctgagctttgagctctgtccaccatgttttatttcctgagaggtagtaaggtagacggagggactcgtctctggaggcagggctctaaccctggaccaaactgaggactaactaaaacagagctagggggtggcggggaagcagctttccatcagacatgcccaccagtgtgccatgtcagtttaccattgccatggcaacacctgggagttaccacccctttccatagcaatgatgtgatgaccccaaagttattacccttccctagaaatttctgcataaactgctccttaatctacatgtaattaaaagtgggtataaatatgactgcaaaactgccctgagctgctagtctctgcctacagggtagtcctgctctgcaggagcagtcacagagcagtaacatcacaggagctataatactgcctcttcagtaaagttgttttcttctacttctggctctctcttgaatttttttcctgggcaaagcccagaatcctcatgggctaagcctcaatttgggtttcacctgtcctgtgtgagtagcatctagattagaatgacaaagctctatttaaggtggcttacataaatatcacagcccccaaaagtaaaattacatgtaaaatatgggtgatgaataggagaagtaaagaaaaccagaagcaaaaatgaaaacatgaaccaggagtggcttcaaattcaccaacttgatcttgatatttttttcattaattcaacaaacatttgccaaaaacttattaaatatcaaatactgtgctagatgctggagatacaacgtgaaattaaagtaccaaggagcttacggtctagaagggtgacagatcagtagatccacaaccacagtgtggtacaaaatgttctgtgaaagaggcaaatatgggcacagtgtgagcagagggaagggccaagtacaccattgtgagaagtcagagctgctttgctgtggaggccatttttgagctctgttttgagggacaagtaggagtttttagaccaaagtatgtggtgagcacaggaatggaaacaaggtaaagtaagacttgttcagcaaattgcaagtagttccataggactaaagacattaatgatttaggagttcaaaagcttagaaaaatgttacttttcctaggaaatatctgcatttttagtggtggtggcagttaaggagaggttggtagcaaagacttatttaattgaaaccaaataagtgaatttctaactgtaaactggagagtccttggagatattttatgacctttactgaattcatattatgcaagctgcctttgtctacctctagagcagccctggaaaacagaaatataatgtgagcttcgtgtgacttaaaattttctagtagctgcactaaaataaacagatgaaactaattttaataatgtattttttgtccaatatatccaagaaaatgtaatttcaacatgtaaacagtatcaagttgactttgcatgtttgtttgtttgtttgttttttgagacaggaacgatcatggttcattgcagcctcaaactcctgggctcaagcaatcctcctgcatcaacctcccaagtagctaggaccacaggtgtgtgccaccacacctggctgtgtgtgtgtgtgtgtgtgtgtgtgtgtgtgtgtgtgtgtaaacagggtcttgctatattgcccaggctggggctccacattttattttgtacaatgtctttgaaatttggcttatgttttacactgtgagcacacctgactttgaactagccacatttcaggtgcttaataaccacatttggctggtggctacggtaccggacagtccaagtctacagcctgatagtatggcttgagaatctctgcaggccagcaccaggctatcaggaaagaccccctttagtaaataaataactatgctgtggcatgattattcatggatgtgaaagtgaactctagccagataatctacaacaagggatttttatccaacaatggaatattttattttgtcataacctaatattgaacatctgagagcacaaacttttccacaaaataatgaaacccactgctaagatataactcagagaaaaatgagaagttgctctgcattctcattctatcttcctagttggttaaccctttgttacttgctcactctaggcttggaatgtattctatcatctcacagactgactggaagttctagctcaggtacatattaaatctgctccaccactggaatcaccaattggcatcaagcatcatgtatgtctttcagccaagagtggtattgaattaggccacgccctcacaaaagaactaaaacagacatcttggaattagttggtcactcctttacctcatactatgtatactctgtattggtaaaaagtccagtactcttttttgcccatttcaattattttacttgaaatgagaattttgtaattctcattctgttggctatccccacttcctaaatagtttatcctgctaggacctttgaaatagacattttgtgaacaaattcacgtgcttcctggaccttcaccctaagcactttgtgtaaaggaatgaccaaccaattctaagatgtctgtttcagttctttgtgtactctggtaaacaggaaaaatcactggatatggtggcaggatgcctaggttcaagtcctcactttctctttctagcatggtggccttaacaaatcaattaatctccctgagcctcagtttcttcatttataaaggagagataatagtaattactgaaaaattattggtgttggctgggtgcaatggctcatgcctgtaatcccagcactttgggagtctgaggcaggaggatcgcctgaggccagttcaagggcagcctgggcaacatagtaagaccctgtctctacaaaaaaaaaaaaaaatttaaattagccaggcatagtggcacatccctgtagtcccagctactcaggaggctgagacaagaggatcacttgaaccccaggagttcaaggctgcaatgagctattatcatgctactgtactatagcctgggcaacaaagccagactctgcctcttaaaaagaaaacaaaaaaaaactgttggtgtcattattaaatgccacagatgcataagaacattccttgtgaaccaaaaagtggtatgcaaatattaggtggaactagtattattttgcccaatcacttagattcttcagccttgaaattcctattatttgctctctaaacaccatctcctttttttcactctatccttcctttgttgtatagtttcctttattttcatccaatcctgatgtgccctactaattccctgacataaattctcattctattggctatccccacttcctaaatagattctcctgctaggacccttgaaaaagacattttgttgtgaacatattcatgtattaatacttcccagaccttcaccctaagcactcactcttcctcctcctatcaactgaaggactggtttaacccagtgccttcattttccctgtagccctcacagatcacaagacatgaataaaatcttttttcacatgaaatatgatatttataattcttactccctaagtggtgagagtcttaacagtattcttagtggccacagtgaagaagcaatttagttcaaactttcttgttagggcagattcaaccatttccaatcagtataaatcctcagtgcctttgcttcagcaaaagaaatagatgatgttcacaaaaacctttgacatttgattatatactcattatcttaagtgttaacattttacagagagctaatgagttattccagtaggtatttatccttggtaaaaagaataatatgtatttcagtaacttgtaaatcttgtgtggggagagctactttgctttgttctagtttatttcctgagctcattttttgagtatatctttgcccaacatcaatcacatgtggtatttgaagttttgacacataccaaaggcacagtaattgaaagaaatacaagttgcatcctcctaattcttgaaagtctcgaattcgtttcacttttgagtttcttacgatcataaggaggggaggagtacaactgtcgggaagtcgggaaaaattgtaaaatacttgaaatgggcaaaacagagtactggactttttcctgattgtcctgctgagagcacctttctaggcaatttccatctcttacggtctttgagctactttgcaaatccctaagttcttgaaaactaacataatgtaaatgattcttgtccatagaaaatcaaatgaactgtgtctagtggaacataattggttactgcccgaaaaatagactgatgcatccttctgtaaatgcattttgccattcctcactttctatatatgggtggttccttgaagtctccttgaaaaagaatttaacatcttactagtgccctcattaactaatgagataaaatttttgatagtaataatgattagtttgcatgagagtcatgattttacctttttttaaaaaaaattatctttttaaagtaaagactatatattgactgaaaaaggtaagctattgggtccctaacttctgcttactcaatgctggtggtaccaccaccccctccagctgtgacaataaaaatgtctccagacattgcgaaatgtctccagatattgccaaatgtctccttgaaggtaaaattgcccctggatgagaactactgatctatactcatctctaacagaaactaacaaaatgaaatctttgtcattttaataaataattcatgtatgaaacagataaaactcttcaatatctatttttaaaaacagttgaattaatcagcaagttgattgactaatagaaggcatatttaagggtgattaccttatggctgattgcacctcaacagcaggaagggtgtgattttttgaagggtctgtaaccacaaaccagaatgataccctctgggttacattgcaaagtaggacatgggaaattctgcagacagtggaaagaaaaaatacatgagaagaatatcataccaaatggcattaaaccgttcactctgatgctactactatcttaagagacatcttagctatgtttaaaaagtcatttctaccattatgaagaatgagctcagtaagaagaaaattatataggaaattcccattgtttcaaaatcatatacttggggatcattccttatagggaataacagggaatctgccaaaaaataataatagtcagtggagagcattagggatctcattctccatcaccggttggtgacagcccccgtttccccaatgcttggccctctctgaaccacagaaacctttggtattttctcattcaactctttttagtgccctgcccattcagtcttccacctctcagatccagagaggatctgctgccccctcatgattcaatacttgctctgtctgcatctactgtctctcttccaccccagcatcagggccaagacaaaaggcaccttctgtgtgtacttttgaagaaaaagttctcaaaaacaagtttcttttacatcgccttgaacaaacctccaacttaaacactataatcaattcaccagcagtctttgaactctttgttttgcagttacagacttttcaactgcaaattggaaatgtgactcactctcctctgtattacaagtgaaaggggagaaatgaaaatagtgttcagagagagacaatctatacatggatgtactcaggatggaaattataggaaagtccacataaaatcaacattgccaatgctaaaacaaaacctgatggctttcccagtttacttaagagcaaaattgcaaaaagcaacattaacatccatcctagaagaatctgatatgagtaaaggatttgtttagagcatccaagtgtattgtgatcattttcacactgatcaaagagagcacccttctgtcaacaggtatctgcagttttcaggacctggcagaaattcttctatgttctgtttttaaaggtcaggtacaaaagtagaggcagctgccaggcccctctgcccagagctgagtgtctgggaccatgagtgggaaggactgaggcttgagcctccttggtccgccagacagcatggggcgccacttgccccttctgcagctgcgcgccgcaaagctctggcctggccgtggcctcctgccccatgcaacacttggtggccagaccgtacccggcacatggcgcctcgtgcactttctgacattttgataccaaaggtcgctggtcactgagcccggacactatctctggccctgaccgcagatttcggaaacttctggcagcccagtgtctactggaaggcccaacccactgccctgctctcatgggcagctacctgagcggcttcctgggctggctctgggccagaaaaccgcgcacccacccccccgcccgacccccgcgccagaagcactgggccctactgtccaggcccttcctcagctcccaggtccaggagaactgcaaggtcacctacttccacgggaagcgctgggtctgcatccagcccctccccaccgctcctcccagctgggactacgcccgcatccgcatccggagagagatggtgcccgcccgcatccgcgtcctgagagagatggttcccgaggcctggaggtgctttcccaacaggctgccgctgctgagcaacatcaggcctgatttctctgaggctcgcctggcctacatgaagcggtggctttggaccgccgccacccccccaccagcctgtccgcagcctggtaaccatgaaaatcgccccgcccgagcgcagagggagcccgatgcccaggccatctgccttcgggtctgtgatgagaaacggagtggcccattcctttctgcccgggtctaggccgctgagcagagcccctactcccgggcagcgttgtctcaatccttcctggcggccgcctgccctgctgaggatatgtggccgccaggcgcccggtcgccgcaggagcgctaggcctgcgggtagcactgccctgacgcctcaggcttgcctgcacctggaaggagcttcgccaggtgggccatgagcctctgagcacacccagcctgctgcccggctccaagagtcaggcccctgccaccacctcctgagcctccagccctcagcaccttcaccctactgaccgcggttctacccccacaccagccaccggccccaccggggcacttcccactgctccagccgaccactcagcgagccccaggcccacctctcctctcccttaaagcccttcccttgcccttgcccattcgctcctgccttctccctggggacaggaggcatgcttctccccagtttccgcaataaaatatttgttgttaataataataggtgtctttattatcatagagattgtcatattctttctttcaaagacgacaccatggtttctccagcttggcactactacttgggccagatggttctttcttggtgggggggggaggggggaggggaagggggagggaggagcgggaagctgtcttgtgcattgcagggccttagcaacatccctggcctctcacttctaggtgccagcagcacactcacagtcctatcaaaaatggctccaggcgttgccaaatactccctgggagggtagagaggtcaaaagtcatactggtggagaaccactgaggaacagtgacctctactggcagaaacaggcaagcctagtcccccaaaatgtgcggttttctaatacatatcaaagacgtagggacaaaccaaatgaagtggcgcatgctggacagaaaacattttcaccagttttctagaatgcttggggtgtgaatgattcctgtggtctggtcttactagcaatcaggaaatgcaaaattgttacaaatgagctactattttaaacgtttcaaattggcaacaatttaaaagttaaataataccaagggctggtaaagacgcatggaattggaatcccaggtgacgctgtggaagcaaggagtccagccactctggaatggcatttggaagtgattcccagaacagaaaacgcagctaccagaaaccctgtggcacacatacacagacactggtgaggatgttctttgcggcactcgtcaccatagcagagaattggaacaacccaaatgtcaatcagtacgggactaaagtaaatatagtatatgctgtcgagggaatactgttccacagattaaaggaaagaaatagcccagggtttctcaacatcagtacgatcaggccagataattttatgttgtgaggataccatgtgctttccaggttgtttagcagcaaatctgagctctatctaccaggtatcaggactacctccagttgtgacaatcaaaaatggctacaggtgttcccaaatatcccctgaaggacaaaatcacccccctggtggcaaccattgagctagagctatataattttttaaataaaagaataaatcttggcctggcacggtagctcacgcctgtaatcccagcactttgggaggctgaggggggcagatcacgaggtcaggagtttgagaccagtctggccagcatggtgaaaccccatctctacgaaaaatacaaaaattagctaggcatggtgacgcacacgtgtaatcccagctactcaggaggctgaggcaggagaatcgcttgaacccgggaggtggaggttgcagtgagctgagatcgcgccactgcactgcagcctgggcaacaaacaagactccgtctcaaaaaaaaaaagaataaatctcaaaaatacaccatcaagtgaaaaagataagaggtaaaatattatgcgtagtacataacatttatataaattaaacaaataccaaatagaatttcaggcataaaaggccagaaatcatgtaaagagtcatttagttactttgcctgtattattttttccatataaagcctctttaaatactgttcaaacatgaatttcatggtattccccattacagagccatagaatacagctgtaaacaaagcaaaatcctttatctcatggagcttgctaaggaggtggagacaaaagataaacaagtaaataaatgcatacactgtggaggtgtgaagtaagtactataaagaaaaaaaaataaaaggaagggcatacaactccatcaacacaactatggccccaaatactttcctctgtccccatcactatggaactataccatgaattcaagttctttaaatttattcaagtttccaatgggtggcaactcatactttaacacattacctcagcaaataaaatgaaaatattttatctacttagaaataaagatttccaaaagattaaaatttttgctgaaaatagtaaaccttacattttcaatagagacagttattgttagatagaaaaagttcctggactgaaactctaaaaacaaagtttttattttgaaatttactacctgccaaatggtggtcttgagacaagtcatttcgctgtctatgagttactaggaagggcttgagctcttagtgtgtcaatgggggtgtgctgttggcattttgggtgggaatgttatgggtaactgtcttgagccattcaccacactgattatctctcttccccaccctttaaatgccacagcactctacagtcatagatataacccccatacagatcccatttccttatactccatgggcagggggcggtcagtaccaagtaagaaacacttctaaatcccttcaaaagtttcaaggtcatgaaaacaaaggaagacagagaaagtgtcatagagtggatcagactaaggagaaatagattcttaaacagaaaaaggacattagtagaaaaagtgaaccaacgtgaatttctttgtttggataagtctaccgtggttatttaacatgatatcataagggaattggggttagagcagggtttctcaatagcaccattaacattttagcctggataattctaggttgtcggggactgtctatgttttgtatgatatatagcagcatccctagcctctacatactagatgccagtagcacatccaattgtgaaaaccaaaatgtctccagaaattgccagatatccttgggagcaattgcagggaacccccccaccaagtgttgagaaccactggtacgtagggactctctatattaactttgtaactcttttgtaaatctttttaattaaatacacagacatatacatacatataagagcaaagcagttatttaaaaagttgcctgggcacagtaaaagtatctacacgaaaaataaaaactaggcaacgttttaatgcttttgactagcttcattgataaggagataacagatttaaaaaatttgtttgaaattaagaaagctgtattcaaatgcaagatactggtacccaccagcataaggatggtattaatagttacctgaattttttaaaaattctttgttatacattcagatgtaaaattatttattatgatgacttccatcgtactagtttcttaagcatcatttctctaagattgatataaagagaagaggtaaatagttttggctgtttgtggtcttcttcaacaggacaatgttgtgtccttcctacatgatgtttctgcccaaatatgtaactcgtctcaagattctaagcaaacaaaaaggtaacctaatgttcaacaaatgtcaccaacagatatataactctacagacgtgtttatattttgttcacatacaggcagttgaactaagaattaataagcccacttcccacagtagcaatgttgtgggaagggggccaggggaaagcctagccctgctctgaaggcagcaaaggctgtatatgaagatggagacacactctgggctgatacttcctacttgcttggatgatgctttcagaaactaactgatgtcttggcctccccaagagtaagaaaccgaggtccaacaagagctaatacccaggcaacagggaactgcttctactctggccattgtgtgccaaatccaccatgggagcatcctcctgtgggactgaggtgaaaaagagaaagaaattggggggatggggggacatggttttcttgtgtccactgcacctcaatagacaggcctctggtttaagagccaggatgttaaacatgcttcattcactcacaactatttactaagagctaaccttgattagccagtatggttagggatatggttaggaaaagagttcctactacagcggccttcagattccgtgccccatcccatgcaggaatttagtgatgctaagactcttgaaaaccaagaccagagtcttgagtccaccagagcattaaataccaaagtggaagccagtaacccccacggtggcagaatttgcacatagttccatgccctatgtgagaatagacccaggacatggggaggacaaagatcttctagatttcacatggcttgtctgcattctttgtcaggagggtctctaatccctgccctgatttgaacttcatgatctccaagcaaagagcacctgttttaatttgatcagttgcagggtcactagggagattatcaaatattttgtccatttgcagcagatttctcttgtgccctgggacatgaggacatgagtcccaagtctgtcctgtgctgtaagcccccatattcctgaagcttggcccacgtggattcagcaagtgattggggggaaaaatggatggatgaaagaaggttaacatctcagtgcttctgacattattcccagagagacaaactgaggaagtaaattggtccagggctgtaataacagaaaagagaggcagggagggaaggagattactttcccgaaactttatctactcacctacaaatactcagacaacaaaacaaaacacagaactctctggcaaaagaagaatcctgaatatactgtagatgaaagtagccaagaagaactgtaaatgtgaaggcagaaagttggtgctaaaaaggaagtaacatgaagaatgactgcacatagttctgtaatttatgtattaaggaaccaaaggatacaaatttcttccagttatagattatgtgcaactaatgtgacttctccatggcctttcttccaaatgtgactacattgaatgtcctccaagatttgtacagaatgaaaaattgatcaacaagcatttcttgagctaaacatgtctttttaaagcacgttttgatgtcataaagaaactgaaatgccattagcacaactaaataaaaatcctacattttcaagattttaaatatgaatgagtccaatggaattattttttgttgttgttagagcaactcagcgaaacaaaattctaatttattgttcatcatattgtttcacacatatgtcaaagaggccaaaaaaataaacagcaactttacagacaaaaaaaaaaaaaaggcagggaggggagtgagaaaccttttatctttggcctttttaaccatctcatacaaacttatagtaccgctaagttcatatacaaaaaagacactggaacactcggaataagattttgttgttgttgttgttgtttttgcttttcttcaaggtttgttttttctttgaactgtatcatgaacatggtcacaccacaagtaaagtcagaagtaagacagagaaagctctgaaggctggtttgatcatttgaaatcattaaaaatggctgacccctaacaatatgtacaaaaatatacaatgaaaataaaaaatattgccaggtacagtggctcacgcctgtaatcccaggactctcgaggctgaggcgggcagatcacctgaggtcaggagttcgagacagcctggccaacatggtgaaaccccgtctctactaaaaatacaaaaattagccaggcgttgtggcaggcacctgtaatccttgctactcgggaaactgaggcaggagaattgcgttaaccgaggagatggaagttgcagtgagccaagatggcgccactgcactccaccctgggtgacagagcgagactccatctcaaaaaaaaacaaataaataaacaatgtaaataaaaaatatgaacaaatttttttcttgaagtacttttaaggaaaaaagctgagctttggaagtttggggttttttttcctcccctgttgcaaattcttgtggtttgggttgggtgttgaagagtgcttgcccggcaggcctctctacttcaagatgactacacttagattctgaaacagggtgaagagtgaatggatcacggtggccttttctctttttttcttttttttaatttaacttttccttttttgctgtctagtcaacctcatcagtcttctgcttcttggtatcaacgttgtcatcctcagcatcttcaactgcccatttgcccatagcatcctcagctgccacatcttcatcttcatcctcttcctcaccatcaccttcttcctcctctttttcctccccatattcttcctattcttcttctacctcattgtcagcctcctgtttcccattttcctcattagcgttcccattaccaggaccatctcttcccttctctgcctcctccacaacttctttcttctcctttaagactttggtgatgatcttggagctggtgtccacagttgcatctgacatggtggggcacaccagtgaccaatgcagtggactaaaaagaaaccgagagtttggggactggcaataatgcagagtccgagaagggcaggtgtagctgcagcaagctggaagccaaacccaaaaacaatgcaaatatggcttttcagagcagccagtgggctggtggaattatttgaattcactttaataatcattttgaccaattgtttttaccaagaaattatattaattcatacataagtaacttctttcagcaaatcatgaaagagaggtaaaaatgtttactccttttcctcaagtgtggaaagccctggtctgaaggtttctctaagaattggatccactgccatttttcatcaatggcgccagacagggccaactgcctccaaagagtggtaagaatctggctcttgtttctggaaatcaaaaggactaaataggcgctgggctgctgttttacaagcacaagaccgttaatccccttaccgtggatacaacagcacgttgttcctttttagatcacaagacttatccttgaataattaggcagaggcagaaatccattatatattctacaccatttaactcagaaagagaaagccttgcctgagttagactttatctttcttgctaaaaatgataaattatctaaaagttgatgtttgagtaaactaggcatattaagtttccagttgacctgggaattagactaaactttggattagattatagcttccttagaaattcctttcaacattttaaaattcctgtgaaactgttttagtaaatctggcctaaatcatattttaaacagttgaaaacacttggttgccatcttcaatccaagttccaggaaaacctcaagtaacctcaactaatgaaaccagagctttcccttaacttcatttttccatctatctcccattctgctcctaaaaaaatacagcaatagcaaaaaaagcatttaatatcagaaattgtgaatgatgattttgaaagagttgtcttgttgctgtcacatttgatctatctttctacaatgtctaccagggctaggttcctgggtgtggacctggtgcagtgtgggacctggtcttagtcctcattcgaatctcagtgctcagcacgtagcaggctttcagtagaggtcacttaatcctgtggctccagccacagcagtgtagttccacgggctggcctcatggacagcagtgaaggaagaggttgatgttgctcacactgttccctttgggcactctgtcagctccttcttcctcgcctcttgacagcatctggggcagatggtgtggctttcctgtcacttccggctgctaaggcatccaggccagtctaaccaaaactgccttcctgcctctcacctacagctgctctccttccagcagttctggccagagcagggacctgagtggtgggctccagccatttcctccgggctccactccctactccctccctgcctgtgctcccctccaccatgcttcattctcctcgcttagggacaggaaagcaagatgatgggggcgtgagatagataaggaaaggccaaattattcttcctggacctgggtccttgtggttcccccgctttgagaggtcttctgtggtagtggacgtccagatgctctccactcagaatgctcctgtggggccttcaagggcccctccagggacctctgcactgcatcttcccctgacatgggtgacacgctgactgatttcctccacctcgcctcggctctgcctccggggtgtacacctccagcctcactctgctgccttgccttgctctgtctcacttagggacatgggcccaataggcagtaactctatcctgttcccttccaaagcctctgcttggccccaggaatatattcaagtgcagactgctcaaaaaactgctctctctctccccagtcacaggtactcaagccagccttccaccatgagacttctctggctaagaagtagccaccagtttctgttccagatacactctcagtggctagggacaccatcatattctctagagctccagctactgttactctagtggcaacttgacggagtcctgagaatgtctgcaagttggggagcatccctccagaaaatattatgccagtctcctttcttaaagacaactgtatcctctatgagcacttctctacctgacttcaggtaggtagggatgcaaacaagaatatcactccaacacatcatcactcgtaaggaatggggaccaactcatcagcatgaactcagttgtcaacaccctagctggccgcactggggaatctgcacaggaacccattcccagccctgttcaagtcctaggggagtggaaatgccacagccctctctgcaagcccacaccctcagcctctctgatccccttagggaatccctggtttctcttccactgcctgcctgcggtgatggtaactggactagatcagctctccaacaagacatcacttcctttttcatagccatgcaagcttctactgtaagtatatgccaattgtacgtttccaaataggaagaggcatgctcaggagacaatgagctctgtatcattggtggtgaccaaacttgatataagagatgttgtagatatcaccctgggtaaaaggtgggatgaaagtgagactattcattattctgttaattacttgaatatctttatttttaattcacgtgatttggtttatttttgtgctttacagttttctgcaatattagtagataaacaatggtgggcgggggggagacaataaacagccagtcccaaaacttggatcctgaagctatcctggaaaggaatatttgccacactccttcagtctgcccacattggcaccaaaagatttctggaaggcggctactggtatcttccatccacctgccacactggagagaagcagcctctccgcaaagctattttcaatccaatcttgcattatgtggtgccctttcccatagctcttcatgtaggggtgcagcttccaatatggcagtgcatgtggaatccaggccagcagctgaattgcatcttaaacacatctcgctcgccaattcatccccttgatagcagtattaccaggactcatactgcctgactctttacagaaaaatgtgtactgaccctcagtccagttttgcagttttgatttttacaactgacactggcaacaaaagcttctacttttcttgaaggtgccattacttgcaatggcaaaaaccacaattactatttcaccaacccgacatatatcctgtgtacccaatttttttttttttttgagacagagtctcactctgtcacccaggctggagtgcagtggcaccatcatagttcactacagcctcaaactcccaggctcaagtgatctcagcctcctgagtagctgggactattggtgtgtgccaccatgcccagctaatttttgcattttttgtagaaacgaggttttgccatgttgtccatgttgcccaggctggtctcgaactcctgggctcaagtgatctgcctgcctcggcctcccaaagttttgggattggaggcgtgagccactgcacccagccccagtgcccaactgtaagtcaaacaacctttcaaataaaccggatcagatattcatagactcctacaatgctccagattctgaaggaagatattttaaaggtaaactcccaaaaatcaatctgaaatgttatatacttaaattaaaatttcctaagaatggaaacacttaatttaacttagtcatgtactaggtgaaatgtgatcatttaaaggaactaatagtgccatgaacacagcaatgtataaaacttgcttacaagaagggctagaagaaaatacaaagagaatatttaagaggttaccattgtgagataaccagtggcttttcttcttattttttttttcctgttcaactttttgtaatgtaatcaccttatttttattgaaaaaagttattataaatagttgtgaaagaatgctgcagtttaatggcatgaaatacaatatatataattttaagatctataaaacaggagtagaacttagggcaaagttttgttttattatataccttcttttcattttttgaatcacgttaatatattattttaaaacatatatttaaaatatacatgtgtgtatacacaaatgtatatgtgttcattttgctccctcaaattccactcttctgtttcattctttatattcatatcccatgcatcagatattgtggatgtgagggagaccaattaatagtaatcatctatactgggccttgaattattatagaattaagacaaaaagattgtacagatgggagaccaaaataaaaggttaggttggaggatatgactttaatcagcaggcagaatttctccctaatttaaaaaaaatcctgaaatgaaatatattcacctccattgtctcaagtagagcataagtgaggcaggtattgtcctgtactggagtaatacacaagatatttaacccttcatataaaatggcacctactaaatgctcctcagctgcaaacagcaagtacaaccttagggtgtatgcacctgtgcatgcagggcctggttctgtacttagctagagagttgcatgagagacgtctgctatcatttggggatggctacctcacaaggagaaaggaacccatgcccaggttctccttccagctcaccaatcacataagtcattttacctctcaagggaggagtgaagaagggaatagagaaagaccaggaatgttaccctcatcacaaatagagaaagaaagaaacatcatagagaagattcctccagaagaacagacaaaaaatataaaactattaaaagtcatattaagtgcttttaagaaaataaacaaggtactatgataaataccaagagtggaaagaacttatacacacttaggttattttcaaaataagagtaaaattctttggtatctatctgcaagaaaattatatatatatatatatatatatacacacacacacacaatagaaatgtagaaagcttaggatatatagctgcaattttgagggatatttatcttcatattatctattaaacaaagagcattgttggaacatgatataaactgtaagatgagttagattataaaagttatttttaagtttaataaaagtgtgaatccctttgaaaaattagcttaataaattattttcaaaatcaaggtttgaaataatgcactatctcaaataatactgtaaataatcagttaagatttctcattatttgcttactctgttgcttctctgttgggaacttttctcatggagaaagctaccatcgctttgaagaggtattcttcattggtatcccaggcatactgaaaaagaaggaaaacaaagtgtatgggggaaaatatggtccattggttctacttgtacccacagtggctctccctctctctctctctccacacacacacacacacacacgcacacacacacacgtttctcatatattagatactggagaccacgataaattatatccccatgtttggggtagggtttcttggacattctaagtttggtgtgtctcctgttgcactatcttcctaagaacctgcagcatcagtacccagccaacaaatagggcatttggacatttcatcctggccatatatagtccattttcatttccttcctccctttctcttttccctcataaactccctcccagttgcctttattaacatcagtacaatttttaaaaaattttcttagccagaaactttagtgtgtgtgcgtgcatattatgggctgaatttttgtcctcaccagaaaaatttcatgttgaagtcctaacttgcaatacctcagaatttaactctatttggagacagggtctttgcagtgatgattaagtcaaaatgaagttgttggagtgggccctaatccactatgattggtgtccttagaagaggaaatctggacacagagggaagatgatatgaagacacagggagaagacagccatctacatacaggccaaagagagaggcctggaacagatccttccttcacagccctcagaaggaaccaaccctatgacatcttgacttccagaactgagagaaaataaatttccgttgtgtaaggcacccagtctgtgttactctgttatggcaaccctagcaaattaatatagtatatttgactcactctgctccttaatgcagtaaatgcaaaaagcctgaggcaaaaagaaactgagctgtttaaggaccaccaaggagggtagcaactaaagagaagcaggaagggagaaagtagcaaaagctgagcggaagaagttggtgagggtggggggttggtatatcacaaggacattgtcaggattggggtttcactctgggatggggaaacatattttaccgttactgcctttctcctctttggtggcagggaggatagtaagtaaaaataaatgactcctaaataacaacaacaaaaaatgtattactcagttaccttctctgggtaaggtttatgactgtgctgtactttttcctttctcctaaatattttcatagcatattctttttttggaagggaggagggatggggtcttgctgtgctgtccaggctggtctcaaatgtgtggccttaagtgatcctcctgccttggcctctgtaacatagaaccttaaactttcttcagttgcttcttccacttcaccattttctccttcagtcctaccttatgtaactctgctgtaagatgttaccataaagaacagaaaagggggacaggagtggtggctcaagcctgtaacactttgggaggccaagatgggtggatcacttgagcccaggagctcaagactagcctgggcaacatagtgaaaccccatctctaccaaaaaaaaaaaaaaaatcagccaggcgtggtggcatgcacctgtagtcccagctacccaggaggctaaggcaggaagattgcttgaacctgggaagtggaggttgccgtgagccaagatcatgccactgcactccagcctggatgacagagtgagaccctgtctccaacaacaacaacaacaacaacaacaacaacaacaacaaaagaatggaaatggaaaaatcacttttctcatatgcaaatgttaaatactgcattttaatgtcaactttagatcttatttgaagtgctccttcaatgttttgatgtgaacttttcatttgatattatactatgaaagtttaaaagtaactgattggtggcatagctctttgtttttgataatgcatttttttccaaaattaattttattcagaataagagtagctatgatctaacctaataataaatgaataaaacatgaagaagaaatgggtctgattaaaaatggtgcagaaacactattaagacagggaaggcttattaacagaatgcagacacaaggaataagcctgctcaagaacaaatgagaataataagctcagtgcagaaaatgaaaataaagatgttagccagctctccctgggacatgaatttcagttgcttttcagatcttggggacaacttgacctgatctcctgtccttccatttgttcatctcaaaaacaagagcataagctggctgggtaggagtccaattttggtcacagaacaaaggtccaagctacttagatcagaacagaactgatgcagttctagattgggttgggtatcctgccagtggaaccaacttatcttgggcaagtgtgaaaaggattgaaagcttgtgcattggacgtagtgtatttctcccagggcattcaaacacttcaaagagagagcctccgcttataaaaggaattgagcacatatattaatgagaaaatgtacaacttaagagaggataaggtaagagttactaaagctaaacatttgtatactttatgatccattaatctactccagggtaaatacccccaaaaaagaaggcatatgaaaaatacacatataagaatgtccatagcagcttaactacctgttgtgcgtatacttgacacataataggtgctcaatgtgaaattgaacacatctttatatgccacgtgtggcttcacagaccaaatggtacaaattaattgcatatatttatctatcagtttagattccttggttcctcatttcaataacatgtgccaggaccttaaatgccccagctcaccttgctttttgcacacatctaagaacactcaaaccatggctaaccccacattttaggtaagtaactggtataactagagacaattacagaacagggttagttggtttaactctaaattcatgatgacctacccccaaattgcctgggaatccctaaggtttcaccatcagttctctttctcatgggtcacataactatttcaaacctctctctagagagagaactgatggtcaatgctttttttttttaaccatttttcccaatggtttccctcaaacctcactctcactaaatggttttgcttcataatttatagatacatctcatcaatttcaactctcccaacctcctgacatcaagatacaacacttcctccatagacacgtcttagccgcctcctctcctgaagtgccagacagaactatgcctatcagaggccatttccgtcacttatattaggaatgcttctcctctgcccttctcagatctaaacaatatcagttcccctccattctgtgtatttagctctgaccggagtctgttcattgtcttttaaccaagctcaagactttctcattaaagccatagcaaagagctgttgttttgcaacagcaaaaacaaatcattttactcagtcttcctttcttctacctactgctatctctttcctgcccttcacagccaaaattctcccaggagttgtccacacatctgtttcaacatgttcaccactcatttattttttaactccccactatctgtcttccagctcctccaccccacgaaaagagctctttctaaaatcaccattgacctccatattgtccaacacaatgaacatttttcagtcgccttctggcttggcctctcaacggcatttgatgctcttgaaccctccctacatctcaaaatgaaactccctaacacagcccacatattccttggcctgcctgctcctctctctttaagctcatcacctgccatgttcctcctcactgccccaattccagatatttctgccctctttctaatctttactctcaccaagatccttcctgtgataagcctttgcacatgctgttccctctgcctttccttctttcatttcctgtaacacttcaactcatgcttcagacatcacagtaagtgccaggtattgtgggccttgacaaagccgaagtgcccttgtacttcttcccgtaatacttgtcaagattgcacatttgcatttggtttactgaatatttaatagatgaccaattctactactactataagctccacaagggtaaggacaagccttaatcaccattacatcccagcattcagcatcgtacctgctattagaggatactgggatggccaaccctgcacactagtagagacagtgtattctgcactcagactgcctgggctcaaatcttacttctgccacttgctgacttgaaatattgagcatgttacttaatttctttgaacctcagttttctcatccattcagtgggaatactaatacctgtactactatcttcctcaaagcattgttgtgagggctaaatgatttgataggagtaaggtgcttagaagagccccagctagaaagtaagataagttctcaataaatgctggctgttataacaatcattactcattgagtcaataataaaataccaaattgatgaactggcctgcaaacagaatacctctaagtttctttagcactcttttttctgtttctatgcctaaggcatcttaacgtcaccttctattggggaaaaaattttgcagaccacactaggaaactgaaactagaattagacaatactgtctttttaattcaatgatctttaccattcctatagccacatgggccctatgactattttttaaacttctatttcataagcatatatttcatatgttactttgataattgagaataattgaagaaacttcaggttcaaattggaaattttttgtgctatgaaagactttatgtgggtagaactatcccttattttcaatggtagaaaatcgaggctaacaaaattcaaatgaccacaacggtgaggagtagacccagtccagacctgaacgactgactcaggccacttggcttcactatcccgagttgagatgctggttttttaagttgttttgtgtggcacaaaacttcacatgttgcctagcatacactactgattaaatactttaggcaaacctactttattaaaaattcatattattctataatctatctttaagaaatcagatttgaggtctttagaaataatttattcaagattaaggtaactatgcagacaggcccattattagagaaagcacagtgttattagcaaacaaaatttaaaaagaacactcaggtgctccacttactgctttatctcccagagctgttctgatactaagtctcactttaaaagcattttctgcacctgccagaaaagaaaaaagaaagagcagtatatgatgattaggatctgccaaaacagagtctgaaaaatcctaatatgtaatgcaactcaaactaatggaacaaagaactacaattaaacagccccaaatactcctggaagtttaacctaaatcatcttagatggtttaatattttctttcaaactcattaaacactcactgccccaactttcaagccacaacatgtctgcagatttagaaaaataaagagttctttcagtcgatgacttgtcaaacatgtagaaaactgttcatctatttttaaatttcaaggctacatacctggttgacagagttcagcatgaatggcagtcaccagaaaaaagagcagccacaacattctttcagggtggaaaacacaaggcaaagtgagaaaaaaaaaatccacgctgcacttaaatctgccttagccattctgtgacccggattagaatatcagagaaacaagcgagccaccaccaaaaaggtttaatgattaacacccatcatttgggttaatacttccataaaaacagcccatctcctgtcagttatttatgaaaacctgtttggaaaacagattagttgttttccctactctgactctacctcaaaagaatgtcttctttgctgactcaaagttggaatcctccccgaccccttctgcgattctctggttacgtgtatgatgggaagaattgagtcctgtctagaggtttccttgacatgcacttcccaccttttcgaggctgagatacctggttcttagataggctatcttcattcaggaaacaaacgtgactcccttctctctggtaaacaaagggtgccctccgtgaagggcctcacctgactctcaccacagcgggtgaacatcccaggagagcttcggagcttcctcttacctacttaaggttagagggtgggaggagagagaggatcgaaaaactacctatcgaatactatgcttattatctgggtgacaaaataatctgtacaccaaactccagtgacacacaatttacctatacaacaaaactgcacaggtgcctgcacattcacacatagggaatgattgtgttcagccctgaggtctggcacttgaattaaatcaaagttaatgatacagagcagcactgtccaagggacattctgtggcgatgggaatgttctgtgtctgtactatccaatatggcagctactacaggtaggaggccattgagcactggaaatggagctagtgtagctgagaaatggaatttttgtttaatttaatttaagtaggcacatgtggctactgactacattggtcagtacagcaatacaacagtaattaaaagttacccactctgaagtaccttcactgggttatttctctgatcctcagacacttcacaattgttatcatcatctcatacgggagggaactgaggctccagcgttgaagtcattggcagcaatgggatgagtgggatgggtgtcactttaccagctaggttgacttacacttgaaccctgtctccaccacacccaactgctctgtgtctctggtcaccattggtcaaaattggaattgatcaaataccacagtctcactgataagtgggagctaaacattgagtacacatggacacaaagaagggaacaacagacacaggtacctacttgaggatagtgggtgggaggagggagaggatcgaaaaactacctatcgaatactatgcttattatctgggtgacaaaataatctgtacaccaaactccagtgacatacaatttacttatataacaaacctgcacatccacccctaaacctaaaataaaagttttaaaaaaccctgaagttgcaacaaagcctcagagatgctctgagaattaagataatgcgtgtaaaagaatctttccccggtgggcattccacagatgccaatcaacgccccgcccagaggttgatgtcaggactttcctctctaccatgctgcctcttcataaattcagtccccaaattccaccccattcctcaaaagtcatgaatggcagaattagattgggtgactctggtgttaaatagaaacattggattttcaaagcaacaacgaggaaaatatcaacaatgagacttctgcagcactttgagaaacacatcatttctccctccttgcgagggtggtattttattgtaaaggacccacatccatcagctaaatccaactgagaaagctttttctcatctccttcaccttggttgcaaggacacggagtcaggaaaagctgtactaaaaggagagggagccacaacttagtccagccatcctagcaatgtcactgtattaggtgcagtggaaatttccagaaggaagagctcacctagctaacatctgaaaaaaataaagccagactagatgaagtcatcttgggaaatgttaaactagataaagtcatcatgggaaggaaaagtcaatacacatagagattgtaacaaagcattttacttacatcaaggaagaaagctatgctaagaacatagaaatctgcttcagcggctgggcacagtgcctcacacctgtaatcccagcactttcggaggccgaggcaggtggatcatgaggtcaggagttcaagaccagcctggccaagatggtgaaaccccatctctactaaaagtacaaataattagccgggcgtggtggcaggtgcctgtagtcccagctactcgggaggctgaggcaggagaattgcttgaacccgggaggcggagcttgcagtgagccgagatcgtgccactgcactccagccggggcaacagagcgagactccatctcaaaaataaataaataaataaataaataaataaataagaaatctgcttcagctttcctttagccttacacttcataaaagtatcaagtggctttctttggcttttacttagtcattgatgtaactcgggttgaagacaatagaacactgagtcttagtgtaagtcattcatttgagaagacaatctcttttgaatgatggtttctcaatgtttgttgtatcatcttttcaaaaagagcaatagaaattctttttagaaaatacaaagcagcacaaggagaaaagtaaaaatcacctgtaattccatcagcgtcaacgaatgaccaattgtcaatgttttctaaatatttggaacatatctttctgccttgtgctttcttttttgtgtaaatacatgtacatttcttcttaaaaacaaaactggggtcatgctattatgcagctttgtcatctttgttgaacttaactgtgttttgttgttgtttgttgtttttttttaatagagacaggatcttgctctgatgcccaggctggagtgcagtggcaccatcttagctcagtgcagcctcaacctcctgggctcaagcaaccctcctgcctcagctcccagagtagaaacacagaattcttcttcaggttcctttagtcttgcatttcttaaaagtgacaaatttcttcataagcttttagtcatctatgtaactagaattgaagacagtaaaatattgagtttcagtcagtgtaagccattcatctgaaaagggaagacaatctcttatttcattatgatttctcaatatttgtgttctcatttttaaaatgattgaaaaaagcaatagaaattctgtatagacaatatagagaagcaaaaaaaagtagaaaacatccataatactaccagaatggatgaccaatgctaatatattttcatagttagaatgcgccttccttagccttggatctctttatatgttcttgtaggatgttgttttttctcactgcagtggcactatcagaacagagtaatacaatgatgggaataagacgcacccttgtcttcttctttactctaataggaatgccactactgcacggaatctggcaagtggctttaaaaatgatgtgtcatgtgatacgagcattatatttgtaattacaaaaaattattttcctcagtaattggtgttgcattttatcaactgcttttcactattaaaatttttaccatttggtgtattacattaatacatttttcacattgattcaattcttagataaaacatttttttaatttatttttagtatgctgctggaatcaattcctggtttttcccctatgatttttaaacctattttcttaaaagaatatcaggtaggttccttttcaagtgctgattcttgaagcgttttttttcctagcctttaccatcttgaaaatgatacagaaagatttctaacattgtctatgtttagaaatacatataatgtaccagaaataaagagttcacagatgaagaatctggaccatgtgcattttagaggaagagttcttcaaaatttttcattccttacattatcatttatttcaggttttatacctctttctgaatccattttggctgtttacaatttccaagaaaatattctgttaagattttctagtatcctcatggactttatagagtatttcccataaaatatctacttttgttgttatgttctctttatattttctaatacgtgtattaattttctcattttgattatattatctttgttgtttaatcaaagaagaagatcttggacataatttgcaattctttctgttttttgattcataaatcttatttatattggttacatactgtaacaaattcattgttaaatagtttgatggagatctcagtaaaataaatggaaaacagaactagatactagggttcttgcctctcagcatattatattttcctatacttttcaaagtcttgcacaaatttagtgcttgtcttgatgtacaagttttaagtagtaagtttccagagccttcatatctgtataaattgcttcataaaatgctcatttcagcaatttcacatatgggagcttcataacttattagtaaccatggtaatgatgacaaataaagcagttcaatcattctgaatatgttactatttacttccaaacgttcagagtttagagcatgtagatttaaaagttcagattactgttgccatgagccacacaaaagggcactgagtctcctgagatgggaaaacgaaattgatttctccgtgttttttatactccacaacactcttgaaaagcactttctgggcacataactatggatctactgctctggggtaaacagaatatgagatcacatgaaaagaaaacacatgtgtcgttcttttgattcatgcaagatcccttaagttcactagattcgtataaatacgtgggcgtatgtaggctccattcacctccaataaagcaagaggtggagatgaccaatgtttcttttaaaattgaccctggttattttgtttcattatcaaaaacagaaatttagtaaatatatagctcctaaaattagtaaactgtaaaaccatctcaaatgtgacattattctgtatatttttattggattttcagaaatgttatctggctgtgacacattaaaagaaatcaattaaaacttttaataattgaacatagaaactttgtataagattttaaaacttcacactttttgctgctgggcatggtggctcatgcctgtaatcccagcactttgggagggcgaggcaagcagattgcttgagtccaagagttcaagacaggcctggacaacatggcgaaaccccctctctacaaaaagtacaaaaattagccaggcttggtggcatgcacctgtggtcccagcaacttggaaggctgaggcaggaggatcacctgagcccagggaggttgaggctgcagtgagccatgattgtgccaccacactccagtctgtgtgacagagcgagactctgtctcaaaaaataaaaaaaacaaaaaccaaaaacaaaacacacacacacacacacacacacacacacacacacacacacaaacccctttggaagttttaatatcttaattaaatggctctactcaatgatttcctaaatgttgtagaattttaataaatgacatccttccttgtttaaattgtaatgaaatggatatactatatataataaacaatatcaagatgtttgtattattaataatttatacaatgttttcagtataattaggcaacaaaaataattttattctctttaaattgtcagtgttaagatacatggagagacaaagtatttttgtctattgtgtgtaagttctattttaactcagtggttttcaattgggggtgattttgtgctccagagacacttggcaacgtctggtgacatttttagtcatcatgaatggcagatgagaggattctactggcatctagtgggtagaggccagggatgctgcaaaacacccccacaaactttaaaaatgtcatttaggtaactcttttcttcttgtagttgagttaatggaaataacccacacaaggaagaacagaagaaaaaagggagacaagtgtgtgtgtgtgtgtgtgtgtgtgtgtgtgtgtgtgtgtgtgtgtgtgtgtgtgtgtggtttctctaaggctaagaatgtaaaaatatatacattgcaatgcatttcatggtacttaatttccagtcacaagcttattagaacttcagtttatgattcaaattagtcaactcagttttcttaaactatcatattcatgggctacgagaaatgcaaaaatgaaccaaatatagtctctgcccttcaggaacttacaattttgtaggacacaaaagtaaatcacgatggcaatagatgcacatacaattgtgaacaaaatgctataggaacactggagaaaaagaggataaaaagttactggatttgacaagtcaattataaaactgttaacaaaagaaaaatagaagaaaggtttctcaatgataatcaagatagacctggaacaatggcaagatgtttaaagataaaacatgaaagcccacaggatacaagttaaggaaatctgaaaacaaacacaaaggacagatacaggatatggccaacagcagggacttgctggtagagtggttcagaggaagatgggggagagagcatcagtgtagatgcatctgaaaagccaagttgggttctgatcttagaggtcagagagtctggattctccaacaatggtcctgagaggctaatgaagatttcaatgtgggaatgggttcattgtaaatgacacagagaaggacaatgggagatgggaaggacattccctgacagtgagtttccaatgtgccctttatttactaatcacaggctgttggactggcagcccactacgtgcccatgactacaaaaaacaggaaattatttttcattggccatcttaataaaaagataaatgagcttattttaataataattttagaatatagaacagatgatgttacaatcttttggtatgcttaattttatgcgcgcacacacacacacacacacacacacacacacacacacacaatttccagtatccttggtaagcaagaaactctataatgtggaatatttttgtctccatcacatatatcccctttttaagatgagaaatcatattaagcaaggatatttgaaaagctcatcaaattttgtaggttaatcagtagccataatcattatgaactttgtcttattcttcacaagttaacatttttctacttcagagaaagttaatcactaccgtttggaaataaaaattaattcagatcaactgagtgagtgtaattctgccaactttatgctcctaaagtagcaatttaaaggacagtttcttaaatgggaaaaaaaaagtatgtgtgtctgtgtgtttcatcttgtgcatggagaccaatgctttataatgggtctcatgtagttaaagcaagacatttcttttacaggtttagctggttccactgttgctcaggtgtaagagttttctcatgatttggcaagtcaattttctctttttactaggctaacagtattgcagccatggtctatgaaatagtattttccatccttaatcatcaatttgcccaccagttggaggtcacctagtcacatttagccctgacaacaggtacttcttttgccaacctctataaagggtgtgggggcgggggcgggatcagaccacataacttttaggttatatgctctcattaatattaaagacatatgaattaatcaatatctcagaatttctgatcctacgtttcggccagtgatgaccctgaaccctctactgtctgaaattcatcaaaagtcttatgagaaatgtttttgtggactgcctaaaagatgtgcacaagagatccctattactacaaatcagagatgacaggttgtttgcagccatttgctcatcccacacccatgacaaacattttttatctatttcagaactttttccttctgtgcatggactcagccaccccaactgagctattcagtccactaatatgaataaatgggagttgacatgtgagttgaaacttatgtgccattatggggaaagattatctaaatgctaccctgaattaaaccagaccattgtggggctgtgtactcagtcgaacaggaaattttggatggttcatgaaattgattcagtgccctgtgctttgtgattatgccaacagtttccattgagggaatgtgggtgtaacaacttatgacacttatttcccacgtagctcacagcgtcatcatgatgaggaactgggatttgccttggggctaaaaattatttttaaaaaaacaaacagtgcttctcaaaagcaaacaaaatcctgattgattggtttttatgaacaccgtaaaactttaaaatacttgttatctcctgttttctatggaagcttagagtgagatctcttgcccaccttcaaaaactgttctggatctgaaagtgtgcatacttgagtgttaatcttaccattggctacattatttattctccctccatgaatttcccctctggttccttaaactataatacttactttatacagtgttgcctatattttggtacgcggcctcaaatcatctgggagaaaataatgctataaaaatcaatgcagtaatttacacaggctgcacttgatcccatttccggtgtgtttaatttttcatgcaaaaaatgattagcattggcaacattttatataaatgagatagagttctcagagccagggtgagcttaataaaaaatgttttgttgaaaattgtcttttactctgtgctccttgtagctcaatattgtgaaagttcccactgtcttcaaagcagaaatggatggaaggtgggaagagaaaggaacttttacactttatatgtgatcataaaatcttgattactggcatatgtagaagtgtatatagtaaatctcactgccatggagggaaaaattgtaatcctctatacaagtgaaaagggaatactttaaatgaagattgagaatttattgtgaagggagctgtactaactgctatgtaagtggcttcctatgtttgctgccccaaaatactcctgctaattagaacaacaaaccagcacttatcaagtccttttccacctatcaactcctttattacaccatctttaattttctcaattcttgtgccatctaaacttgagttggggaagctcagtctgtgatctctttgactcttgtcttatttcttactggaacatagtacttgataaatctgtcttgaatgaatgaatgaatgaatggctaatggaaagtgtccatcctctaagaatgtccgttcagaaatttctggacagaaaagctggtaataacctcctcacttttttcctgtgaacccagaattgcgaatggagggagtaaaaaagcgtaatcttggagcagggggctgcaaacagaggtctgaatgtggtggtgtctagacaggacctagagagcattagggcaccaagtgcctaggaaaagtcatcaggaggacacatcaggaagtagaggagtgtgcttactccatgtatctccctagcatttaaagtccgctgactttaaatgggctggaaggaacacggttccagtttatctccatatcgggttaaaggacatgaaacctagctagaaggaacattgctccaccactggcccatcagttctgtttcctactcggtttttgcttaacgagttgtggtgtttagagttgggagatacatggagaaagtcactttttaggagaggatcagagatccgcaggctcatttcactctataaatgccgcggacatctggttccaggacctggacagtcctctctggagactggtgggcccctccaacacctccgtggcttcccgggatcaagtatcgcacctaaaaggagcgcagagagcgtgcaactggcgggagaggcgtgaccagagtggaaccaaaagtgggtggcctgggaacctaacgcgtgaccagaagtgaaggtaggtaagtgcgcatgcgcaggatgcgagtggccaatgaggaccacaaggttgtagcgtgtggcctgagaggacggccaggactggccagaaaagagaggtgtggaatgcagtaagaaaagtgacgcggaccagaggggtcttgcctgttccgagagaatggaaggggttagccacggtgggaacggccacggcgggaacggccccgccagtgaggagcgcaggcagcaaggcttagcggaagaggcgtgacccaggcgtaccgcaggggcgtggcccgaacgagctgactttagcccttacgtgaaaggcgtggcgtagtcgcaagggtgtaaaaaagaaattcgaattcgcgggacggtcggcctcaggcggagtagggacgtgagcccaagggagggaggtggggtaggcagactagttgtgactggatgatcactgggcgaagggtggaaaagtggccacagatggaaaggcgggctgcggagtagtgaccggcaagggaggtggcgcgaaaagggaagtagggacatgacgtagttggaacgcagagacgtgcctcgaacgtggggggcgcggtccttacgtgtgggcgtgccttgttgctctgaggggcgtaacaaagatggtggagcaggcggagggcagaggcgtcggcaagttagcgtgcaggcgcgtggcagcgacaggagatgtgtagccagagcgcagagcaggtgtggactccggcgctggggaagcgtggccagggcgagatttcagcctgggtcggggacagaatggggactgataggggcgtaacctggaatgacgaaatgacgtttgctgcgtagggacgtggctaaacgtgagggggcgtggccaagatggccgcgtgcgggatcctcgggtaccgggagcgaacgaggaggttctggctcaggtaagtcgttcgggtaagggcgggcggcagtaaggagcgtgggcagcagcagggcgtggtctgcttgagagggcaggaactgtgccacttgccgcaaacatgaccgcgtgccgctatcggccctggagccagagaagcttttggtgcggcgaggttggccggggccctggcggggcttctctgaggaatgggagtgggaggctggcggcggggaaatagccacttccccactctagccctctttctccgctatggggatcaccagacatccttttaggattctgtctattaaaaagtagaacagctttcccagagacattgcgggatgagaggagtgtccagaaaccaaggagcagcaagctgggactccctcgggtctgcattgttgatattcccacctgactatgctaggggctatggacagacacagccaccccagagtagatcaaaagcacagttgtgtcccttggacaaatctgagtttttctgttgtgccttgccccagagccggaggagaggaacctccaaaatgcagacattcttggtggctgggattctgtgtgatattcagcgttaaatgctgctgctctgaggctgctggaaacgcgttagtattaatatctgtgtacttctctcacatttacttttgctggaaaagcttgggaaatgacttaacgaagatgcgtaaaccttaatttgtttatatgctccttattagccactgaataccacattgctttctgcttccccttcttctttactgataatctgaccatttccactatgcactttgaaagtcttgctggagtatggagaatagtcagaaatctctggtaagatgctgccccgcgcatctctcagaggagtcactattcatagcctgcatcagagttcacaatgaaccaaagttcaccccacctcccctgtcttcagggacttagtgaaaagctgcactgttcttgaatattttggaaatgaaaaactttctgggctattttaaatcagtacctgggctggaattaaccgaaaggcgaaacagcaagggcaccattctctgtgcctatacgtagctgccctgtgcttggaaccaagcaaaaaggctgccactgctcacagttgcaatggaataaaggttgagtgccttgtgattgcatatgaatattaaggaaatctgatggaaagagggaaattcatcatgtcactggccacactggggcagttagttgcaacacacaaatcaggtataatatattttgaaacctttggcaacctcagattgggatcacactctcaaggaagaagtgagtgagaggaggaagctaagctttcttaagacatagcagcgtaatctctaatttaagtttcaggaaattgcaaaaggcaggcttccttttgaaatcaggagttgagaaaatgaagagtcaatctgatgccaatcaaggaatttttcaatataattgtaaccttttgttagtacttttcctgtctctttcgcataagttgcttaatcaggcagagttcaagctatgaggcatttaataaatacattacttatgaatgacatttaaagacttttagaatcttttcttttttcacacatttctaaggctgcaaaacaacagaaaaagaacatgttagtaatatccaaggcatacatgaataatcagtgacagcaaaggatgtgtagcacagaaggcttagctctcctaggcggtatccagccacacactggtaattgttgaaatggagtattggatatatagatgatttattctcaccatttttttgtacaagtttgaagtttgccctaataaggggaaaacagattctaaattcagttgacccatggactattgctgtttaaacctgctaagtgaattcagatagtgaagttatttaaaaaccagatgctcttacctggctgcaggaactatcaagataagatattgaaagcttattggcagtctgtcttttaaatcctgagccagacttttttacatggcttcaacaaggtgatttttcatctccttagacattttgacatacacactcccactaaaaactgtatttacacaaacacagataaaactaaacaaaagtgattttaactttggtttgagaattgtcagcaccttttaggcaacgcagacatactttaggtgtcactggctgttacgagttcaattgcaccctcccatctcaaactcatatacgtttaagtcttaagccccagtacctcagaatgtgacctcatatggagattgggtctgtataaaggtaattatggtcattagggtgaccactagtccaatataactggtgtccttaattaaaagggaaatttggacacagacaagatgagaatggcttacgaaaattggatttaatgctgacacaagccaaggaattaccagaagcaaggtttattaggtgttctccagagaaacaaaaccaattgtgtgtgtgtatgtgtatatatgtgtgtgtgtatgtatgtatgtgtgggtgtgcctgtgtgtgtgcttgtgcgtgtgtgtgtgtgtgtgtgtttagagagagatttatttttaaaaattggctcgtgaatgtaggctcgtgaaatttgcagtgcaggccagcagactggagaccagggaagaattgatattacagcctgtcttactcagttttgtgctgtaacagaatacctgacactggataatttataatgaacagaaatttatgtggctcatgattctggaggctgggaagtccaagggcatggtgccagcatctgctcagcatctagtgagggctctctcttgcatcatcccatagcacaaggcagaagggcaagaacatgtgcatgtgaggggtgggagtggttgggggtgaagaaggagggagggagggaagggaaagaagccaaatttatccttatatcaggaacccactacctcagaaactaaccagctccccctaataatggcattaatccattcatgaggggagggccctcatgatttaatcacctcccaacacttttgcgttgcagattaagtttccaaaacgtgaactttggggacacattcagactggattgtgagcacaaactggtgccatggcacagctccagtccaaaggcagtctggaggtagaatttcctcttcctcaggggacctgtctttttcaacttaaggctttcgacggattgggtagggcccacccacatgaagggtaataatctttattccaagtctactgatttaaatgttaatcttatctaaaaaatacattcacagtgacatttaaactggtatttgaccaaacatctgggtaccatgacctacccaagttggcacataaaattaaccatccaagtagaaaggcctggaacagagcgctcattgccctcagaaggaaccaaccctgcagagaacttggacctcagatttctaacctccagaaccatgagacaacaaaaatttttaagccaaccagtctatggtactttcttacgagctaatacattggcctaaagacctccggtagggagtcaagcctagaggtaaggaacctccacaggattcactaacttcctaccagtcccctttaatgtaatggctgcacatctctggctccctgagttcagcgcacattagcaaagtgatgcatatgcaaagcaaagcgcatggcactgtgccaaaagactggcttctcatcctgctgtgctttatttcacaatgcacatagagatgattctcgctcctttcacgtaggtgtagtcttctctctagcttagatggagcaggatcaaggacagcagtacagaggagaagagctagttcacagccaattactagcatgaatgtgcacaaagagaggggaggatgaaagcacgtttgcctcctttctcagcatcactgaggaccatgatgtgggttttatatcttacattcttcttggaaagatggtgtaaagaaataaagttcagatttgtaagggaaatgtgtctttagtgcccctcaacttctacatttgtgccttttgccacccattcccacctaccccaacccccaccactaccccaccatggccatactgctgagagcccctcttttggcaagagaaggcagaatctgaggtggcaaaaaacaccctgctgcaaactggtttgctctgtgtttctcttacccatactatgtgcatttcaggaggctcctaagggagaaattacatacctggaaggtacagttcaagtcttggtcatctttgcatcatagcacccaccactgtgcttggagcaaaagaaatgacaatacattttgaaatgaaagtgctaactggcagaatcccagccctgtgagactagatgaggttcatactcagggagggtcctctttttagatcaggcaggatttggggggtcctttggatcttttagataggggtatgagaccctcctctcaaaggagaaatatttaaaagtgttttaaaagtatagacatccctacaaatgggtgatgacgtttgagaaaaggaaagacccctagtactgtctcagagcatgctggcagtcatggcacagttcttagttcttgaaatgcggaccaacatctttgtcaccaagggagcctactcgggtcagttggctagtactcccagcacccattttgaatgaggcactgtgtccctaagagatgcagctctgaccaaggcagacacggtccctaccaccatggggcttagatactggagaggatgcagtcataaagtacattcctggtgaggtattaattcgactgtgataagcactgtgaccacaaagcagttctgggctgacctggtgagcttgtggtcgggggagcttagaggaagtgacgctggtgtcagtcacctgaagtgggggtagggattcaccagtcacagatggagggagagtccaggaaaggaagggcatctgcacaggccagagggaaaggcaggagttggaagaactaaagtccatgtggctggtgggcgggcagaagcgcaaagtgaatgtgagtgaaagcaagtgggtctgtcatcttggggtgaccaatgagtttgaggaacaagagtggataattgactcccatttgccctccccttcacctcagggtgcgtattacgagtctgaatattgtcctacttagaggttttctcatgatcttaagtctctattgtttacagctttcacttctctgccctcttccctctaggttattgggttcctgcaagttatctgggaactgatcaaagtttcagggtaagatggtggtgatgaacaccctgagggtcactcgtcctgtgtccccatgcaaattgctgtggagaagcttccagattccaaggcccaggccattctgcagcctctgtacttgtacttacaaaatccagaaataagcctgagagtacaccatttcattaaagagaggagaaaaggcttgttggttttataaaaatcacgcgtgttaagcgtttgtagctgtgatgtcatgggcattccagtgtgagattatatgccttatggactgtgagaataactgtttctctatttgtccagtaaaataaatgtggaacattctttcttgacaaatgttaaaatgttaaaatgatgtcatgcagaaactggagaaggtttcagatattctggaacctgttctttattatttctggttagcagttgtctttttactaaggttgatccacaaactgcagattatttctgtgaatcttaaattgctggaagctgcacatgaatgtttgcaagcagttcagtggcttcatgcttcagaatattctgtccagagttaagaattgcagaattaattctagctgactgatttgcaagtgtgtactctgctgtaaacacagaagatcatgtgacacagcaaatgttcttcctcaagcctttctcatctcgttcccctcctggaaatacaaggtactatctgcagctggatgttgcagggattctccactgtggcacgatggacattggggatggatcattctgtggcgtgggggctgccctttgctcactggatgttgagtggcatctctgatctcttgccagtagcactccccaaatgatcacattcagatacgtttcaagacattgctaaatgtcctctgggagggagggcaaaataaccctgggagagaaccgctgagatgataggagagatgtctgtgatggtggagagttgtgtttaatgaattggctaaatatatcttttgggtttttttaatatattttccactattcacaatgaatttacatagttttcaaatactggcttgtttcaggatttgaggtttctcagattgtgctcttcgggtttaccctttttgaacctccacgcacataagaaaaggaattccgttaataatgttgatttagctggatccattgccttgaaagtgcttcagaagaattttttattacaagtttattttgttttatcccaacattgactatgttctcattgaaatgagttggtcggggtcataacaaatttatgattgctgggtgtgcccatatcctacccagactggcttattccgaaccctgggactgcattctaaggcttaacgtggaaaaaatttagtcatatttatctagttactaacgttttgtgtgagtgtggggtttttgccttgatatttagtttgtctttatttgcagaaagttgaaagttaaatgcctaaagtccaatcagtctatgccattaggataacttgctgcttttagtgccaacagaaaccaaatagtggtcccccgaggagatggggttcacttgactaatagctatattatatgatgtgttcttgtttctaagttactagaaaaacacaggtggaagtcaacatttgattttgtttgtggtatgtttcactgttccaacctgttttccccaaggagaatattgtggtctttcttgccctgggcctttgagcaggtcctattcctatattctggaccctcatctgctcaattgtaaacacagttctcattgtttctgacagctcagtaccccagcagaaggctagtgtacgcttgtaaccaagaataaccccagattcttgagggttagaagctcagttatgaggccgggcacggtggctcatcccagcacttttgggagaccgaggaaggcggatcacctgaggtcaggagttcaagaccagcctgaccaacatagtgaaacctcgtctctactaaaaatacaaaaattagccaggcgtcgtggtgcatgcctgtagtctcagctactcaggaggctgaggcaggagaatcacttgaacctgggaggcggaggttgcagtgaaccaggatctgtactctgtctcaaacaaaaaaaaaaaaaaagaaagttgtggcagctacttctagtactttgttatcatcatcgtaggctcagtgcctgcctcagatgtttaagtctgaacattttaagaggaggcaaagcagaataaggagtgaatgaaagtaggaggttgtggcaaattcggtaagcagcatttcaggtcagcccagtgctctgtgctcatcatatctttgctcccaaggctctccacagataatctttagctgtcaactcagattgctgtttgctgttatctcaagtagcagacagtaactgttgatagtcctaactttagggacttgtaatataacaagataaaaataaaagcctacacctgttatccaagatgaaaataaaatcagtttcacttagcgtatcatctagtgaaatttagcgtgatgatcgcataaaaagatttaggtggccgggcatgatggctcacgcctgtaaccccagccctttgggaggccatgaggggcggatcacgaggtcaggagaacgagaccatcctggccaacatggtgaaaccccgtctctactaaaatacaaaaaattagccaggcatggtggcacacacctgtggtcccagttacacgggaggctgtgaggcaggggaatcgcttgaacccgggagtcggaggttgcagtgacccgagatcgtgccactgctctccaacctgggtgacagagcaggactctgtctccaaaaaaaaaaaagatttaggcatgagatcttaggccataggaaaattaatttaataatgttaattcttaatgaaatataaagagtatcagctataatgtaaatagtacaaatttaatattattccagtgattcttaatgttcatgatctccctgcttttagaaagaaaagaaacatttccttttaggataacttggactagaatggcgctgtctaaaatgtagccacaattaaatgtagccactgtgggtatttacctgtaaatttaagcacattaacattttatagcctcatgtgcctacaacttaccatactggacattttcatctttagagaaagttgtatttgacagcactgatttatattataactcaactgtgttataaagttctattatttttccaattaattttgaagaaccaaagcctggagaacaatacttgttttttggtttttgttttttttttaacttttattttaagttcaggggtatgtgtgcaggtttgttgtataggtaaacttgtcatgggggttttgtacagatgaggacaagagttttaacaggcttgttttgcaatgtcttcctaaagacctctgatataggctgggatgcctcagactgtactgtctccattaactttcaaataatcttgagaaacagtgggaggattaggagtcccatggaattgcactaatggcttcagggttgtcttcagctacctgggactgacgattagccctggaactgaccgccaagaaatgtgggcttttagtctcctgtgctgataactgcatgtgtattctatggctaatggactcagcatccaagtgccttttagagccctgatgctctaacaaggcaatttgtgatcctgcgattatcctcagccaagtcatacagagggtccctgtgtatacacccatcactgcactaaggccaaggcctacacagatggtcttcagtaacatgaggaaacagcacatccctcgtaaaaagggtggtacatagcaagggaccagataaaaagcacatgagggtatagggcaacattgtcctatagacatataattgagccacatatgtaattctcagttttctaatagtcacattagaaaaggggaaaagaaaacaggtgaaattaattttagtaacattttatttaacccagtatatccaggatattatcactttaacatgtgatccatataacagttattaccgagtttacattgtttaccttgcaccaagtcttcaaagcctgttgggtgttttacatttacagcaccactcatttaggattgaccacgggggcagcatggaaacaccagcgtttggaaagaatgaggagaatggttagataagtgaggagggttctactagaaaaacacaggcacttggacacagaagtttccacttgatgtactgtctttagcacaggagcaccctgacaaagccggtaatttgggaaaactgagtggctgaactcagggggtaaagggaagtgagaaaagaggacaaatgaccaagaggctttgtgtgaagtccatggcgtagagttcagaactaggctagtggtctgggcaaggcgaggaagagctaaacctgaacgattgttaaagaaaaataatgtgatcagtgggggtaatgggaaataaagcaaaaagaagcaaacttcttcggtgatatacttcatctgattcatttgatccaccgtagttgttgaaagccagcttgcttgcagagcagtgggggaggccgataactaagtgcgtgtgcatataattataactatacccatgtaataatgttgtgaaggacaaaaccagaatgctgtgattaaaaattcaaggggatcatgttataggagggtagtcaaagaggagaggaggtgacaattaaggcaataacaggagccagtgccaagtggaatgaggggaatgattccagcagaggagaagaatcaggaaccgaggggcttgaggcagaaatgagctttctacatttgaagagcccagggacatacaaggaggctagagaaataggtggtgcaagcataaaataaatcaaacgcaggactaggcatataaataagaattaagaccaagtgcatcctcaccatgaaatctaaaggagttttcttgctcatcagtgacagattattgacacctttttaatgacagtgtgcccttcactcatttaaactgtgattgaaatagtcacaatctcttcactttctacatataagaaaaacctgaaaatgaagcctctcagaatgcttcgtggtcaccttcctgttttgagggaaagtatgagaactgccaagaaatcatttctatctgtattttgttaaaatggtagaaggggagggaagaggaaaagaaaagtgtgaatttatcattagcaaaacaagcccttggcaaaaagttggcttcaatagggggataatgaccaaggaccacctctccccacagtgggttggatggtctagcctagatggtctttgtttaaaaaggaggaggtgggtaggaggaaagaaaccttctggaagctgaacttgtaaactcaagggcataaactgatcgtgtcattatggtcattaaagagcaattgaaggaacaggctcagttttcttgggctggtatttgcatgagtctgagtgttgatacttcccatttcatgaatgagatggggaacaattaaggatgaccaaggcatcgtcttagggagctgatcgtcactccagttcttccctagtcttcatggtagaccctgattgaatggctttgaagaatgtgaattctcacattatcaaccacagtctgagtgtctgaggggaaggtgcgtagtctctttgtgtcaggaatcttttaaaatataatcagggcctttcaagggctttctagaaggaatctgcattccaatcagatttatagtattgaaatattgtgccagttcaaatgcatttttaatttttggctcctaaatttaacagaaaattattgttctttttctgttgtattttttctgttttctgttgtaaatctattataaggaattctttcatactaagaaaaatgaaaacattgggttcaacctgttgggtattatgctcactggctggggtgataggactgttgggaccccaagcctcagtgtcactccatataccaaacctgcatgtgtaccctttatagttaaagttgaaattaattttttaaattaggtttaaatctctttagagataagagaatactatgttataggaagaaataggaaaaaaaaagaagaatattctgagtttctgcagactgagattctcacctgggccactattgacatttggggctggataacgctttgcactggtggcttcctcctgtgcttcgtagaatatttagcagcatccctggcatctatccactagatggcagtagcaccctcttccagttgtgacaatgaaaaatgtctctagatattaccaaatgtcctctggggccgtagtcactctccttgttgagaccactggtctggatgctcccaagagagctcagtgtctatactgccaggacacttttgcctaccaccacacaaaaataaagccaaggctaagattttaaacttccatctttgggctgctactgaagcaggagaactgtcgcccctgtaagagtaaaccagaagcaagtttctggtttttatggaaacaagaggatgtccctgccatattcgggggatttgactgggtgggagctgcctagttatttctcaaatccttcgacccattcttagtggtggggcaagatgcagagggtcattggtaatgatttctctcaattcatgtttctcctagttttcctattgtccttgattctacccatccatggtacttctaaaggacagggaaatggaccaccccaaactgatatacattggttctgctcatcacacatggggatctcaacaggccaatctgtgttaccagcaagtctactgatacttaccagggacttgctacagagacctggtgcttgactctggaagaaaatcagcatcagcaatgtcttcagtgcctatggaggatgaattgtatgtgtacaccttaatagataatctccacatccctgtgacacactgcaacctccagggaccttagcaatgccgatgttctacccaggttttgcaggatggctgcctggtcctcagagtttgcttacataggaggtgaactcaactcagcacgcacagttatgtggggcgagcatcttatgggatgcaggctacacaagtctttttttctaccagccaaccagttaaacactgacaatacttgattgaacatttcctttctcaaagttcttccatttctttcttttttttttaaatgagtctgttattgaaaatcgaattagtttgtctttgtatttagagctagtttgggggcttggggcttgggaaattctcaaagaagaaaagaaactcatttatgaatacctatttccacatggcgctaatctccatgcattttactgttatcacaggactgattgcacttggtttaggtgagcttagtaggcagactgagacgagttgggttttcaagatggcagaatgctgtttttctgcacagtgctttctgacttgtctttagcctttgctttagtcagctgcttaaggccctgaatggctaattgctaaagctcttagttcccattagccttgacagggtctccagaagtggaattgcctcatgtgtgatgctagatagtagacagtcttgataatagcctgacctgctttctcctagtgcatccactctgggagagcgtggacctggttcctgggggcgatcgccagtcacccatcaacattcggtggagggacagtgtttatgatcccggcttaaaaccactgaccatctcttatgacccagccacctgcctccacgtctggaataatgggtactctttcctcgtggaatttgaagattctacagataaatcaggtgagggcaagatctggtggtcttgtaaggagttaaagaaacagtgtcatgttaacagaggacacatcaaactctctccatgatagtattgacctctttgtgagcaatggcatggaactcattggaatttaaaaaaaaattgtggtgaaatacacataatatgaaatttatcatcttaaccatttttaagaatacagtcaagtagtattatattaagtacatttccattagtgtacaatcatcaccaccatctatctccagaaatcctttcatcttgcaaaactgaaactttacccattaaacagtagcaccccattcaccctccctccagcttctcgcagtcagtatttggcttgcttgcttgcttgcttttcttttcttttttttggaaacagattcttgctctgtcacccaggctggagtacagtggggcagtcttggctcactgcaacctctgcctcccaggttcaagcaattctcctgcctcagcctcccgagtacctgggattacaggtgcccgtcaccacgcccagctaacttttgtatttttagtagagagggggttttaccatgttggccaggctggtctcgaactcctgacctcaagtgatctgcccgccttggtctcccaaagtgctgggattacaggcatgagccaccatacccagccagtattctgctttctgtctctgtgaatcggactactctaggcacctcatatgagtggaatcatacagtatttgtctttttgtgactggcttatttcagttggtataatgtcctcagagttcatcgatgttgtagtatgtgtcagaatttccttcccttttaaggcttaatgatactccattatatggatagaccacatttgtttatctattccttaccttttggcttttgtgagtaatgctgctatgaacatgggtgtacaaatatctctttttgactcagttttccgttcttttgggtatatgccctgaatgggctttctggatgatcactggactcacttttcagtgtatggaaaaattcccttctcttttatatggatgtttccttctactagtataggtaatattttctattaacaaatacatatatctgtatgtacagattttgtaattgatatagaagaaagggcatgaaatgaaatgaaagatttgccagaaatctattttctgtgtgtgtatgtgttgaatatgtactagttttccttggctggcttactttgcagataacttctatattaaatagtaattatgtttaattacattttaaaatgtaagattgcaatacagagcagaaggataattaggcaagaaaaacacattttatatttggggtcacctgataacgtgtatgtattttatcatttatatatttatgtttgtaacattttctgagtggcaactatgtgcaaggcactgcacaaagtaccaggagtactaattctcaaccacccaaagggcaaagtctagtgagggaagaatactcgaaattaaaattataaagcaagtgtgatttgaaaaatgtttctgaaagtgctatgggaccacagaggaaggcatgtgatacagaccactcagaggagtctatgatgatttcactaaggaggagccatttatattaggtattaaaggatgtatggaagtttgccaagaggattagaagggcattctagactgagggaaaatcgtgcaaaggcagatttgatagaatgttcaggaaatgaccaaaaaacaaaatgatgtgaccagaatgttgaatgtgtgttgtggggagaggcagtgagagtggtgatcatcaaagcataatagggtagatggagggcaggctcatcagaaactagttatttgtaaacaagagagtggcatagcttgatttcgtttaattagcagtttatgtttttagattaacccaggcaacaatgcagggccacaagttgcgattaatccaagtgatagatggtgagagattaaatgaaggcaatagaaatatagaaaatgagcaacttttaaaaagcatttctgaaataaaagcaacaggactaggaggtgagatcctcttccagagaacagaaagcaaagttaaccaagaccttgaggtgtctcacttaggagacttgggggaatggtgatgccagaaaataagttcatgagtggtggacaaggaatgatttgtagagaagttatcttaatccatttgtgttgctgcaaaggaatatctgaaactgtgtaatttataaagaaaagaggtttacttggctcatggtgctacaggctgtacaagaaacatggtgctcacatctgcatctggtgagggcctcaaactgtttcccctcatgttggaaggccaaggggagccaacgtgcagagatcacatggtaagagggagaggaggaggtaccaggctcttttcaacaatcagttctgtggctgaatgtgatggctcacacctgtaatcccagcactttgggaggccaatgcgggaggatggcttgaggtcaggaattggagaccagcctgggcaatatagtgagaccttgtctatacaaaaaaaaattttaattaaaaaaaaaaacaattggccaggtatggtggcccatgcctgtagtcccagctacttgggaggctgaggtgggagtgtcacttgagcctagcaggtcaaggctgcagtgagtcacagttgtgccaccgtactccagcctgcgtgacagagtgagaccctgtctcaaaaaaaaaaaaacccaaatcagttctcttgggaactaagagtaagaactcacttccacccgaatggcaccaagctatttataagggatctgcccgcgtgatccaaacacctcccatgaagccccacctccaacattggggagcaggtgtcaacatgagacctggcaggaccaaacagaccatatccaaaccatagcaaaagtatagggaaatcataaggaaatataattgcttcttacagcttttttgtaatttaggttttgtttgtttggtttattggttttgtttttttttttaataggctctcactgtgtcacccacgctggtgtgcagtggtgcagtcatagctcactgcagccttgaacttctgagcccaagtgatccttccgcctcagcttcccaagtagcagggactacacgattatgtaccaccacgccaaactcatttttaaattttttgtagagatgagatctcactgtgttgccgaggctgggcttgaactcctggcttcaggtgatgctcttgccccagcctcccaaagtgctgatgtgagccatcgcacctggcagcaatttagttttaaatgttgtatcaacaataaaaagaacattttaaatggtcatctctcaaagaagaaatgtgtcttcaactcttttttttcttttttttttttctttgagacggagtctttctctgtcacctaagtggcgtacggtggcgcgatcttggctcacttcaacctccgcctcccgggttcaagcgatccttccacctcagcctcctgagaagctggggttacaggcatccaccaccacacctgctaatttttgtatttttttttagtagagacggggtttcaccatgttggccgggctgatctcaatctcttgacctcaaatgatccacccaccttggcctcccaaagtcttggcattacagatgtgagccaccacacccggccagtcttcaactcttgtctaattcctataaggagaacttacttttctcaatataaacattttctctcctttaaatgtaaatggattttggatgttagtatttcatgcaaagcagaatgggaacgagcaaatgttgatcccttactgaaatgcgactcagtttgctatatgtattttattttatttttctccccgagtccttttattccaaagaaatattaattgctgtccttgcctaaatttcttcctgatctttgtttctatctcattttggattgtcatatggttttcttggtggctttactttgggtgaggaaacatgtttaaatgtcataggttgactgaggctgtgggtttattctggagagattctgtatagtcacgtgttaaccctcttttcatggtgtttcagctgcacttagtgcattggaacgcagtcaaatttgaaaactttgaggatgcagcactggaagaaaatggtttggctgtgataggagtatttttaaaggtaaaaaatctcaccaactttaaatgacgtgttgtattctaggatgaaaagatagaacagtataatattgttatttactttaagaatattgggatccctacactggtaagataaatagtgattgttaaggatatattttaaatggcatgaaaccgtgccatccaatagagtggtcacaagccacacgtgacagttgggcacttgaaatgtggctggtgtaacttaggaaatgaagatttaatttacttctaattcacttaaatttcaattaaaaaactgatattcaattcagttattgaaaaacttttgggttgggcgtggtggctcacgcctgtaatcccagccctttgggaggccgaggcaggcagatcacttaaggccaggagttcgaagccagcctggccaacatggcgaaaccctgtctctactaaaaatacaaaaattggccgggcgtgaaggcaggcgcctgtaatcccagcttcttgggaagctgaggcacaagaattgcttgagcccacgaggcagaggttgtagtaagccaggatcgtgccactgcactccagcctgggcgacagaacgagactgtctcaaaaaaaaaaaaaaaaaaaaaagaaaaacttttaagaatgtttggaaccatttggatatgtatatatatgttttcaagtataaattttttgaaatctaaatatagatcaagtatttttgatgaaaaaggtagcatccaaattgagatgtgctgaagtgtaaaatacacaacagatttttaaaacttagtatggaaaaaatataaaccatctcattaataacttttcgtattgattacattttgaagtgataatatattgaatatatttggtaaaataaaatattaaaaaggatttcatctatttttactttttaaatgtggtcactagaaaattaattacctctgtggcttgtatcatacttctgtttttaagcattggtataaaaggataaaggcgaataaataaataatagttaaaatgtaagattaatgtattttaggccaggtgcgatggctcacacctgttgtcccagcactttggggaggccgaggcgggcggattacttgagtccacgagttcgagaccagcctggccaacatggtgaaaccccgtctctactgaaaatataaaaattagctgggtgtggtggcgggcacctgtagccccagctactcgggaggctgaggcaagaggatcacttgaacccgggaggcaggagctgcagtgagctgagatcgcgccactgcactccagcctgggtgacagagtgagactctgtctcaaaaaatttaaaaaaaaagaatacattttaaacggaagaatgtattttaagcagaatagaaagataaaggcaaataactaggaaatcttgaagggaactaatattcatgagtgctaagtgactccatatttgccaagtgcttagtttatctttctaagaattcggcaatattattgtctccatttttcagatgaagaaagtgaagctcagcgaggttaagtgctttcttgctaggtcacacagctagctaacggaggactggggttaaaaatccataggccacactctcatggggcccctgagctcttgcaggttcagcagctacaggcttcctgcatgcttccaactttagtctgcactagaggctgagcgttttaagggtacctgggatttgttttagtcgggtacagtaagacatgcagacatgggaatgactgtcatgaaggaagaagttgatcctgtttccagatccctagaagctggaggcatggcacactgtgcagagccacatgaggaagcaccagggttggtcaagaggcagagaatgtgaggggaaaatgcgggcaagagcttttattgtggtttcagtgggaaggaacaggcgaggcagggtaagcaggcttgggattggctagtttgaataatttcagagtgttctggggcctagggggctgtccccacttggctgatacctgaccgtggagtgattggtgcaggagaacagtggccccagtctaagagcctgataaaggagatggtggggctgtaagctctggattgcatatgaaaggtgctcttgcagttgtctgttctctctgggaattagccagccttgggagggacagtgcttgtggtgtcaacaagtccccagatatcaaagcattaaatacaaaagctattaatagaaaacgtgctttatgtactgagtctcctggaacatgcccttgaggacttaggggcctgcgccgaaagcctggccttcatgtgctgtaacctgtttgaagagcttcagcctccagggtccctgtgggccaaggcttaggaaggcccggggaggtgagtggagcaggagcacctttccctgtggactgcaggcacaacgtcagacagcctgctcatgtgttctgtgtccagtttagttcggtgatgtttataacattctaaattgccagtttaagtggtttcagactgtgatttgcttttaggtaatcaccagatggtcatttttaattcatatttcattccaattctacagtgagatgtccgttgtttttaatgttttctcatttgttgttctttagctaggcaaacatcataaagagctatagaaattggtggattccatgccatcaactaagtgtggggtagtatttttcctaaattgcctgaaatatattttgtgtttcaatctcaagagtggagacattaccaaggcactttgaattgggaagtttaagtaggtgaactgtattccagttctctttcaacactgccttagaaggagacctgtaatttatgaatgaccctggccctgggtcacattgcaggggacagaagtgatcatgtgggtgggccagtgagctttctggttttgctgcagtgccgctgaggacttggggactcaggaacatattgctgtcccctcctctgttcctgacaccggctccttctaagtccttgtgaacacacccagagcagccttctgttctgtagctgccatcccacaggcagggagcagagcgcagttctacagaaacttgccttgtccagctggaaagaacaatgacccacatccttcaggttggatgcctttgtccagccccccaagattatttcttctatattcagaatctcaaagggctgtgctctggaggcccatatattgtctccttctccctttcatcccccactgtatccttctggtccccacctctttccccctgctttcctctccatttccctcttttttcctctctccccttttagtccaggtttctggctcctcctgatctgcatttcattttttgtttgtttctatcaacttttattttagatacagggggtaccatgtgcaagtttgttacataagtatgttgcatgatggtgaggtttggggtacagattccatcactcaggtaatgagcacagtaccaaatgggtagttttttaaccctctcccccctccagtaacccccagtgtctattgttcccatctttatatctgtgtgctcaatgtttagttctctcaagaacatgcagcatttggttttctgttcctgcattaattcgcttaggatgatggcttccagctgcatccatgttgctgcaaaggacattatttcattttttatggctgtgtagtattccatagtgtatatattacattttctttatccagtccgccgctgatgggcacctaggttgattctgtgtctttgctattgtgaatagtgtgacagtgaacatatgagtgcatgtgtctttttggcaaaatgatttattttcctttgggtttatatccagtaatggtattgctgcattaaatggtagctctgtttttagttatttgagaaatctacaaactactttccatagtggctgaactaatttacattcccaccaacagtgtatatgcattccctttttgccacagcctcaccaacatctgttgttttttgactttttaataatagccattctgactgttttaagatggtatctcgttgcggttttgatttgtacttttctgatgattactgatgatgagcatttttcatgtttgttggctacttgtatgtcctgagaaatgtctgttcatgtcctttgtcccttttttaatggggttgtttttctgcattgcattttaaaaggaaaattctcagtctcccttgaagaagtgaagcctccttctttatgcactggccactgtctaatacctcccagcaatactcagaggagactacctgctggaacctcactagaattgagagatcaaatggttttggctgttttcccactggagaatataaaaaatacacagttaattttagaaacaaaggctgggcatgattccatcctaagcagcaattcttcaggtagctgcccagaagggcctggagctcctctggaccactgctgatctccagatactccctgagaaccgtcacctcggcgtccaattcctgagtggttttcactactaaataatgactcagtgacccagtctcttggccaggacgctgttatggaatttgggtcgtttggcacttcctgcctggtgcccacctgtctagattactggacccaagtaggtccagtatctccctggtccagccctgtcttgagtccatcacctttatcattaagaagcagccagtagaggttgatgatgatcaggtacgttctctccacaattttcatctaaggaaatcctcgtctccccttttaaaacaaggctgggctcagactgtggcatcagttttaacatcttgtaatgcttatacatttttattgaagtgtaccaacgtcttatctcagtttggacatgaatttagagatatttcaaattagctagagagaagagttaaaacatagaagaacataagctttttacatctatatttgacagtgacatatgtttttattatacatgcattgtgtagattctctatgaaaattaagacccttttaaataaaaaaacgaaggctggaaatgggtgtattcaaaaccctttaaaatccttaagggagttttgctatagaatctcaggataaagacagactccgacaatattcatccagaaattttcatgtaagtcagttgtttgaaacttgggatttatttttctcttagaaactaagtctaagtggtggttactacatcagcacacaaaatcctgtttaattcataaactaaactgtaataataactgcgtttacttgttcatattggatttttattgactaaaagcttccagcctctttttcatgcagccaggataacagtgataccaaaacctatcaaagattagaccatcctacccccaaaatataacaataggccaatatctctaaaaaatatgtaacaacagaaaaaaaagctaaataaaatagtagaaatagaatctagcagtgcattagaagaaatatatactttgtccaggtagggtttattccagtaatccacagatggttcagtactaagaatgatatacttacaattaatggatttcatcccatcaacaaatctatatgatcatttccatggatttcctaaaatacgttagacaaaacccaccatccctttaaaaatttttttaataaaacagaaatgaagaattccctaactggatgaagtagatttatctcagctcaaaaataaatagtatgtttaatgtggaaaggatatcattaactccatggttattagcatactaaatattaaatttaattgaattaacctctggcaggagccaataaagttaggccaaaaaacataaagaacattagagaaacactaaaaactcctacaaagataattcagcaattagtggagtaccatgtcaatttatagaaatcaattccgttggcatatataactcacagttagttaaaagacataacagaagaaggaaacctacttataatagaaactaaaataatgttaataaacaacataaaatgttaagaaagctataaaacatttctgagggacacagaagacttgactttataaaattcataccctgtttttacataggaagatattataaagacacctttgatgtcagttctccttaagttgattccataaatttaatatggttttaataaaaataccaacagaattttaaaactagatatagtacttctagagttcatgtggaaaagcagataagcatgaatagctggaaaaattctaaaggaggaaaataaggaatgattagacccataaggctttaaagccacaataattaaatagtatgatactagcacatgaataggaagataaatcaaggaagaaaatagttcagaaatatgtccaaatacatgagaatttactttatggtaaagataggatctcagctcaatgcaggaaaagataaatccagtaaatggcattgggggacaactgagcaggcatttaggagaaaaagttggacccatcgttcaatcctgacaaaaatatattctggatggaacaaaactttaaaggtaaaaaaatgccatagaagtacgaggataagcataggaaaattctttcatacatccaagtggaggaagcttttctaactataaatcaaaacccagaagtaatcaagaaaacaactagcaattagactacatacaaaaattttaaaatcctttctgatgaaaatcaccgtaaacaaaagataaatgacaaacagggaaaacatttgcaactctgttccctcattcagctactatttattcaatgcctactatatgccagctactcttctaggtgtttgagacatcatagtgaacaaaacagagagttaattgccctaatatacaaagagtttctagaaatcagtttttagataatcaacagcaaatggtataaacagacagcttacagttaaggaaacaagaaacccaataccatgtgaaaaaattttcagccttgcttataaaaagtgacgaaacaagatgaaactacactgaaatacaaattttcacatatcagattagcagaaaccccaaaattgtattgctcacagtgctggtacaagtgtggagcatgggcagcctcatgtgttactggtaggtggtaatgacacatgaataaagatataataggctaaaaagtatgttgttttactaatagttaattacaatatcaaaggaagatacaatgctaagttggtactattgtagtagctatcagagtgcagtttaccaaacagcaatttatcctacacataaactgcagacctaaacaataatacatatacatagttattctttgcaccattgtttgcaaacaacctaaataccagtcacctctatggcattcctcctccaaaatttgtattccctcatctaaatcatgagaaaagacaaaaccaaactgaaaaaggacttctacaaaatacatcaccagccgtcttcaaaagcatcaaggtcatgaaaaacaaggcagaaaaactccagagtggaggagaccaaggaggagtaggttctggagaagacaaaggacacttgggcaatctaaagtctggagttcacttaacagtatcaacccaatgttaatttcttagtttgatgaatgcatcgtgattatataacattagaggaagctggatgaaaggtctcaacctcagcaccactgacattgagggcagatcattcttggttgtggagactgtcctgtgcattgcaggatgtttaattgcatccctggcctcgactcactgagtgcctatagtaccacctccccaggtcatgacaaccaaaaatgtctccagacattctccactgtcaattgcaaactcaccccttgttgaacaccactgatagacactaatccctaatatcaactaaccaatgaaatgctgtacctcttgttgtatgagaagaagaaacagacatcttctcaagtctatgagaatggcttttaactaatcaacaccttgattaaccagtagaaggcatatttagtgatgattcgcttatgactgcctgtacctcaccgggacaaaattgtggtttgttagagagtctttagccacaaacagaataacaaccactggcttatattgcaaaaaggatatgggaaattctatagatattggaaagaaaaatatattataagaagtctaggccgggtgcggtggctcattcctgtaaccgcagcactttgggaggctgaggcaggcggatcacctgatgtcaggagttcaagaccagcctggccaacatggtgaaaccccgtctctactaaaaatacaaaaaattagctgggcgtggtggtgggcgcctgtaatcccagctacttgggaggctgaggcaggagaattgcttgaacccgggaggcggaggttgcagtgggccaagatcacgccattgcactacagcctgggcaacaagagcgaaactccatctcaaaaaaaaaaaaaaaaaaaaagtctatacctactctgatgccattatcttgagatgtcttagatatgaataaaaagtcattccactcattatgagaactgtctttagaagaaaattatactgaattataccataggaatatctctaggttttgaaaatcatatacccagagatgattccataaataaggaatcaggcaaaaaaccaaaggaattcattggtgagaggagagtgttagggatctcattcccctgcaactactggctgaccccaaccctgcattgcaaaacacttggccccctctgacctcaaaaagcatttggtgcttcctcattaagctctatttattgtctttactattcacccatctgcctcagtctgggccaaatctattgcccaatcttcaattggttgcgacttttttgtctcttcccgattctggcattccagagggtcaataggttccttctccacgtgcttttgagggaaatgccccccccccaaaaaacttttcacaccaccttgaacagactctaaacttaggcactacagttactaagcagcctttggattctttgtttttgaagttagatcttttcagctattagtggaaaatgtgcctcactctactccaggattaccaatagaaatgaaaggacagaaatggcattagtgtttagagaagattatgtatatatggctgtatgaacactgaaaattatgagggtcaacataaaatcagcattacaggtactaaaacataaatcctgatggctttcaccgttttcttaagagcaaaattgcaaaaagtgatattaacagtcatcctagacgaatatgagcaaatgatttgtttttccttaaaagagcctccaagtgtattgtgatcattttcacactgatcaaagagagcacccttctgtcaacaggtatctgcagttttcaggacctggcagaaattcttctatgttctgcctttaaaggtcaggtacaaaagcagagacagctgccaggcccctctgcccagagctaagtgtctgggaccatgagtgggaaggactgaggcttgagcctccttggtcctccagacagcatggggcgccacttgccccttctgcagctgcgcgcggcaaagctgtggcctggccgtggcctcctgccccatgcaacagttggtggacagaccgtacctggcacacggcgccttgtgcactttccaacattttgatgctaaccgtcgctagtcactgagccctgacatttgatctctggccttgaccgcagatttcggaaacttctggcagcccagtgtctactggaaggcccaagccgcttgccagaaagctgcgccccgcccaaaagcactgggttctgcagtccaggcccttcctcagctcccaggtccaggagaactgcaaggtcacctacttccacaggaagcactgggtccgcatccggcccctccgcaccactcctcccagctgggactacacccgcatctgcatccagagagagatggtccccgcccgcatccgcgtcctgagagagatggtccccgaggcctggaggtgctttcccaacaggctgccgctgctgagcaacatcaggcctgatttctccaaggctcccctggcctacgtgaagcggtggctttggaccgcccgccacccccacagcctgtccgcagcctggtgaccgtgaaaatcgccccgccagagagcagaggaagcccgacgcccaggccatctgccttcaggtctgtgatgagaaacggagtggcctgttccgttgtgcccaggtctaggccgctgagcagagccctcactcccaggcagagttgtctgaatccttcctggcggccgcctgctgccctgacgcctcaggcttgcctgcacctggaaggagcttcgccaggtgggccatgagcctctgagcacacccagcctgctgcccggctccaagagtcaggcccctgccaccacctcctgagcctccagccctcagcaccttcaccctactgaccgcggttctacccccacaccagccaccggccccaccggggcacttcccactgctccagccgaccactcagcgagccccaggcccacctctcctctcccttaaagcccttcccttgcccttgcccattcgctcctgccttctccctggggacaggaggcatgcttctccccagtttccacaataaaatatttgttgttaataataataggtgtctttattatcatagagattgtcatattctttctttcaaagacgacaccatggtttctccagcttggcactactacttgggccagatggttctttcttggtggggggggggaggggggaggggaagggggagggaggagcgggaagctgtcttgtgcattgcagggccttagcaacatccctggcctctcacttctaggtgccagcagcacactcacagtcctatcaaaaatggctccaggcgttgccaaatactccctgggagggtagagaggtcaaaagtcatactggtggagaaccactgaggaacagtgacctctactggcagaaacaggcaagcctagtcccccaaaatgtgcggttttctaatacatatcaaagacgtagggacaaaccaaatgaagtggcgcatgctggacagaaaacattttcaccagttttctagaatgcttggggtgtgaatgattcctgtggtctggtcttactagcaatcaggaaatgcaaaattgttacaaatgagctactattttaaacgtttcaaattggcaacaatttaaaagttaaataataccaagggctggtaaagacgcatggaattggaatcccaggtgacgctgtggaagcaaggagtccagccactctggaatggcatttggaagtgattcccagaacagaaaacgcagctaccagaaaccctgtggcacacatacacagacactggtgaggatgttctttgcggcactcgtcaccatagcagagaattggaacaacccaaatgtttatcagtacgggactaaagtaaatatagtatatgctgtcgagggaatactgttccacagattaaaggaaagaagccaggagcagtggctcacgactgtaatcccagccctttgggaagctgaggcaggcaggtcactttgagtttagaagtttgagaccagcttggacaacatggcgaaatcctgtctccacaaaaaatacaaaaattagccgggtcttggtgttgcgcgcctgtagtcccagcttctcaggaggctgagataggagaattgcttgagtctcggcggcagaggttgcagtgagctgagatcacgccactgtactccagcctgggtggcagaacaagactcaaataaaaaaaaatataaaataaaaaaaaaacaggaaagaaatagcgcagggtttctcaacatcagtagaaccaggctagataactctgtgtgagaatactctgtgtattgtaggatgtttaagagcaaacctggcatctgtctaccagatacccttaggactaccagcagttgtgacaatcaaaaatggctccaggcctataatccccgcaatttgtgaggccaaggcaggtggatcacttgaggccaggacttggagaccagcctgggtaacatggtgaaaccctgtctctactaaaaatacaaaaattagccgggtgtggtggcacatgcctgtaatcccagctactcaagaggctgaggcacgaaaatcacttgaacccgggaggcggaggttgcagtcagctgaaattgtgccactgcactccagcctgggtgacagagtgagactccgtctcaagaaaaaaaacaacaaccaaacaaacaaaaacggctccaggagttgccaaatatcccctgaaggacaaagtcacccgctgatggcaaccactgagctaagagctactttttttttaaaaaaaggataaatctcaaaagtactttcaaatgaaaaagattggaagtattttgtgtagcacaatgccatttattcaaataatatattttattacataatatagtgcttataatttaattcatatttatattttatttatatacttatatagcaattgttcattatatatgaattaaaatattcataaaattgaggtattttgaaatcttaatatgtaatatattctatattaagtttaatataaagatttcatcatataaattatataaaaaatataagattatttctggcatgatagaggaggccagaaaccaggtaggaggtaatttggataccttacccatattgttatttttatctaaagcctctttaaatactgttcaaacatgaatcacatggtattcccctttagagagtcatagaatatagccataaactaaagcaaattcccttctcatggagcttgctgtctaaggggttggagacagacgataaacaagtaagtaaatgcatacactgcatgctggtggagggcaggaaggcaagtgctataaagaaaaatagggagggttgcattaaactctcaacccaactggggccccacatactctccttgtcccaattaccatggaatgacactcttactatgtatgcaagttcatcaaatatttcagtgttttctttggtggcaactcatactttaatagagtaccacacaaataaaatgaagatactttatctacttagaaataaagattcccataagatttaaattgttgctgaaaatattaaaccttacattttcaatggagacagttttggttacacacaaaaagtcctggactgaagctctaaaaatctagcttttagtctgaaattttccactcccccatctctgtgattgacaaggcattgcaatgtgaatgaggtacaagaaggggcttgggttctgtgtgcatcaatggtgacacttttggcattttgggtggggtactccttgttatgtaggactgtcctgagccttagacaacattaattatttgtctaaggctcaggacagtcccacataattaatccccaccctctaaataccatagcactctccagtcatggatatagctccaaaacaacccctcaacatttctggatgctgaggcaagaaagacttctaaatctttgacatttattttcacactccacttgcctgcttcttgccaaaaattttctaacaaccatctatagttattcagcaagggctggtaattattcattcatttatttgggcttcatattactttcttatttttttcatattactttcttcttgtgaattatttcacttttagaaattttattctttgtatagttttagagtttacacaataattagttctttgaaatgctgtcttgctcatttgacgtagctttttgtgggcgttaaccccaaagctgctttccacaagacacatctgagctgtcagttgtattaaaatataatagtgagtgtgtgataacacaagtccataaattgcttgacactcctccctccagaagtgaagcttaggtctcctcccctaagtataagggtttagagattcccttctgacagttacagtttggaaagggaaacttgacaggcaccacgtgatccaagggatcaaggtgaacttaacagtgatgtcatgtgcatatcagggaccctgacaccatatgctgagaagggcacttcacctcattttcttctccaataatcactgtgttctggctaaattatgagaaaacagcagataatatcccgttgagaacttttacaaaatacccagtcaaccctcttcagaagcaccaaggtcatgaaaaacaaggaaagactgagaaacacagagttgggaagactaaggagaaggagatctaatcgcctattgtaatggatgcatcctggttaggtataataatagcattaggggaactgggtgaaggggccagagcaggctttcacaacctcaacatttggggccacctcattgctgagggaaccatcctatgctttgtaggaagtttaccagcatccctggcctgcacatgccagcagtacatccctttcaccatagccccctacctggccaaatagtgaacccaacagtaagtacctctgtatagttccaaatgttctggggtggggaaagggcacaaattgccccaggttcagaaccgttgttacacaggaactctatctctgcaactattttttgaatctaaagttattttaaattatgacatatatatgtatatgtattgatatggtttggctttgtgtccccacccaaatctcatctcaaattgtaatccccatgtgtcaggggagagacctggggggaggtgattggatcaggggacagtttcccccatgctgttctcataatagtgagttctcatgagatctgatggttttttgtttgtttgtttgtttttggttattggtttatttggctggagtgccttggtgtgatcttggctcactgcaacttccgtctcccagtttcaagcaattcttctgccacagcctcccaagtatctgggactacaggtgcatgccaccatgtgtggctaatttttttatttttagtagagacagggtttcaccatgttggtcaggcttgtctcgaactcctgacctcaggtgttccaccctcctcggcctcccaaagtgctagggttacaggtgtaagccaaaatgcccagccagaccctatggttttaaaaggggctcttcccccttccctcgcctgccaccatgtaaaaacgtggctttgcctctctctcgccttccaccacaattgtaagtttcctgaggcttccccagccacgtggaactgtgagtcaattaaacctccttcctttgtaaaatacccagtttcaggtggctctttatagcagtgtgagaacggactaatgcatgtgtatatctataaattgatatatagatgtattttagcaagagctaagcagttattgaaaaagttgcctaggcactataaattaaactacagataatgacataaaccactggataaattacaagttctgattggcatcattgataatgacataacagctagaaatatactttgaaaatagtgagatatattcaaatgcaagatattggcacctgccaggtgcagtggctcatgcctgtaatcccaacactttgggaggctgaggcaggaggattgcttgagcccagcagcttgagacgagcctgggcaacacagtgagaccctatctctacaaaaaaaaatttttttaaactagctggatgtgatggcatgcacccatagtcccagctactcgggaggctgaggcaggaggattgctcaaatccaggaggttgaggctatagtgagccatgattgcaccactgcactccagcctgggtgacagaataagaccctgtctcaaaaaaaaatgttttaaagacgttggcacccatatgttgtaagaatagtcttagtaattattcaaaattttaaaaacttggcttttttctagatgtccaatgcactgtccattgcatgacagagccaaaacttagcttttttctacattcacatgtttcatatgtttgttattatgccatccactatactaatgccttaagtagcaccatttctgtcatttcttacaggattggcattaggaaaaaaggtgaatagttttacttgcttagggtctttaatggaagaatactaaacatccctcctacattatggtgctgccaagagtagtaaaatctcagattttaagaaaacaaaaaagttactttgggctcaataaatagcagtcataaaaatatacctttagagatgtgtttatattttgttcacatacatgcagttgaactaggaattaataagcccacttcccacagtaggaatgttgtgggaagggggccaggggaaagcctagccctgctctgaaagcagcaaaggctgtatatgaagatggagacacactctgggctggtgcttcctacttgcttggatgatgctttcagaaactaactgacgtcttggcctccccaagagtaagaaaccgaggtccaacaagagctaacacccaggcaacagggaactgcttctactctggccattgtgtgccaaatccaccatgggagcatcctcctatgggactgaggcgaaaaagagaaagaaattgtgggcgggggtgggggtgggtgggacactgttttcttgcatccactgcacctcaatagacaggcctctggtttaagagtcaggatgttaaacatgcttcattcactcacaactatttactaagagctaaccttgattagccagtatggttaggaaaagagttcctactacagcggcctttagattccatgccccatcccatgcaggaatttagtgatgctaagactcttgaaaaccaagaccagagtcttgagcccaccagagcattaaataccaaagtggaagccagtaacccccacggtggcagaatttgcacatagttccatgccctatgtgagaatagacccaggacatggggaggacaaagagcttctagatttcacatggcttgtctgcattctttgtcaggagggtctctaatccctgccctgatttgaacttcatggcctccaagcaaagagcacctattttaatttgatcagttgcagggtcactagggagactatcaaatactttgtccatcagcaacaaatagatttctttgttccctgggacatgagaacatgagacccaagtctttcctgtgcagtgagcccctgtattcctgaagcttggcccatgtgggtcactcagtaagtgactgtgaaatgagtggatggatgacaaaaggttaacatctcgctgtttctggaatttttccccaagagaccctgtcaaacatttagttgggtaggagctgcattaataagagagggaagaaggaagagagattacttccttaaaacttcccctacccggatacaaatattcagagacacatcataacaaaaactatagtgaaaggagaatcctgaatatactgtagattgaggtagccaaaaggaattgtaaacataaagcgagaaaatttgtgctaaaagagaagtcacatgaagaacacagctcagtagttaacttctttagctatcaaaggatagacatttcttctcattataaattttgtacaactagtgacttcatggtctttcttccaaatgtcactacattgaatgtcctccaagattttcagagaatgaaaaattaaccaacaagcacttgttcagctggacatgtctttaataaacaaaccaaagtaccattagtgtaactaaatagaaatcctgcattttcaaggtgttaaatatagatgagtctgatgaattcacttcagtaatcattttgaccagtgtttttaccaagaaattatattaactcagacacaaatgtcttctttaagcaagtcgcgaaaaagaggtaaaagtgtttactctccttcctcaagtgtgggaagccctggtctgaaggtttctctaagaattggctccactgccatttttcatcaatggcgctagacagggccaactgcctccaaagagtagtaagaattgggctcttgtttttggaaatcaaaagaactaaataggcactgggctgctgttttacaagcacaagactgttaatccccttaccttggatacagcagcacattgttcctttttagatcacaagattcatccttgaataattaggtagaggcagaaatccattatatatcctacaccatttagctcagaaaaagaaagccatgcctgagctagacctctacctctcttgctaaaaatgataaattatctaaaagccgacatttgagtaaactaagcagatgaatttcccagttgacctgagaaatagtcaggggctgtagataaataagagaaggaaggagagagaaaatttcccagttgacctgggaaatagtcaggggctgtagataaataaggaaggagagagaaaatttcccagttgacctgggaaatggagtaaacgttatagcttccttagaaattactttcaacattgtaaaatccttgtgacatcattttagtagatctggcctaaatcttataattagttgaaacacccagtttttcaaccaataactgcagagttgacatttcctatgtaagtcccaagaaaacctcaaatagaataacctatagatattagagcattcttctatcaactaagttttttcatctaccattctacttttttttttttttttttttttttttttttttttttttttgagatggagtctcactcttgtcacccaggctggagtgcagaggtgtgatcttggctcgctgggacctcagcctcccaggttcaggcgattctcctgcctcagcctcctgagtagctgggattacaggcacgtgccaccacgcccagccaatttatatatttttagtagagatgaggtttcactgtgttggccaggctggtctcaaactcctgacctcaggtgatccgcctgccttggcctcccaaagtgctgggattacagacaggagccactgcgcccggcctatcttccattctgcttttaaggaaaaccagcaaataacaagaaaaccatttaatgtaaagatttgtaaataatcacttcaaaagaagtgccttgttgctgtcacatttagtccatcttcatataattcttatctgggccagtttcttgggcatgggacatgtgcagttacacaagcctgtgctcttaagagggtcttacccatagtttaatgttctgctgttgtagtcttgaaattcttaatgatttaacaaggggtcctccattttcattttgcactgggccctgcaaattacatagcccatcctgatttctacaactatagaatagcacaatgggaattccatatggattaataatatgtgacacttacggctttttctatacgcttccaagtacttcatataaattacttcatttcattcaatggtagaattggtagatgcttaacttttaatgaaagacaaagtcagattcactctaaggattaaaaaatatatgtaacattacattttaaagattttcaaaaacaatttgttgtggaaatgaattattgtcatgagatattccccactagacggacttcctgtagggtcaggggtcctggtcttctgtagggatgagcaagcttttctgaagggccaggtgctaagtgtctcaggctttgtctgttaggactacccaactctgctgttgtagcaagaacacagcctgttagcagcagatactcaaatgaccaagcctctattccaatgacacttggtgtgtggacactgaaattggaattgcagataattgttaggcatcacaaatctttttcattttccaactgtttaaaaatgtaaaaatcattgttagcttgtgagctgtataaaaacaggtaacaggctggatttggcccacaggccatggtttgctgactgctgatcttagccctcatttgactctcagtgcccagcacatagcaggctttcagtagaggtcacttaatcctgtggctccagccacagcagtgtagttccacgggctggcctcatggacagcagtgaaggaagaggttgatgttgttcacactgttccctttgggcactctgtcagctccttcttcctcgcctcttgacagcatctggggcagatggtgtggctttcctgtcacttctggctactaaggcatccaggccagcctaaccaaaactgccttcctgcctctcacctacagctgctctccttccagcagttctggccagagcagggacctgagtggtgggctccagccatttcctccgggctccactccctactccctccctgcctgtgctcccctccaccatgcttcattctcctcacttagggacaggaaagcaaaatgatgggggtgtgagatagacaaggaaagaccaaattcttcttcctggaccagggcccttgtggttctcccggctgtgaggggtcctctgtggtggtggtccagatgctctccactcagaatgctcctgtggagccttcaagggcccctccagggacctctgcactgcatcttcccctgacatgggtgacatgctctcactgacttcctccaccccacctcagctctgcgcccaggggtgtacacctccagcctcactcgctgccttgtccttgccctgtctcacttgaggacatgggcctaacaggcaatgactccatcctgttcccttccaaagcctctgcttggccccaggaatatatcaagtgcagactactcagaaaactgccctctctccccccagtcacaggcgctcaagccaaccttccaccatgaaacttctccagctacgaggcagccactagcttcagagtatcttcaagttttctgaaatattcatggaataaggaataagaaaaaaataaacagccaatgtccaagacccctgaatccatctttggaaaggataattctactgtgttagtttcctatggctgccataacaaataccacagactagatggcttaaacaacagaagttaattttctcatagtctagaagctggaagtccaagggcaaggtatcagcagagttggtttctcctgaagcctctctttttgccctgtaatagctgttctctccctgtcttcatgtaatgtttttgtgtgcacatctgtgtcctaacctcctcttcttttaaagacaaaagtcagattggattaaggctcaccctcatgacctcattttcccttaattacctttttgaagatcctatctccaaatacagtcacattttaaggtactggggtttggaacttcaacatatgaatttgggagggtagaggacaagattcagcttataacagctaccctccagaatttttaattcactcagtctcactttggaaccaaaagacctctggaaggtagatttaaaagctaacccatttgccaagctactggtgttttccatccacccaccacactagagagaggtagtctctttgcaaagttattttcaatgccatcttgcattatgtggtgccctttcccataggaaaaggctgttcatgtaggagtgcagcttcctttatgtcagtgcatatggaatccaccccagcacctgaattgcatgttaaacacatcctgcttcattaagctgccctcatcactcatcgccttgacagccagtattgctataactcatactgcctggcagcaagatcagcatgtccctccatgcagggcacctggccaagaaccaactcttcctgcctggaacatttttcccctggcaggctcctttttgttaatccagtcccagcttaaatgacacttcctcacaaaggcctcctcctgaccacccaagataaagaagtccctgccatcccaccccaccatatcatatcattatcaaggtagttagtagttcttttcgtttgtaacgtgtttaccatcaatttctccattggtctacagatgccatgaagagcatttcctaaggacactcaagttgtcacttgtgtgttccaattttggcttgggaaattttgtgcaccgtgggcctaacagccatcttttatgtcactgtgacctatgcagttggctgctactttttcatgcaactacacacaagtaaaggtgcaagtatgtagacagtggtggccccaggggatggtttggggagaatttagcccatgacaagttccatcagtacttctctcataggcactccatataaatgtgagatctcagtgaaaggggagcttgctgccaaaatgtagtttcaacacaagtcccgtataatctctccacccatcaacaaagaaaatttgaagccaccactgtctgtgagggtaggctttctcattgactactgaaaactagaaggaatgtttcatatatcattaatggctattttgctcataggatggaattttttttttttttttgagacagggtttttctatgtcacccaggctggagtgcagtgatatgatcataggtcactgctgccttgaactcctggactcaagtgattcttcctactcagcctcccaagtaggtgggacaacaggtacacaccaccgtgcccaattaattttttaaaaatgttttgtagagacggggtctcactttgtactcagactggtattgaattcttggtttcaagttatccttccacctcagcctcccaaagtgttaggattacaggtgtgagccactgtgcccagccaggatggatttcaaactaatttacattgcagtgaaacaactcccttgggcatgaaggaagaactggctttagatgttcccttgtactatctgtaatataacttcagataggaaaagaataacttgctgaaatacaaataaaatccaaatcctcatttcggtgaagaattttaggattctctttcctcaaagttattttcataaatataaggaaaaataaatttgagtttcactatccccttggtgcctttccctgcttaagtagcagaagcacacaaagacctctaatctacaaacttgaaaatcaagaaagactattgttgattaagagttggtacatgctgtaaagatagggaaggcttattaacacaatgtagagatgatgaatgagcctgttcaagtgtagataacaatgataagctcagagcagcagataaaaatgaagatcctacctcccaggatggcatctggaagtggatagtattctgccagctttggaaactggatgaaaagcaaatctggcagaggtacccatttcattcccagcttgctcagtagctggtgattggaagaaactctgcaacagtgttcaatccctggacaggaaaccctccttccatgattcttctttaacatgggtctgagaaaaagagaaatacagtattttttaaaatgaagatgctagccaactctcaccagaacacatacttaaattgtttttcagatcttgaggatgatttaacctgatctgtcctttcattgattcctcttaaaaccaagagcttgagctggctgggtaggggtccagttttggtcacaaaagaaagccccaagctatttagatcagaacaggattgatgtagttctagattgggttgggtatcctgccagtggaaccaacttatcctgggcaagtgtgaacagattgaaagcttgttcattgaaatacatagcatacttctcctagggcattcaaaacatttcaaagaaagagcctccatgcataagtgaaattgagcatatatactaatgagaaggtgtacaactcacaagaggataaggaaagagataatagctctcaacatatgtatactctgtgacccaaatttctattcctaagtaaatacccaagaaaaagcatacagaaaaaacacgtacaagaaggtccatagcagtttagccacctgttgtgcatgtatctgacacataataggtgctcaataaatgtatataattgaacatatctttatatcccacatatggtttcacaggccaagtgacacatactagttgtgtcatcagttcatacttctagcatgtactataaatactttaataaaaaccattttattaacaatttccattttagtctattattgctttaataaaacattggaatgaggtctttaggaatgatttactcaagcttaagataactatgcagaagggcccagcaataaagaaagtgttattagaaagcaattttttcaaaatgaacactcaggtacttcacttaccgttttagttgccagagctgctctgtctcactctaaaagcattttcttgcaaaggggttggttttgatcaacccaaaaatctggcagctgtgaaaatcaaagttaatgctatagaacagcgttgtccaatgggacattctgtgatgatgggaatgttctgtgtctgtatatggcagccactacacatagatggctattgagcactcgaaagagtggtaataatgacaaaatgtgtcaaacagagcccagtgattcctaatattttatgcaactggaatgaacaaaaaacagatctacaactgaatggctccaaattatttactgaaagtttaccctctgtcattttaggtggtttaatattttctgttgaaactcataaaacagtcacaggctcaaatttcaagcctcaacacatctgcaaatttagagaaataacaagtcctttaaatcaaagatgcactcaacagaaaactggtttgtttttgtttattttttttatttttgcttggaacagagctggatgcaaaattaggttgtttattgctgttttttaatattatttttattgctgttttgacagtggttattgtccagccttttctcttactggcccatgttaatgtatttttaagtttcaaggctaactacctggttgacagagttccacctgaatagcaatttctggccaggcacggtgactcatgcctgtaatcccaacactttgggaggtggatcacttgaggtcaggagttcgagaccagcctgcccaacatggtgaaaccctgtctccactaaaaacacaaaaattagccgggcgtggtggcgggcgcctgtaatcccagctacttgggagtttgaggctggagaattgcttgaacacgatctcatcactgcactccagcctgggccacagagtgaaacttcatctcgaaagaaagagagagagagagagagggagggagggagggagggagggagggaagaatagcagttaccaggaaaagaggtcacaacatccttttggaatagaaaacaaaaggcaaacaaaaaaggaagaaaaacccactctgcacttaaagctgcctgagccattctgtgacccagattaaaatatcagaaaaagaacaaagccaccacctaaaaggtttaatgattaacacccatcatttgggttaatattttcatagaagtcacctgtctcctgtcagttatttatggaaatctacagattcgttgtttttttccagactctacctcaaaagaatgtttcctctgctgactcaaagttggaatccttccctcaccccttctgcgagtctctggttacgtgtatgatgggaagaattgagtcctatctagaggttttttggcatgcaccttccaccttttcggggctaggatacctggttcatagacagactatcttcattcaggaaacaaacgtgactcctttctctctggtaaacaaagggtgcccttccatgaagggcctcacctgactcaccacagcgggtgaacatcccaggagagcttcagagcttcctcttacctacttgagggtagagggtgggaggagggagaggatcgaaaaactacctatcgaatactgtacttattgtctgggtgacaaaataatctgtacaccagactcccgtgacacacaatttacctatataacacacttgcacatgtacccctgaacctaaaataaaagttaaaaaagaacgctgaagttgcaacaaaacctcagagatgctctgagaattaagataatgagtgtaaaagaatctttccccgtgggcattccacagatgccaatcgacgccccgcccagaggttgatgtcagggctttcctctctaccatgctgcctcttcataaattcagtccccaaattctaccccattcctcgaaaatcatgaatggcagaattagattgggtgaccttggtgttaaatagaaatattggattttcaaagcaacaacgaggaaaatatcaacaatgagacttctgcagcactttgagaaacacatcatttcttcctccttgcaagggtggtattttattgtaaaggacccatgtccatcagctaaatccaactgaggaagctttttctctctccttcatcttggtcgcaaggacacggagtcaggaaaagctgtactaaaagaagagggagccacaacttagtccagccatcctagcaatgtcactatattaagtgcaatggaaatttccagaaggaagagctcacctagctaacccctggaaaaaaaaaaaaaaaagccagactagatgaagtcatcttgggaaatgttaaactaagtaaagtcatgatggtaaggaaaaatcaatatacatagagatagagattataacaaagcattttatttgcatcaaggaagaaagctatgctaaggacatagaaacctgcttcagctttcctttagccttacacttcataaaagtatcaagtggctttctttggcttttgcttagtcatctatatagctagggttgaagacagtaaaacactgagtcttagtgtaagtcattcgtttgagaagacaatctcttttgaatgatgatttctcgatgtttgttgtatcatctttttaaaaagagcaatataaattcttcttagaaaatacaaagaagcacaaggagaaaagtaaaaatcacctgtaattccaccagcgtcaaagaatgaccaatgttaatgttttctaaatatttggaacataccattctaagccttgtgttttcttttgtgtgtatatacataaattcttaaaaacaaaacgaatcatgctattatacagctttgtcatcttctttgctgaacttaactgtgttctgtttttgtttttttttgtttttttttttttgttgttgttgttgtttttatagagataggatcttactctgttgcccaggctggagtgcagtggcaccatcatagctcagtgcagcctcgacctcctgggttcaagcaaccctcctgcctcagccgccctccgcccccacaatagctgggagtacaggcacatgccaccatacccagctaattttaaactttttttgaatggatggggtcttgcttatattgcccaggctggtctcgaattcctgagctcaagcaatcttcctgtctcagccttcttgattgctagaattacagacctgagcactgcatccgatccacagtgttactttgagtgtattcccacatcttttaataactgtctaatatttcattcattttatagatctgttgtatgcttttaaatttattttttatttttttaaattacagcaagcaatgctataataaatattctggaaactgacaaatttttattcacttctattaatatctttggtgtaaatttaaattttggagtcaaaaggtatagaaacatgtagggttttagtatgtgttaatttcctttcaaaaggattatgtcagtgtacagattatttgctgtatatgagtgtccattttccaggatcccgcgccatatattattggctctcaaaactcttttggcaaaacaagtggtatagcagtatgtaaatactgcttccatttgcaatcatttgtttcatagtacaactgaacatttttatatgttgaatggtcatttgtatttctttttctgcttatttgatcctttgcactttttctgccaaaattttcattattctcaatttttttttgcatgaatttgtgtgtgcacaggcattccttttttttttttttctttttgagacagagtcttgctctgtcaggctggagtgcagtggctcaatctcggctcactgcaacctccacctcccaggttcaagcgattctcctgcctcagccacctgagtagctgggattacaggcacaccaccatgcctgcctaatctttgtatttttagtagagctggggtttcaccgtgttggccaggctggtctcgaactcctgacctcaggtgatccacccaccccagcctcccaaactgctgggatgacaggcatgagcctccacaccctgctgtacagacattctttgccagttgttagttcccctttcaatttgatatatgatttttttgcattttcccagaaagcaatcctattatttcatgtcatctgcatatactttaaagtttctctcctgcttttcaatagtaatacctagttgttgatgttgttgttttgtctcattgtagtggcactatcacaacagagtgacataatggtgggataacatggacacttgtcttcttccttactgtaatgggactatttctactccacataatctggtgagtcactgttaaatatgatttgttttctgataaaagtatccttttatttccagtttactaaaaattattttaatcagtaatcaattttgaaatgtaactatcttttcagtatgtattattatgatcattgggttttttaatcatttagtacttttatactgataaatttctttacattgatctaacccttatataagttaatttttatttcaatttttcattatttgattttgactattttagttattttcagcaagctactagacatattttgctaggtttttcctaagatttttagctctgttttcatgaagaatagcatataggtttcttttcaggagctaattcttgaagatttttcctttttattgccaccttgaatatggtatagaaatatttctagcattttctgtgttttgaaatactttaaaaagcatatgaaataaacactttatggataaataatctgaatcatgcatatttgtggtgagaagttctctgaaaacttctcatttcttccacggtcatttgtatcagatttcatgaatctttctaaatccatttagactctacaatttccaagacaatcctttaattcattcagatttttcagtattctcatgagcattataggatattttctataaaatatctgtttttgttgctatgttctctttatatttgctagtgaatacattacttttttctcagtttcccattggacatgccagaagttttgctagttttttgttgttattttttcaaagaacgtgctcttggattaattttcacttttattctttctgtttcctgattcattcatcttagttcattgattaagttatagttgttttgctgttttgtttataactcttgagttgactaataagcttgtttacttttggtcttagttaataatgaaaacatctgtggctatggattttcctccgagtactactctggctatatgacataagaaatatagatgtatagtaatctcattatcattaattttcagaatagtctataataacagttttcattttttcctataacccagttattacatttaaaagtattttctaaatttctaagttcttttcagatttaactctaaatatatatgtatcatattttaaatattgttcttattaatctcaagcacatgaatacatatttaatcttagagtttatgggaggaaatctgtacagtttacttttaatatccaaatatattttgtaaataacttcaaataagcatctgacaatattcatttattattgttatttgctctggcattctccttttttttttttctttttttaaatttcaacttttatcttagattttcgggggcacatgtacaggcttgtttgttacaagggtatattgtgtgatcctgaggtttggggtatgattgaactcatcacccagtgagcatagtactcagtaggtgatttttcaacccttgtcccccaccctcctcctcttgtcatcccagtgtctattgttgacaatattctttttaaaggaattgtaagtgaatattgcactgttacatttctgtttttaaaataaaagcattgtcttgactttcacattattttaaagcagatatatcatattaatatgattaatactattaaagggcatgaagtggaaactttcttaaggtagtaagatttttatatcaggataaagctaattcttgcccatgggctgatgtactcatatgtttagatttgtttgaccacagcaaaaaaaaattgctaaatgtgcggcccaaagtggcaagatttcagttaatgacttgtatgggtcctatgagataaataaaaagacaaaagctcaaatgacaaatttgcgacactgccaataacttgatttcaaatatgaagacaccacaggtgacatgtcacatagaaggtacaaaaaacaaattcattgttaaatagcttgatggagatctcagtaaaataaatagaaaatggaactagatactaggattcttgcctctcaagatattatctgtatttttttaaacttttcaaaatcttgcacaaatttagtgattgtcttgatgtgcaagctttttttgtttgtttgtttgtttttgagacagagtcttgcttcgtcacccaggctggagtgtagtggcacaatcgtgactcactgcagcctccgcctcctgggttcaagcaattcttgtgcttcagactcccaagtagctgggactacaggtgcacaccaccacgcccagctaatttttgtattttttgtagagacagggtttcaccatgttggctaggctgatctcgacctcctgacctcaagtgatctgcctgcctcagcctcccaaagtgctaggattacaggcatgagccaccatgtacaagttttaagtagtaagttttcagaatctttatatctgtgtaacttgcttcataaactgctcatttcagcaacttcacataagggagcttaataacttattagtaactgtggtaatgatgacaaataaagcagtttgaatcattctgaatatgttactatttacttccaaatgttcagagtttagagcatgtagatttaaaagttcagatgactgttgccatgagccacacaaaagggcaccaagtctcctgagatgggaaaaagaaattgatttctctgtgttttttatactccacaacactcttgaaaagcactttctgggcacataactattgatctactgctctggggtaaatatgagatcacatgaaaatgaaacgtgtcattcttttgattcatgcaagatgccttttaaagttcatcagagtcataaaagcatgtgggcatatgtaggctccattcacctgcaataaaacgagaattagggagggctgatgttccttttaaatttgactctgagtattctgtttcattatcacagaaatgtagtaaacatataatgcctaaaactagtattataaattgtgaaaccatttcaaatgtgatattactctgtaaatttttattgggttttgggaaatttatctggctgtgacacattaaaagaaatcaaataaaacctttaatggctgaatatggaaacgttttataagattttaaaatcatgcatttttaaaaccagcatctaaattatttagcaccattcagaaattttctagaagttgtagatttttaatcacatgtgatccttcatagtttaatgcaatgaaattgatatgtctacataataaagcaatttcaagaggtttataataattagcccaatatttgctgaataattaagaggtaacaaaatggttctattctctttaagctatcattaggttaagatacatatggagattaaagatttttgcctcatgtgcaaagcctattctattttaacccaggggttctcaatcaggggcaattttgccccccagagaacatttggcaatgtctggagagacatttttggttgtcacaattgcagtgggcagggatgggggtgctactgacatctagtgggtagagaccagggacactgctgaacatcccgcattatgtagggtagctccaccacaaagaattatctgggtccccaaagacaatagtgctgaggtggagaaaccttgtttcaacctaatgttgctactttcattgtataaatgattttggggccaggtgcggtggcttatgtctgtaatcccagcactttgggataccaaggaggggaggatcacttgaggtcaggagttcgagaccagcctgaccaacatggtgaaaccctttctctattttaaaaatacaaaaattagccaggcatggtggcacgtgcctgtaatccaaggtacttgggaggctgaggcaggagagttgcttgagcccaggaggcggaggttgcagtgagcggagatcacaccactgcactccagcctgggcaacagagtgagactgtctcaaaaaaaaaaaaaaaaaaagatgattttggataatagatcatgtatgccttcctagtttcccaatattagaaatagtaacttagggtctagtgttttagagacaattttggtgctgacaccttaattggcatcattacttttattgttgacatgtataaataaataagtcctatactgaggaaacctcctagatgtaggtgtagtgaattttctctatacctgcttaggtaacaatgattgagttcaatcttgaactcagtcttgactgctgcctagcaacttcttgtctcagtactgcacagtttaccttgaagagttctgaacttggacttgttcatcttaaactgagaagaatgcaaagagtttgcttataaacttttgcactgcttgtacaaaatgaagttttaatttaacttcagtcttttctctttttttttttttttttttttgctgggattacaggcgtgagccactgtgcccaccctcttttctcttttaaaactctgtttttctctacggtgagcacagcattttgatat
